United States Patent 7,892,730 (COMPOSITIONS AND METHODS FOR CANCER) - sequence listing, part 14

SEQ ID NO: 1435 - DNA, 117382 bp, Mus musculus
  misc_feature (1)...(117382): n = A,T,C or G
tcaattaataggaatacatgctgtgcacctagattgggcagatctaccaataccatcttccacatctatgagacccatccaggccatgtgcttctgctctgcttttcttcttcctccttttctgtgccctctccctctcccattttctcctccttctctcttcccaccttcctctccaccttcccttttatctgcccaatcatcagttctcctttattttacaaattgaggtgggaagcaggtttacaggaaatcacctgagtgctgactcattccttgttcacaaccactcacaagagaattgaccttaaatataattagccccagggctatccacaacaatggggtgtttcaatcttagaggaaacaagaacaataatccccccaaaagagaactaatcccgcatgaaggtacagagaaggtaagcgtagaaagacttcgatgcctgcaaagaaaccagtcctgcttacagcctaagagttaggaagatattggttgtttataccagccaatctgtgggactccgctatggaaatcataggaaactaacacagtgacctaacatagaattgggggggggggtctcagcatcaaatagcagtaatagtaacagtgtcactatttactaagcagatcctgtgagccagggtttgggttacacacatcctcccccacccaagtattatctcatttagtattcatgtaacctccgtgagtcataacctttccccttcccccaatcttctaagacgatgctgaggctcccagagcccaaggctacctaattacaaaactactaactggaggcataggatctagaattgaggtctgactagggccattatatcctggtacaaagaaaatggcttctcgtcttttgggcacagaaagcccctgtgtcagagggcaggggctagcgagcagagggctggttggctttcagtcctccttgcctctttgggcaaacctccactttacaatgacctgctctgtagcacaggtgctcagttgttatattggaccagctgggggttgaggtggctgtggtagcatcaggaggtacacaggggtcatgagtattggggtgcagttgagaaagaggccccgggggctccttgtgacctttaggaaggcattagacctcccttcagccctgttatgctcactggccttagcacacccccaatccctccggtctctcagtcagcaagaaatctagtttgcaggatcacgtgctaggatgacctattgacctttttaccaccatcctcgccgtccctactattaccaccaaaccaaaaagcccaagaaatgcctctctggctgttttatttgactccgactttcagcgtctatgcctttcctcacaattaaagctccatttcgctctaaagtttgcagctttcatgaagagggaaaagggacctttgacaccgtaaatatttaatcaccattgagatgtccaaaagatgagggaatggacggtgcagattggctggctctgagaagcaacaaaagaagccatagtggtggggcagggggtgggacagggggtggggcagggggtgggcaggggtggagcaggggtgggcagggagtggggaacggggtggggcaggggtggagcaggggtcggaggtcggggtaacctaaaacatgccatctttagagcttaaagtggctcacattcctattcactaagtgtgcctgagctatgaaggaagctagatttattaatttatttatctctttaaatattgggcggggtgaactaagatgagatctggaggtgaagaagtctgacgctctcctcctacttctgttttggtaaccatgaagagacacgaaatttctagactatatcgaggtgactgctggagttcagacgtgggggagaaaatgtctaaagaaggaaaaaaaagagctgtctgttcggttttgtgtcttgtttgaaaatacacttcaaacattcgacagtatttcggagatcataactgcctatgcccccaccacctcctgagcccttggcccccgggagtccagattcacttttaagtactttttagctttatgttttaactggaaaaaaaaataatcttgcccagtagggcttccatttgtttctatcaatgggctgaatttagtttaggaaaggctgtggagaaagaatgaaatgtgccttttccccttgccagatctggacgcaccaaccgtttggaaataaagggcatgcaatttgccaagtgttcctgctgaagggccatcccgcatctcttctggatctttctttgaggtaggttgagttgatggttatattcttgcaggaagcaagtgataggaacggaagcattaaaggggtggggtggtggctgaggtatgggcatggtaagggggcaagccaaagctggcatcagtaggaggcgctgcgtgctacaggtacagggtgaggggtgaggggtgctgagtgaaccagggcactgagagaggacaccccgtggagccaatggccttttagaagacctggtcacagctagtatactgattatcaggtagggatctgggggggctaagcaccccaacttcaccttagctctccactccggggtctcccacagggcctcccattggctgaatccaaccagaagccaaactgtccttagatgcagactttcggtatagaacgagactgggaaggcaggagatgataggaagaactgaaggcgacgcagccaggatggataagaagacatacgcagaaaggattgaggaaggaggggtaggttaagttctgcgggtatcctgacctaagaactcatggtgctgtatataggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctactttgaggccgcctgggctatacggcaagaggctatcttaaaacgcagggagcagggggattgaaaagatgactgctcttgcagaagaccaaggtttggttcccaaggcctacacagtggctcacaaatgtctgttactccagagccaagggatccagtgccctcttctggcttctggagacactaggcacacacacagtatgtggtatatacacaagcaaatacttataaacgtgaaatgcaatgattttttttccccaaaggactgggagacgtctcaatcaggaaaagtgcttgctatacaagcttggggggtctgactttggatccccatgtaaatactgggcgtgatggtgtatgtcagtaacccctaggccagtgggatggaaaacatgaatccctcgggctcactgatcaattagcctgtccagccaaatcagtgggcttcagattctgtagacgccagtgctgacctctgaccttcatttgcacgcgcacacacgcgcacatccaaccccttgcctgccccctccccccccacacattaaaaaagaggggaaagccaaaagcagcagaaggccaagaaaagtattcagctcttacatttgagatttggtgcgcgagacgcttagcatcagcaatccaatggaaccatcacgccctcaatacttcccaagcatggatgaggacaagaaacgcttccccagtcttccccaggaccacgtgcccagccaccagccagccactgcccatactcagaactcattccaggctacatggcgatatttcgtagggagggcaaggactgtggaataagccgcgtgtgctccgcagagagcgccagattgctcgcccagaagtccagccacttcatcgtcagctgagagaatctccccaccagaatctcgaggaagcggaagcacaagcgactgtggagctatctgcctgttaatcttatcttctgctattcattttaagagtttgagttattattaatatgaaggtctgctttatggcagctcttcttgttgaatgagtttgtgccaagctgcctgccagttatcaagggactcaggggcccagggttacactaacagcgagtccctgagatgtgatgacagagacatgaaaagattttttttttttttgtcctaagagggatcagtattttatgtttaccctcaataaccttttggcgcttcatttcaaaggaacattaagaaaaaaatacaagcaaggatagccacacatttcaaaaataaatctttatttataaaaaaaaatttaattttaatttaaaattaatttaaattaatttaatcaattaatttagttaacttaaaaattaaataactttaattttaattttaagagaccacccaggttgcagaagtgtcctaaagctgaagatgtaattagccgatgagtttgcctacttcctgcagatctagaaaactcgatggtcgctgatgacttaacggtattttgctgtcaatcaagggcggcctcagatccttcaccacaggcagagcaagtgtcggaagaaacttcaccttcctgagtcagggccgtagtctgttttctattgctgtgagaaacaccatgacaaaaagcaagctgagggggaaagggttaatttcatcctgcagcctacagcccatcctgaggagaagagaggtcaggacctgaaacagaggccatagaggaacactgcttactgaactgctctctgcccttgctgatccaactcaggaccctttgcccaagggtggcagcacctgcagtgggctggtccttcccacatcaattaataataataatgataataataataagaataagaataataatggcctgcagatgtgctacagaccagtctgatggcggcaaattctccactgaaattccatcttcccagatgatacttgtctgtgtcaaggtgacaaaaacttaaccagcccagcctgccgcttctgtaacacagcaccgagtgccagggtagtttatgtcctggactctgcagcctctgagaaaaattggcatttaccaccctttccaaaggcccttataatattgaaggctcttacaggccgtaaagaaaggcagcgttgggactttacgcaaagaacagtggttttgaatgtccacctctgttcttttgtctgtaagtgttactcttctgggaagcaatatgtaatccaactctgctgagtcatgacagagaaagctgacaactgaaatgttggaggtgagcccatcacacaatccagccttcttacaggaactaacactgggtactgtcaccaagcatagaaggttactctccatccatccatccatccatccatccatccatccatccaaggccatgttgactgacagcaggacctgatcttacactccctcagctcttgcgcgcgccagactcgaccagcaaggacgctgcaacaggatccttctgcacacgtttattgggagagcttgattgtagaggcgaagagaccccgagcccagaactggtgctgcttttataggcctaggagaggcgtgtcttacaccaggattggttatgcactacgcctcatttgcatgttcctcatctgattggctactctctctctctctgtacctcacagagcctcattatcatacctcatttgcatgtctcacatctgattagttatactctcaaagcctcattaccatgcccgggccaggcactgtctttgcaaaaaactttactgcatatgtacacattggttgtttgtccaaacttatacgtggtggccagcagtagtcagtgccactctgcaacggcacatgtggcttcccacactcagccacaccttgaaaacttgtttaaagtgtggatattcttgaccaatggtccttgtctgtggatggagaaacactgagagggagagagacaagaatgctgggggaggaagggcaggcccacctggccagccagcttagtcagctcaactgcgatcaatgaggtgacggacgtcacagccagatccctcagtcatatctcatgactgcgctgaattcaactgacttctattggctgaactgtgttcaactcatctcttagcatccactcaaactataaaacgatacttcctctagtgtactttcaactatctgttaatctgaagaccaggaaggaagctggctcaattcattttcctgtcagtcaccaaaagggaccagaaactttgataaggttttcagcccgaagaccacatagatatgagcagagttgtggagaggcaaggtggcctgtctgaaattccaggaggccaaaacagatgtgatctctgtggaattgggcaaggtgtcatcgtagctacaaagaaagggtgtgtaaaggatctcttgaccactagaactaacattcttagttgcttctggctcccatcaacccaatcagccctttaaagtatggtcagttaaaaaaaaaaaaaaaaagcaaaacagaagagtgaaatgtgaatgataaccatcttgtgactgtgaccaattgcctactgaacagccgttcttaacgtcccaagtcccagcaggaaaccacagaatctataaagccctgtccagcagaaatgagtctgattgtagatggcttggttaacccagattgcctccagtgcctgagggagtggatattttctcattatggagacttttccagctagcaaaggctgtgcgtacaactgctcagaacccatctgaacggcccgtttccgtggtagcaggtctgtctggaggacagatctgtatcaccttcttttgtttggttttcagccatttgtgttacaagaagttctgaaatgtgtcataagggacacccaacaagatggatgggttcagtcaattggtgagggatgagtgagctatggaccctccgccagatgggtgtgtctaagagaaggcctttaaagaaatacagaccctatgcctaaatatttatatagagttgttcatatttcccacacttttcaaatgtgaatgtgcgtcctgaaggtggagctttagtacaggagaaaattgggaaggggcaaagacgtttgctcaaaatggggcaggaccagtgaagaacctgtttccaggtttcttaatcgcctacatttttcatgcccaaaagttagcatggattcgggtttcttccactatgggagtctgcacgcaattaaacaggaggagagagagaaagcctgcttgccggaatagggcttatggtctcagcaaactaaggagatgcagggaccatcagaaccctttccacaccttgctggtaatttttgtaggatgttgtttcttctttttcaaaatgcagcagcaaagaattgagcagtgagcaacgtgccacaccatggagtatgtttaatccaaatagcttccaagatgctctgtgactgactgtagcaactctgtggggtttagggaaatggcttgcttaccagcgaagtaaggctatctccaaaatggaattgaatgctgcttcttggcccataacactgccacagcccatctgtgagtcagccacagtgactataggagactgatgcatgtatgccctatgttggagaggaattattttgctatttatttatttatttatttatttatttatttatttattttcggatttgagtgatgcaaaaaaaattcttaaaatattccaagtggtggagaatgagttgaggggggtattttttttaagcaagtaagccacttgatttgcttcacttaagaggtccatattaacatcaacctagacctacattccctgcttcttttttctctcctctactttctgacactacagaagaggtgacctccagctaacatctgagagcatcggcactgcccatcagcagagagaaacaaggatagccagtccccaaagaggaggttgcacatggaaagatggccacggaccatcttttaaaagccactgctgaaggaatagtgtgtgtgtgtgtgtgtgtgtgtgtgtgtgtgtgtgtgtgtgtacagcagagagaatggaagtcaaggcctggctgagctacacccaccccctaatactgtactgtacatctagattagactttcaagcttcttgcccagttccttctcctcccttctgcctttcgaagctcccatctcagcagcgggaggaacagatctaagcagttctgtggaagtgtaaaacctgcagcaggtgacctgtgaggaagctcattcagagcccccttaaaaaacaatacagattcctatccagagcttggctgacttggagctaagaagagaagatcacacagcaaccagttgcagtcctaggaagatctaggaagaatgcagatcatttcttaaggacccatacgggtctttagctccctctccattcaccacagagttgaaggcaccaaggcttgcctctgggaagcccacttctgagaaaacatgagcttgcctgctccccagagcacagtgatctttctgttccagaaattctcggtggcttgcgaggtgggggaaggggggagcaccccagctgacagttgctacctggatgaagtggtggagggagcccctctagaaacataagagagctccggactcttgagatgcgagccctggctgctgagcccaatgtacctttgcctttattctctggggagtgtagtttagtggccacaggtggcactggactagcaagaaacctgtaagaggctccggtgtgaggtgtggattcgaatctctgctgtgctatttgctaacagctgtacccgggcaggttccatagcttctccaagacctttctcaaaagccgagtagggttgatacaagtcactaattaatactgtttgtcccaagcatcaagtgaatcaaaatctacatggtgcatttagaactatgcccagaacggagcaagttctcaataaatgttagcttttgtcactagggttagatagtgagcagaactttctaagtgctatatctgagagcctgggactccgttgccaagggagaccagggagccttttcaaatatgagagctctggcccgagggattgtccacaacgagagtgtggcgcctttctcctacctcactctgaccgagggaaacccacccccggtcacaggggcgtcttggtccccctcagccgcctcccgcttggccccagccccctggcgcatctctcaggcccccctcccgccgctccacacctgtcagccgccctggcagcctcccaggggctcaagccctgggcctccgccgcaacccgttcgaccctgggtcctggctccgcgagcctcgcgtttgcccggggctgctctcgtaaacaaaacccgggcgttggagcagccccgcgggctggggagcgcgggagccagctcggtgcgcggttccggcgccgggggaacccggggcgagcaaggggcgatggtggcagccgcggcggccgcggcaggcggctcagctttgttatgaatagatgaaagaggccacctacacagtaacccaaattacgagacctccctcctcccgatctcaccgaatcaagaagggaggggagatgggcgtggagggagggcgggcgagaggcggagggcggaggaggaagaggatgaggaaggggccagttgcatcccactttcacaatgggaaagtgaaacgcacaagcgcacccaacctctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcgccctgcccgggggcggcccccctaccccatggaggtctcccggagaagacgccgccgcgccccccgtaccccgccgcaccgttgcccctgatcgcctatctgctggcgctggcagcgcccgcccggggcgcggacgagccggtgtggcgatctgagcaagccatcggagccatcgcggcgagccgggcggacggcgtgttcgtggcgagcggcagctgcctggaccagctggactacagcctgaagaacaggctctctcgcctataccgggaccaagcgggcaactgcacggagcccgtctcgttggcgccccccgcgcggccccggcccgggagcagcttcagcaagctactgctgccctaccgcgagggggcgaccggcctcgaggggctgctgctcaccggctggaccttcgaccggggcgcctgcgaggtgcggcccctgggcaacctgaaccgcagctccctgcgcaacggcaccgaggtggtgtcatgtcacccgcagggttcgacggctggtgtggtgtaccgcgcgagtggcaccgacctctggtacctggcggtggccgccacctatgtgctgccggagccggagaccgcgaaccgctgcaaccccgcagcatccgatcgcgacacggctatcgcgctcaagaacacggaggggcgcagtctggccacgcaggagctgggccgcctgaaactgcgcggtagtgcgggcagcctgcacttcgtggacgcctttctctggaacggcagtgtctacttcccctactatccctacaactacacgagtggcgctgccaccggctggcccagcatggcgcgcatcgcgcagagcacagaggtgctgttccagggccaggctgccctcgactgcgaccacggccaccctgagggccgccgcctactgctttcctccagcctggtggaggctgtggacatctgggccggcgtgttcagcgcggccactggagagggccaggagaggcgctcccccgccaccacggctctctgcctcttcaggatgagtgagatccaggcgcacgccaggagctgcagctgggactttcaagcgactgagcacaactgcgtaagtccagcccccggggttcagatggagtcttgggtgacacttaccaagtctcaggttcactacaccaccgactggccgagattgcaggctactctaaagcacagtctggggtccccaaagggagcgtgtagaaagggtgacggggtagcggggaggattggagggaggttcaaaactctagtggctgcctctcatctttttagtacaaatgcgggcgcttgtttaggactgagctccccccaaccccccgggcccgggctatcctctgttcctaaccgcttctccagaccagagtctcagtggacatgtgggcttgaccctttgagctaacagttactaatgcccttacagaaaaagctatcgaacctaaaagactcgccgccacaccccggcctttgtgccccccccctccacccaccccaccttccaatctctggctgcaacctatgtgatgtggtctgtagagttgtggcctgctccgcactggtaaataaatgctatggtgcaaaagccgctcgcagaccgcccagcctgaaccagcgcgagggggcggggctgtggctagccaagggtggctgtggtctcaacctggtggagagaaccctaggaggcagcttatggtgtacaaagcctcgccctgaaaaggagaaccgggtgtgtgtgtgggggggggggcggtttggaaagtgttggggtgctccaggcagtttctgggctgcagatttccagactagattgcggggctctctggcaccacccttgagctgtgcctaaaccaggcaaaagacacaggtcttcccctcagggctcacagggcagccacagcttgaaatctcgagattgacagttctttgaccggaaaatgaagcgacagttcaagagggtctcgctgatggggattacggaggctttgtgtacttctgcagaggcctttgccctcccaaggcttctggcaagtaactctgcatatggctcctgagagtgaagcctgctgagagcctccttaatcactggacaggattcaaagagcagaaacggagggctacaggagttgctattgttttgctgtaaaatgaatccgaggaggaaggcgggtggtagtggtggggagtcttggagtggagaactgttgcatgtacgtttattgtgtaccagggtgccttgaaacatttcccctaaggtatattgatatgcgggtagaaaggcactcccctcccgccctgcaaagcacaccttaccaaatattagtcttattattcatggagaaaaaaaaaggcttccggtcactcgctccttctctgctagggcaagcacatagccatttaatttcactactagtatacattagcaaatacacaaagagcacaggttgtaccccccccccccaatggtttagccttgctgtaagcatacaacttaatatttaatatcttcctttatatatcttcataatctaatcgctaaagtttggtaaatcactgcctttttttttttacttctctgttgaaagacttgaaacctcccctgcccccccccacgctccacgcgcccccattttactttaagtgttaggcagtttgtctgtggggttaacagcaacagctcagaggcccacagcaggtaactaccacggaagtccaagctttgccatctgacagctgtgtcgatgtgcagagccaaaacatttctcttgactgcatctacctagtgggtactggaggactcggtttccttccaaacccagcatgcatcctgaatacactcaaaagccagtttttggctcaatcaggtgttcctacttgcatcgggatggggaggggcaggattagtctagagctgtttatccttcttcctgagagagagctgccccttggaaatcaagcaagggataaacacaggctgccaaaaatctggaataggggggaaaataaataattaattaaacaggtccctgtacagtgcttcttgctcctgttatttattgagaactcccagggcgcccagagctgtgtgttctgaaagatggggtctctaccctctgagcttgtcatccaagttaaatgatatactcaggttcaaacaatagctttccttggctgcacaggtgggagctgggagtttgccttttctttccttttcttttcttttcttttcttttcttttcttttctctctcttttcatttaagtaaactctctgctcctggaatgcattaaaaagctttaatgggattgcattttaagaacatttgaatgaaaaaaaaataggtggtagttttgatgaaaaaaggccacaatttgctaaccaattaaataggcagataagatacttaactcaacaaatacttgtttgatggcctgcttgtgtgagcctgtgagctatgctggatgccaccgactgtgccagcaaagagacaatagcaggttgcaaccctgtttaatggggtcatgggatcagtgtggcctcggttgtcactcacggagaatgttgtcacggagattgcatttctttttcgggtcttgaatgtgtttttgagaggcgtgctgaattataggtgcctgaaacaggagttggacctgaaacactccatagagggagccccagcagactgcaacagctaacccttcctagcaaacacaggctctcccaccccgattttctttctttccttcttttcatcagcaattcacaggctgccaaggctcaagtgtctagatttgcttgccttcttctatcccctcccttgccagctggtacctgtatggcccatcttccaccaacccatggtaatgatggcactggccaggcagtgtttggtctcttatctcccaactgctcattctcgtccctgctgaggattaatttctgagatgcaacgagtgtgtactcaatgtttcacacacaaggcactcccccctccctctccccctcctcctcctcttccttcttctcctcctatttcttaccttgccaccaaatttcagtgtgtgctttcacagagatcatccgttagctgcagaccccaagcccaccataatggccaatctctgcaggcccactctctgaggcccctgatgggcatcagagtaacaggccctcccgtagagagttttgtgacagcttgacacaagttaaagtcacctgagaggagggaacctccatgtgattggactgtgggcctgcaagcctgtagggcattttctcagtaaaggcttgatggggaaggacccagcctattgtgggcggggctacccctggctgctactcctgggttctataagaatgcaggctgagcaatccagttaagcaacacttggctgtggtgctatggcctctgcatcagctcctgcatccaggttcctgccctgactttcttcagtggtgaacaatgaggtgaaagtgtactttaagcaaacccttcccttagtagcttgcttttgatcatactgtttgaccccagcaaatagaaaccctaactgatatccctccccaaatgatgcttccgtgagtccttcagcaagcccgacaggctggttctgtgaaaagcatcccattttccagattgaagaagctatggtcaataacaacatgaatgccaaagtcttgaagctcaaacctaggcctcctggtatatagctctgtattcttttggccatcctggttcttctggaaatgtcccctgaaagttccctaatttaaaaaggcagaaaatgattgcccttagggcagtggttctcaacctgtgggtcgcgaccctctgggagagaggtgaatgacccgtttgcaggggtcaccatgtcagagagcgtgtctttatagtgcaattcataacagcagcaaaattgcagtaatgaacttagcaatgaaaataattttatgggaaggggcgtgtcacaatatgagaaactattaaaggtcacagcgttaggagggttgagtagcactggtctacaatgtgactttgagagtagagggtaccttctgaagacagtatttgccactaattttatgttgagctttaaaacattacatggcttattttcttcattatgttctacaatgtacctgtgtttagattaatatagaagtgaatgtttttaattatgtgctttagtttatgaagttaatttaactacaccccttctggcacaggaattcccgaaaggtgtgtttgggtctgtgaagatagattatgctagatttgtttggctgcctcagttgggtcctagggttgcctatggattaaatacaactgttagccctctgtagaggctattgtattttctcatagtttggcttatagcattgattctttagttctttctatctgttgcaggtagatatgtacacaccccccctttcttcacactcacacaactctgatgtaattcagttgtcatgcagatatgcaaccacaagatgattgcatagtctccaccaaccacagccaagacgcatgtcactactgtgaggtgatagcccagttctacttggcagtgtgacccgctgacctcaaaatacagtcttcctgtgtttattaccctttcagtttttgttatgattctgtacagccttttttttttttcatctgtagactagatgggcaattttacctttacacacatctgacatgcaaggggtggattaacacaggacaagtgtaatgatggagcccacttagaaagtgggaaaaagcaatcatagctgctatcttctgagcagttatcatggctgggtttgtgcagagcaatttacatgccttattttctgttgattctcagtcaccatatgaggcaaggactttagttattatgatgattatagatgagaaaattgaagcactgagagcttcggttaggttcctagtttgcaaatagcgaaggatttagagcttatgtgatcgggctctaggacctgggtttttagccactgctgtggacagtcagtccccacagacgatgagttttagtgttcagcctatcctgtgtggggcaggcgaggctccaattgataagacaagaccagctgtttgtaggtgatggagcagagaatccttgtttgggaacagagtttttgagtttacatctctcaccatctgaattactgtctggtgccccgtgtggtttctcagccattcatttttttgctaatattgtttttggcatttgggcctgtaaataaccttcatgagtgttacctcttcaagccccagtacctagtgcagtatctgttgtgcagccagacactaagaagtgtctattgaatgaacaagtgacggctcttggaggatcaaattggaaataaatgcactctatacttagcggcaatattgtcctggttctggtcaccatatattcccttactcgtcttccttttcttaatagctgatgtgtttaggattccttctcttcagcttcagggttagatgctatcctatctactctcccggctcttcatagcaatagccagactgcttgtgttacaagtgtgggaggcatctttggccatagaaacctccgtgattggtatttctgtggttgatctaacaacattccaattctagagggaagagctttttgttgtaggtcagtgtttcttaacatgtggtatatggaccaccagtgccaacatcacccagagatttgctagaaatgtaaattcttggacctaacatagaattactaaatcagagactctggaagtggagtaaggctggattcgtataagtttcctacaagattgaaataaacattccatactgctggggagctcctgaatcaggaagacaaacaactcgaaatagctttaggaagaccctgaagctgaccagattcatgaggtccctccctaccagactggaagctgagctacaagactttcagacaaagcaagctacgaagaagactctggaccccaccagctgcctgaaagaggcagagaccagccaagctgtctagaagaggtttagattacctgagggacctagaaaatgaattcttcaacctgttgagctgcctgcaggctatgcagtgccacttcagggtcccagctttgtgagctgtcactcatgctggggtgggctttggtgatgcagctgtctttgagtcatttctgctcctgtaagtgaccccaataaagctcacggttcagcaagttggttcagcaagttggaatttggtgctatcggcactatggtctgtcatgggctgtctccctggggtgagtagacaggtgtgtaacatttctccaggaaaagtcttgtcacacaaaacatcaggcaatttttgggtttccttattttattgtattcatttcctatgtatgggtattttgtctggatgtgtatctgcgtaccatatgccatgcagtggccttgtgggctaaaagacagtgttagggcctttgggactggagttaacaggtggttgtgagctgccatgtgtgtgctggaatcttacctgggccctttagaaggacagacagggatcttaactactaagccatctctccagccttcagtctgtatttttaaacaggcctcaaagtgatttgaattcatgcttcaggaaaagaaagtgaattccattgtgctccaactgtggtgcctgggaaggaggcattgtctcatttttctcccttgtattttatcataaaatgcctactaagtgctcacccaatcctgttactcctattctctccaaacatgtgattgcccccagcagaccctgaggctggattccctcagaggagaatgatagaggagccaaactgaccaacccttgactataatagcatgatttcatctgtaacagtgtgacatcatctataatagtgtgatgtcatctataatagcatgacaccatctcacttccctcaaggtttccttatgacttccttaaatatgtgtaggcacatgaaaactggaaagcctcaaagccaccatggggacaattggttggaatcatgggtctagtttatttaccagagccaggggaacaacaaacatggaccacctaggtctaccatctttctgtctctcactcgaaaacagacttctaagagataatgataaaataaagtatcagtttgatctgatatactcacaaattttcttataatattaccttcatgaaatactaatttgccgatgtcttagggttttactgctatgaatagacaccatgaccaaggcaactcttctaaaagacagcatttaattagagctggcttacaggttcagaggttcagtcccgtatcatcaaggcagacatgatgcaggctgagagttttacatcttcatctgaaggctgctagccgaatattgactttcaggcagctaggatgagggtcttaaagcccacacccacactgacacactccaaggccacacttcctaatagtgccactccccgggccaagtatatatgaaccatcacagccaatgttcatgttaccatagctgattcccccctccccaacccccattacttgaaaatagctttcccctgctccttccataatatatcaggattacagttatctctgtccctctattcctctcagttcctccccacctccccagccacccaggttcaccatctttctgtctctcactcgaaaacagacttctaagagataatgataaaataaagtataataagataaaacaagagctaatgcatcggaataggactaaacaaacagaagaaaaagagcctcctaaaaaggcacaagaaacagatatagatgcagagacacacaccccttcctcattcgccataatcccataaaaacactaactgggagccataataagcaaaggacttacaaggtagacatttacacatatatattatattacatataatatatacatgtgtatatatatccctgccacaatattgtgagatgaacttctaaagatgccattggactcattttctattggccatctagtgctgggcatgtggcctaccgtgaagagtagtttgtttcccgagtaagactgccttggaggaagctaaattttcattttcaagcggttatcagttgaaggtggcttctgggctagagatggggacatgggtacacttctcttttctgctgtaggaccccatgtggcacagagcagtgcaggctctgtgtgtgcatgctgcctccatctctgtgagtctgtgtgtgcatcaatcctggtgatgttccccggagagcctccatcccctctggtccttatactctctctgccttctcttctgcagggtctgagccctgattggggtggggagtgttaatggagactcccgttaaaggcttagagtttcaacagtagctggtttaatgtattagttcctctgctccactattgcttggagtgctttcttcagagaagttagtggttggggaacttggcactatttttagcccaacaaccatgctgttatacagacttcaaaacttttctgtaaagagccaggttgttaacattttactctttgcaaactactcttaatctcttaattatggttaatctcttaatcatagctactgacctcatgttgttctctgaatgaagccagggattggtatataaataagcccacagagctagggccctatgaaatattatggacactgaaacctgaattccttctcatttttatttgtcatgaattattctcacccctccccctaaatttcaaatcatttaaaaacgtaagaactactcttggctcacaggctattcgaatacaggccagatgtggcccactggtagtggcttgccaatggctgctctcctggaaagttggggaggaaagcaagccttctccaaggctgctattccatctagaaggggccatgacagaagggcttggaagccctaagcaagggtgtcatcatcagcagagggagacccagaaggctccagagcaggggcaggacgcttgagcggtgtcttgaagcttagtgaagaaggcagacaagggagtgctggagagcatccagcttgctcgcaagtgggatgttgaatgagtctctgagccacaagccacttaccctggctggggagtgtccagaattgagtgtgcaggaccagatggcgaagggcataatgagacaagcaaaggtgggtaggtttacccggatggtcactttcagactttccaaaccttgctttttaaaataaacacttgcccagaagctccgtgtgttccaaaagaacagcgggtcctctttgacctgctgttccaggaaagagccttgccaagttcaggggtgctaggtgaagcaggttgcaaagtccccagatcccacagcttgccccaccccccacctgcatccatgcgtcatcttcgggatttctgctgagcttggtgggaagaccaagactgaggatttagggagcagcaagaggtttagaagcacacccaaccccagtgtgttctagaaagatcactcacgataaagtgggtaaagcaactgattacaaggacagccattggttcacattggctatttcttgtatttatttatattcaggggccagccgtgtgtgaaagcaccgctctcagcactaaatagggaagataataaacttgtagcaaataggtattttttttttacattaaaacgatagctaaaactttagaagatgccatatagcactgtatccctctaatccttaccatacttttacgaagtgaggcgttttgtattccccaattcgcagatgagaaaacagtgatgcgttgttagggggaggtgggggtgcccacaaccgcagtgacacacttcctccaataaggccacagctcccaacagtaccattacctatgggccaaccatattcaaatcaccacactgtctttgtgtggtggtttgaatgagaaatgtcccacataggcccatgtatttgagtacttgaccctcagttggtggcactgtttggggaggttatttaggaggtggagccttgttggaggaattatgtaatgagggagatgatttgaggtttatagcccctcccccttctcatgtgcagatgaactgtgaccagccaccttcccacccttgctaccaggtcatgcattcccagccatgactacttctttctctctactgtaagctaaaatattctttctcaagttgcttttggtctagcattttagcacagcaacacaagaggaactgacatagatggcctctattccnnnnnnnnnnnnnnnnnnnntctgaagacaaacaagacttcctgagagccaccaacccccccatccccacccccgctgcgcatgcgcaccatagctgggtgcctactttgccaagaaacctgagggccagtgcaagtgctcatgggaggacaccctggtcagtgtaaagagaaccttgagtgtagttaagggtgtgagggagtgaagaggagagtggcagtgggctgtaggacgaagtcgcagcccttccaacaggaccccctaggctgtgggaagagattagattttagtctcaaagcctgggagagctttttgaagggaagcaggatgattggatttgaatttctaagtaatggctggcctgtggggaatggctggccctgtggaaggaggagagcctgcaggaggctcttacagtattgccgggacagaaatgatgttgcttctagccaagagtgagaagagaggatgcaaatggactgttatttactgtcataagccgacggataatgaggacctgaactgcattccggccatgaacacagaaaggaaggaggggatgagatagctcattaaggaatggtattgaaaagtgttggcagcccgttagaagatgactttaattgctgttgggttttggttgcctttgggacatccagaaagaatgataaaagaggcattgtgacaaattttaggaatttgttcccccaaacttagaatatgttaggctcttttaggctcaaacagccctatttggactgtgtgtgccctgagtggtattttaatctgctctcttttgctataacgaaagacctagatcaagctataaagagtggaagtttatttggctcaggatactggagattgggaagtctattgccatggtcctggcattcagcgagggctttcttgctatatcttcacacgggcaagaaaagtgggtgcagctcaaatacccccttctgtggaggaagccactaatgtcatccttttgtagaaaagatttattttcatttattcatattggtcctttgtctgcatatgtgtctgtgtactttgtgtgtgtgcagtgtctgtggaggccctggagagggcatcagatccctggaacgggggttacagattggcatgagccaccatgtgagtgctaggaattgaacctactacttcttttgcaagagccatctctccagccccaatgccatctaatcttaacagtctccaaaggatcccaccttcaaatatgaatgacatgtggatattggggttctgctactgacagatggactcttggaggacacattcaaatcatagcaaggggagtggcctggctagttcatcccattctttcccatgatgccatcgaacgcacagtgattgaacccttagcaaatgattatacaaactgcaaagaaggctctcctcatctagtggaaaagacagtgataagagggggctgagataaagggttccaagatggggctgtgtttacaggaataataaaagccaggcagtctgaaaggaagggtgtttctggggacttcctgctcagtaaggcagaatttcttgtcagggcctccctacccccagcctggctgaagaagtgtgttatctaacacgccagctgttctccatcattgctcagtggcctcccctgaaggctcctctcttccactgtgaccccttttaagaactggattccaagtactgacccgtgtttctctgaggcagcgggatgggggaaagcctgaagcagctggtaaccacgggtgtcgtcttgtgtcaggctcccatactcagcaatatttcttttcttaaccctatgggagtcttgtgccatgggcctctgatgaaacccatagctcctaagcctatttttaatgcctcaaataatttgggctgccaagtaaaccaattatattgctatacaaagatgttactgtgtagtaatatatcttaacacattgaacagctaggtctagcagcagcaaccactataatctcaaagtagagatgagcttaaatgatcctttgagatattcgcagtaactatgaaatgataagaaagtgtctgatttcttttggtgacaaaggcatggcttcatttaatactgctgtggactgaatccaaaattaggggaaatgctgcttcacttagagctgaagtaaagatgtacctgcctcctcgcctgctccatggattccttgaattctgggcctgaactaaggatatgagtagaacttccactctgaaccattcattcatttacgtctgagaaaccatagtgtgaaatgtaaagtgtctcattttgtttcaaagcccacttgatttacttgcctatatttgtgagcttactcttatatgtatttatagagcagacatttagccaacaacaagtgaatggatgaatggaaatatggatggatggatggatggatggatggttggatggatggataattgggtaggtgggtgggtgggtagataagtgggtagatgggtagatgcatgggtggatggatggatggatagataagtgggtagatggtggaaaagtgggtagatgggtggatgaacggaaatatggatggatggataagtgggtagatgtgtggatagatggatggatggatgggtggatggatagataagtgggtagatgggtggatggatggttggttgggtgaaaggatggttgggtgagtggtaggtggatggttggatgaatggatagataggtaagcagatagacaggtaggtgaatgagtgtatgggtggtgggtagaaggatggatgaagaaaattcagagaggagaaatgactatctaaattctctcaactcctaagaaatagagcttgactgtgaatctgatagtttaatctcttgttataactttagagttgaaatttctaattctttctacccctcccagcttcactagtaactttcagagttgaaagaatgttagcgccgggcgtggtggcgcacgcctttaatcccagcactcgggaggcaaaggcaggtggatttctgagttcgaggccagcctggactacaaagtgagttccaggacagccagggctatacagagaaaccctgttctcaaaaaaaaaaaaaaaaaaaaaaaaaaaaaaaaaaagaatgtnnnnnnnnnnnnnnnnnnnnnnnnnnnnnnnnnnnnnnnnnnnnnnnnnnnnnnnnnnnatcgtatttttgttgttgttgttgtgggtatttgtaagcattgcatggtgcacatgtgggagccagaagttgttgtgtgtgtatgcatgagcattgcatggtgtatgtgtgggagccagaagttgttgtgtgtgtatgcatgagcattgcatggtgtacgtgtgggagccagaggattacctttagaaatcagttcccttcttccacatgtgggtcctagggattgaacttaggtcctcaggcctatcagcaagtgcttttacccacgaagccattcccctagccctgaattaagttattctaattatgagaagagacagcttctttattttgttcagagcatgtgtcaaatactttgttctgttcttagagtcacattattttattttgttacagttgcggcttgtatgttgctgttatgaggccatgtgtctccatacagcccagtctaagcttaagacttgaaatgtaacccaggtttgcctcaaatccatgatctttctgccttagcctcttggatactgggaaataaatgtgtgcatgaccacaaatggatttagagacacattttaaatagtggtacactcagttactaggctatctatggatcagaagctgtctcttgtgagttattgataagctgtggatatgagattaggtttagatacctggtatgagaatgtggggaatagtaacttactatcgctccccaacgcagaccaagacccactgtttacaagggacaaatcttgcctcggttgaagaactctgtaatgattaaacctacttagcagtgttccttacttgcctgatgagatattgattgaaagtatccaaacattgatctatgtgtttatttattcattcaataaacacttatcgacatcttactacaagctggatgctgaggtggaggctgctctcaaactagagaataagacaaactgtggtagagctcagagtcttctgggagatagacaataagtacaatttttaaaacaattataggtattctgaaggaaatgagctgactgctatgattcagagtaagaaccgggaatgaggagagacgagttcctgggttgctgaagagttagcttaaaatctgaaatatccaaaagagtcggtccacagggaactggaggagaagcagcaaagaaatagcgtgtggcgagacctgaggtggaaagatggcaatgcatccctgaaagaaagctgctgtaggagcaaaagcagcttaaaggaggagagctaagggatgtctctgcagtcatcaggggaccagcacaggtggggtctcaggtctctgggtataattctgagtgtaatgggcaacattgaagactgttgaggaaggtctaacttgtcttaaagaccaccttgactgcaggatggaggacaagttgtggttttaagtgagagaacagttgatcaggagggaggtgctgggagctcagcctgggtagatgccatggagaggaagaggaggatgggctggagaatgctggaaaatctggcttggataacagagccagtcatgggagcagaatctctgggattgactggtggtcctgttgactgtgttgagttagtgttgaggaacagagtaacaagagagaaagcctagacagcatctttcaggaactctgaagccgtgcacggatggggtggttctcatgacacaatgacatcagtgtgtttggagagattggggaaggtacttggcacttgtcggcagcatgtagggggcacttctggcatcttgtggagagtagaccaagatggcccaagagacatacctcaagatggaaatgactccactcagaacaccattagctttctcgtggacagattttggtggactacctccttcggtttaagaggctggaggatcccgtttccatgctgcctaccattcatagcttttggggaatgatttaagttgtcttttcaaaaacatttagctgaaattacctagagggaagaaaagagatggtatgaaccaggaacataaaacccgaaggaggaagtagaatggtcttggagagggggctttagcagcaggtaggatgaggaagtggacgactcagggcaggaatagaaggacatgtgaagtctgtgcctctttcaagtgtcttctgcaggggagctatcccctgagacattgtcacacagctcttccctcagcccccttctgcatcagcctcctgcacaccttgggttcctcccatgactctgaatccctatgaaaatgtccccttggatggccccatacatgtcataaacttagctggaacccagtcgatgctgtctgttccagaagaactggaagaacgtgacaacctgagcagctaatgaagtcccactctaacttgagtaaaaggtttgtttggtttgtttggtttgttttgtttccagttctttagcttgatgacgatgacttcctaattattgtcatgcacacgatgtcacttgagtctcgcggcagtgctggagctaggcggggcacgaggtagggatgtgtccattgtacaatgtggtgacccgaagaaacccacttgcccaaatcaagcagactgtcagagactagaaattggaattcagagtcttactaaccgggtccctgatgaatcacaaatagcaaaggatggagaccctgtttgaaaacaagagtaacccaagggaacagaatacaagatgaactgcccaagagggcattttataaacccgagaaattaataagcaccagctgccattcattcgcctttgtcttataaggaaaaaccaacctcaggagtcttcttagcactgggtttgagtaaaaagctcaactctctctctctctctctctctctctctctctctctctctctctctctttctctctctctctctctctctctctctctcggtccccagcactggaggcccagctttgtggatatttcctgtgtgccttactgcaggaacttcattgggtagaccttgtatggcatctttggtcacctaggaggcaaagctgaggctgccttttcatgtcctagaaatcatgactggtgctccctttggacttgtgcagtgaacagtgtggaccacagctctggtgatcactgcagacaaaaatagtatgacatggccatcaaactactagatatgctcactactccttatgtactggcctgcatgcatgcacacacacgggaacatgtccatcagcccatgtcctgttccccaccctcgatggcctggtcccaggttgccatgttgggtccagacctctcagtctaatcatcatttgagagaagggtgctttttcctctggctgagagaagtttcccctcagtgagagctaaactgtaagcgtgcgagtggttatggtgagacgcggcaggaaggagaagtggagggacagctctgagggaaccgggaaaacccagagggagatggggcttagagctgaatcgagattggattttgtcatgaaagacagaagtggcaaaagcatcattatgaggcattaaccttgttacacacagacgaacaagcagaggcagggactcggagagaaattacacataataaactaggcagaatgggctgagagcaacattagcaattacaccctaagggaagagaagggcaaaatagaagacaggccagaggcaggaaggagtgagaataatttctggacacagggggctgcttgcacgatttcccctcttttctgcttgactccctaggtattaagttcccgtttgtgaggaggtttctctgaggccctctttcttctgtttttccctttgctaaaatgagagtaagaaaagcattctgagggttcctttctccattcacagggacctgtccatttctctgtgtttttagcacaaaagaatccatttccattcatccagaccggtcctgggagcttgctggggggtctaagcctctgccctcctcttttctcccaggctcataattagccacagagttctgactactgcgaagggcctcttggctggcccactgctagatccaacaagttatggttgttattccttaaacagtgattttcaggaaatcccatggcagctactgtggttaacttagtgaaaactctgtccccaagaacctagggcccattgtgtttctcctgcgctaatctccatgagctggttttcgtcctccatcttggatttagtggaagcaaaatgtcttcctttttctacgtgcatatcttatgcctcttgtaactgtatcccaagggagggcatgagaaagatccaacagctcacctgcagagttttatcagtgaggaaactatatagccaggaacccttccagggagctccttaagtctcactgagtagccctgggaatggacagccatagttctctgtgagataggaggacaaatgcctggtaatggtgactggaatcaccatttggttggaccaattatggcttctgtctagcttgggttattgtgatctgaaggaaattttagaagaacagctagctgtcttgggtgtggtagcaactgtttgcctttttaaataaggtagtggccacaagtacagcttacttgtgtgtaactgtgtgtcaggcattttaccaaacgaattcatttagtccttataagaacttaacaactgtgaagaagaaatgttattaccaacccttccacgatatagagcagtagttctcaaccttcctaatgctatgacccttttattacactgcttcatgtactggtgactgccaaccacaaaagtatttagttggtacttcataactgtaattctgctactcttatgaatcgtaaaatatctgatatatgattccccatccccacccctgttgagaaccacttgttatagggctgaaacaatacatttaaagtcccttagctagacaataacagggcccaggctcaacacaggtattgggctctttgtctggaaaggtggtaagtacacaccgtatagcaccctgagaatatccatgtgctaggtagtattactcatatgatcacttaaaaccacctccctgatgctgcagccctttaatacagctccttatgttgtggtgacccctctaccccaaccataaaattattttcactgctactccataactatagttttgctaatcttatgaatcataatgtaaatatctgtgctggaaagctgtgtggtcttaggtgacccccataaaagggttgtttgacccccaaagggttcccaactatcaggttgagaaccagggacttagagtgtcatcttcttaagtagcccaacagtcaggcacattggccttatcagacagtagagaaagccaactcaactcagattcagtaagtcaccagggttatccggtgagcgagaattgagttcaaaggcagagtagacccgggtggtttgtcccatcccaccagtctctcaagtaatacaataatgaatgattgcaattcgtagctgtgctattagtctcaggcttatttgaaaactacatcttttgggaagaagtcagaagtcaaaggagaatgggaatggttttcctcctgttcctgtccagcttctggccagcctatgtgacttggggagagtctttggcaagcaggctatctcccccagcctcagccaaagcctacccaggccagcactgtccatggataactggaacagaaacggctatttggttcctaccgcagaccagacctaagactccagtcctactcggtacttgtgggtaatcaacaatccacagcccttattccttttgtgttgataagaggtgtagtcctctattaagaaatatgatagtgtgagagcattctcaaagctcagaaatgatgccctaaatctctgacttcgcttctctatgatgctcaaataaacaataaataataaacacaataaatgatcttacatttggacaattctggttttattttaagccaggatgtgtgatgtgtctgtggggtggggttttttgttttgtttttcttttttcctttttttttttttttttggtttaaaggtcatccaactttttttctgctcatgatcacgaggcttccttatctaaacagaggtctattgttccagtcctcagacctacagagatcttttttcctcaacttcacttttaacaggataactgctcaacctccccaatggcaagagacgtaaggtcttttcacaggaaaacataaatgtctaatgggcattccagaagtctccttcaaagggagtttactatatagcattttatgcaaatgagacactctcttaggctgtggcattccttccttgaaacaagccggggtatcggagggagctactctcctcacttaccatttcctcacaggacaacatcaacaaagaaatatcgatggcgcttttaaagccttcagaaatcaatttagtccatgaatctatttagtttagatgttaatgaaacttggtggctttaaaaataatgaatatttaataagacataaattgaaagacataaacactgttggcaataatataatgaagttaataagtcttggacccccatgtccatctccctgctccccaaatggccccatctcaggagtctctatgatgttcactgaagtttgctgcctctcatattggccgcaatttaaatgcgcctttgaaaaccgtaatacggttgggaatcgggctgtggcagataaagtgagctatcacactgtgttcagtagctgcagtgggcaacggctctctcttagctccctatcttccagagatttgtgtaacaaactcagcttcctgtcttggaggcaggaagcagcttggggcccttcattccttttaaacaaaaaagggaaagatatcatggttggtactctctgggcccttggtttaaggaggggctttatttattgagcaggagcaagcatgtgattccacgtgctcaaaacctcatacaatttcaacgcatttgggttgagggtttgggcttttcacttccgctttaacagcctcagctcagggcccagttctaccctgttcctcattagctgggtcactacatattatcaccatccacagtcccatctgccttctgccctttttattcatctttgggcttcgccctgcactttgtctatttagaatctctcctctctggctctctgctgccccactgataggaccctgctgcctaataggatagtccgaggtcactcttgggacatgttcatgtttctggtcacagaagccaatatctaactaaaatgaactacagcggagtcctgcaaacaggacagttacctccccagccccagttcagaaatggcttctcttccggtgataatgcaaactctgtgtcttagagcaaacggggttgtgccaggcacgtgacatggatggctagctcggtgctggcaatcagaacatgtgaatatacagttaagcacgacgctctccgtggctcgggcaagccaggagagttggcagatgaggccagtgaaggctgtccctaaggatcccgttgaagagaatgtatctggggctcagaaatgcagacttcctaagggtttgcgagtggtacttcatcaatataaagagaaacactgatgttagaaaatgatcatttttctcctccttatttgttcctttctgtgtagaaagaaggggatcggcctgaacgggtccagccaattgcatcgtctacactgatccactctgacctgacgtctgtttatggcaccgtggtgatgaacaggactgttctgttcttggggaccggagatggccagttactgaaggtcggtttctctgtgcttcttcgatcagatgtccagttttcataagctcctcttagtacctgcctacctattgtaaacttcccctcaggctccaccgagtcctacacaagactctacctaacatggctctgcttgttctgaaaaagcaacattgtagcaatctgtacacagacccaagcaacattgtagcaatctgtacgcagaccctccgctcctgccacctcacactgtcaccctgcaatgaggcactagccgcctgctgtctgtataggaggcacaccgtgcccccttccttactcacggctgctgggtgtgatgaatgctgctccagcccctaccccatccctgactcaccttcctgagacgtttaacctttcagttctcacaaatcaccttatttctcacaacttcaaagagacacgagattagaggcttgaaaagaaaaagaagaagaagaagaaacaggtgtgccctccttccagcccctgtgccacccacagagggggtttgttttctgccccctgtacctgtacacaccagggagaggttaaagatctgaaattcttccagactcccctggcctttcatctcataggactgttttcccccatggtatagatgaaccttggtcaagctgagatttttttttttaattcacccagagggggaggggcagcggggaggaggaggagnnnnnnnnnnnnnnnnnnnnccccccccacacacacaccccgcagccgtcgcccctcttcagctagctgtgcctttaaggcggatcatttagcctctcttagcctccatttctctaaatgtaaaatgagattatactaggcaagacaggaaaaaaaaaaccaccccaaccctttcctcatctgatggctttgtacccacagactctctccagcttagcttgtgagccgctatgtggtcctgtgtccacacttgatcatacccacccctagccggaaatggcttcccccttctttctattctttactgagttctctaattggctccagtcctgccttctctctgccggtgtccaagcccccagaagtgtcttgctctcctcgtctcctgagctactcaccaccagcacccttccttgactttatattgatgtcttgccttgatacctagcctctgtggtccatgtttgtcctaccttgagtctaagcttcctgtaaagggcgccatgaattccctcagcctgacacaatgccgagttctgggtaggcatttgattgagtctgtttcctttggaggaaacccagtaacatatgggagggaatttgtttgtatacacattctttttaaatatacattgatcatctttctccttgagctagtttcatttcctggggaaaggagaggtagatagagaaatacccaccaatctttgcacacttgacacacaggaatgcctgtggacatactagcctggtcaggccaaggaggcccattaaccctgcagaggaagtttctatccgtcttgcctgggtctccttaccaattatctcttcagatttgggatgtttttgacaagtgttttgacaagaacactgtttccccaagctgagcctaccagactgtcacacgaagaattggaggtgaaggaacacttgcctataaatagtcccccatgggatggcttggcttcccttgtcctgtggattcagatcagccattcgtgtgtgcagctgtccgagtttcagtcttgctagaagccggggggtgggcccaagctgcagcttcacgctgttaatagaaaggtggttgcgattaagtcttgccgtcctcatggtctgtatggggtaccactttgagacccccatctggtctcattttcagggttcaattaacaagggtagacagatgtttggtttcagtttcatgagtttacatttctacagtgtttcctgcatgttaaataatccagctctctcaccagccccattttacagatggaaacatggaggcctagcattgttgagtgattggacaaagttacaaatgggcagtgcagggatttgaacttggaacaatgtcagaggctggattcataactctctgctgtggggacattgcagtccgtgcctcagcttccaggctcctcctttgggggctcttagccaggggatggtgtgttgggagggagccagccagccagccagccagccgaccctctgattgagggaacccctgacctgacccaggattaaccactccccatacttggtctctaatagttccctcccacagcaggaggctctgaggggtgaggctgtctccctcccaccctactctctagggacagtaggtaattcccttcatactgtctcttgtgtccatgtgcaaattcttggatatagcttttgaaatgacttggagatggccccaacactccccccaacacccccaaatagaatcatgcccagatgatccccagatctttttattccaaagaacctcccattcctcttgccacacttctccccagaaccgttagggaagatgaacactgagagacacaagcttggcttctaagcctcttcctggaggtattaatggacaccagagaagcgaaccccgacctgctgccgacagcgggaggaggaggaaaaaaagggctcgcatcacccacagcctgactcatcagtttcgcagtgatcaagaggcgaaggcattttgacatgtgccaggcaccgtagtatatgcctggctggatctgaggcaggcaaccggcagccggttgctgtttttatcaccaccagtaagaacctgacttcttccgtctctgcaaacctcatggagttttaatataattttggtgccattttaaacctcaggctatttaaataatatttttttccctgcttgtgaaagaactataagctcacgtagagagttgcagggtagcgggggataagaggaaggcaaaataaaaatgatctttaattgcgtcatgtagaggcaaccactgtcagcattttagattctttttttacatagttgaggtcagactgtatccagttttgaatcctcctttccttcagctaatgagggaagaggcttatattcaaatgctgctgcaaaccctttgtaaacagtatttttaaatagctctatcatggtgttatatgggaacacaattttgaacttgagccgagatactggatcactctataaaaagtctttaaacacacacacacacacacacacacacacacacacacacacacacccgttccaaagaagacagtactgtctccaaaggtaagatttcaatgatgagccatgagaaacctagagattttgtggttgctagcacccttattaccccacttctgcctttgtaaaatggtagggaaggggaggaaatgtggagctcaaaggtcctgccctaccaacttctccgcaggtgttttgggatcctgtagcaagtcgcaccccacctcccccatcatctttccattttgccccctttctgaatatggttctatgtgatcattttttttaaagttgtcagtatctctactgaaatcagctgaaagtgtgccgactctgaactcagtgtttgaaaatccacatggcacgtgtcacatggggtataccatcctaggaacacatgccatatcgcttctccaactgtggtggagtctgtcgtgtgctttggactcctttgagctgactctgttgcctgtaagaatattctctcctaatctcaagggcaaactgggagatttttgagcgtttccaggtggtaaaaaattaagtaataaaggaatatgcatgaaatgtgaaatttgtaactttatgcatgcccgttaaccttccttataagcataaaagataaataaggagggagcaggtaaggactaataaaagccggcatttctgagctcttactatgcacctgccgtctgaaccagcatcagcatgggttaattcatttaatccgtatgagtcaatactatgaccatccccactttatcaatgagaaatcccggggctttagggcattaggcagctggttcaaggtgatttgaactgaaacaatctgtccccagagcctgggcttttctcctctggcaaaactgcatttacagtttaaatgtaatctctggagcttgacagagtgcctgggatgagctgtggacttttctgcctggtgtgagggcaactgggcaggtctcgagacaccagtgtctgaggtttcctgagaaggggccttggtttatgtggtttttactttgttcctacttggggacagttttgagcagctgagggctcagcccctcttcttgggactgcaagtggctcgtggggacctctgtacagccattagagctcaggttttcccatgtaggctccttttgaagaacagtaaacattctgaattctgagctagcagtgtttgaatggccccctgataggagagccagggtttcccaatttccttgttgctgagggagtgtgctggcccaggaagctatgtcatgcatgcatgcagcagaagggtattgctcgcagggctccatcagccctggcagactgtattgttaggactcgactccatgaagcaaagcaagtcagttcgagagcttgcttccagaactcaaaaacccacaagttcctgaagaatctctctagaccgctggctattaaggtggtcaagtgaatggaagagagagttttcaaataaaatattttactgtacttccacaaaatgtaaaagtggggggggggaaggacccaagacaggcacagagctggtggggagcgctgaacaaattaatgggccaaatagaaaccacaggaagtgccaggcttagaaaagggctccgtggttggctgtgtagaatgtcatatgaaacttatttcagactcactccattacaccccagcttgtgagtctggggactccctgactcggcacagttagctccaagtaacatgcaggtctagaactcagaattgagccccgtgcttctctaactgactatcatgaagagtagacagagcttcccctccttcttcctgttttctctttagtattcctaactccaaaggcccactacacttttttttttttaaagattcttttgagtcagggtttctctatatagctctggctgtcctggaactcacttttgtagaccaggctggcctcaaactcagaaatctacctgcctctgcctcccgaatgctgggattaaaggcgtgcgccaccacgcctggaccactacacgctgttagataactgttttgtgtgcttaggggtgaggattaagtctccttcccagtgtttctcaaaagccattttgttcgaaagaataaacaggacaattggctcatttacccttctgctgaccagcttcagagaaggagaaatgggaaatgaaatgtcttaaaacaccttagccttgtgagcacggcttctctatctcaggccatcggaaaggaacaaagaagttaagtgtttcacttggtttcttttcttcttcatcttcctcactgtggagcatggagctgtcctgtgactctgcggtggaaatctccactcgcttaattttagctgcacggctgggaggttttcgtatgcagcagaaatctcagggctagttaatagcctaccacgaggtttcaggaagatgacaacagaaacaagatgttgacatgaactgaaattctccatcagggaaaatttcttttctacaaaggccttggttggaagaatgtgaagagctttacaaaatcttgaatgcttaatagagtagcatttgacttaataaataaatatgttttctgaagcctcttctgtaactattctggttatttgggtacaaaggtgagtcaaaagagcggggtgtgctaatcctagcacttgggaggcagaggcaggaggagctctgtgagttgaaggtcagcttcgtgtatgtagtgagttccaggccaaccagggtcacatagtgactcagctatctcataatacttacaaaagtgagccaaagagacaagccttgccttcctgctgagtgtgtgcgtgcgtgtgtgtaagtgagtgtgtgtgtgtgtgtgtgtgtgtgtgtgtgtgtgtgtgtgtggtgtgggtgggcagagagatcagaggcagaaaacaagtaaattaatcatccaatggtaaagccatttagagagtaattaaagtactgagaacaccagagggatggagaaagaaggacaatggccacaggagagaggcaggcaatcagggagagctgctcggaggaggtgtggctggatgatgaggcatatgtaggaatatacacagaggaggcacagagtgacttcagattagatctatattaaggtcgtatgctgagagcaacaaataaaaacctgcaccatggctgagcagtgtgtcgtgtgaattggacgaggtttcgcttatgcaaaattccacccattttgggtagctgtgactcatggttctttcctgcactcctcctctgatcccattctttttccatagctgcccagccaaactggcccaaggagcaatgtctcctttgctttagcctcggcggcttttttttttttcctgcatggatatcctcatgaggtctgtgactgaaagtccaagaggtcccctgtgcccctggtctgggggcctgggggaagtgagcagaacctatgctggccattgagagatgctactggggaccgcagaagccaacgtccctgacgctgactgtagtgcgtttgtgatctttggaataaaagttcaaccttcccattgttttcctctccagcacgcagaggtcattgtttgcatcatctgtttcacccgcccaccttcaaagattaaagaacttaaatttaagttctacgtatgaatctcactatgtagccctggttgacctgtagactaggctagactcaaacctccagcagatctacctgcctctgcatgcctggtttcgggaattaatgttgtgtgccaccgtgcttgaccttatgtctgtatattttaagataatacacggacattgtttaaaaccctaaactactgagaagtacagagtgaaatctacccattcccaacttcccattccaggttcaactaatgaaagaagtgtcactggtagctttctagtcagagtatacacacacacacacacacacacacacacacacacacacacacacatacacacacacacacacacacacacatacacacacacacatacacacacatacacacacacatacacacacacatacacacacacatacacacacacacacacacacatacacacacacatatacaggcaggcaagcaagcaagaggggatgtatttttcccctctcctatttttactgaacttgtgtatagctgggcagtggtggcgcacacctatagtcccagcacttgggaggcagaggcaggcggatttctgagtttgaggccagcctggtctatagagtgagttctaggacagccagggctacaaagaaaccctgtcttgaaaacgtgtgtgtgtgtgtgtgtgtgtgtgtgtgtgtgtgtgtgttgtgtttatatgaacgtatatttactataacatgttaaaatacttgccttctaactattctgatggctaaagagtactctactttttacactactgtttaggtaaccctgtttgtttttacactattgtttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacagaaaggcttctgggcccaagaatacatgctttataattttcatgacaaattctagatagtctcccagatggatcctagttccagcatccctgtcacatacccattcacacccatcatctacggtgagcacgccgtgcccaggaactcgtttaggaaattgttggtaggtcctggcaaggcatacctagaaacagcaagtgtttttgagaaagaaaggcttccctgcctcatttggattgctgaaggatgctggtgcctcctcttcaagatgtcaagtaaacagatccttggcatagccctcctgtcttcccagtggctgcaagcgtcgatggcgcaagaccctgtaacagctgcgagacagctcccgacgcaccaaccacggatgagggatggtgtttttctaaattattttatgtctcttcttattttaaagcaaatttcagacactatgacatttaccccaagatatttcattatgcctctctgagaaattattatcgtgttcccaactgtgactataatgtcattatcacagttaacaaaattatctgtaattcctcaggattatctactgaatatagctgaaatttcacaattgattaaaaatacacttaaaattatttggttcaaatcgatgtctggggcacacttgggtgcctctggcctaaggcacccctcccacttaattttctctctcccactggcttcctgaaaagccaggttctagggcctgcagtggctctcatgtggatttgcctgtttgtttcctgtgtcatttaagcttgctctgtgacttttgcttccgaagctccttggaagttagcactggagatttgactgggttcattcaggttgaaggtcagagttccgaatgtggtacagagagcttccctgaggaggaagcctgacaggatgacttcctgaaataggacggaagcagcaacctttcttgggccttacttgagaatcctgtcagttttttttttttccgttgtttaacttcccccctccctttccagaagcccagaagctgtttaattctgagctaagtcatagtgtaacttatgagttggtcatgagttagcaagtttgccacttactggctcggtgcctgcttgcccccttgggtccaggcacgtaactcttttctatagggccaccttgctcagtggaacatttctgtgctgatagaagaagtattctatgccagcacttgacagtacagcagcactggctgcgggtgagctgtgagtgcttcaggtatggctagcaggagtgagaaactggactttcaatggaatctaaatagccttgtgtggttagtggctaccatcttggaaagcacagctctagagtcattttcaaatgagccacagatctttcctaccaccctgagacctaactgctgctattttaaaagtttttcccccctttgattttggtttttcgagaagggggtgggtaggtgaggggtaagaagtgattctctgtgtagccctggttgtcctggaactcactgtgtagactaggctggcctcaaactcacagagatcttctttcttgcctctgcctagcaagtgctgggattaaaggtgtgtgccaccactgcctggctttaaaggggattttttaaaagtcatatttaatatatggggtcagtgagattgacttttactgagtgtctgcagaatttgctgagtagtcttgtaagattaggtgccccaaatccactagcgattgattaagcagatgatggtgtgaagttacagggcaaaggcagtgcctggaggggatgggtacagggagctgcctcctgtgctgaactgataaagagctggtaatgaaacagcaaatgccaaggtgccaggagggtatgctggggtagggatacaactgctcagtggacttgtgagcattgctttgtccaaaaagaatcttgggagtctttttttttctttttgagacacatatactatatgactaatgtccaccatagtagacatgtgggtattgggccagtgagatggctcaggagttaagggggcttgctgccaagcctgacaacacgagttcaattcctgggacccacagagcggaaggggagaaccatcacttgcaagttgtcctttgacctccttactcacatacccataccctcaccctgtcccccagagcacagaaaaataataaaaaacttcaggttaacagaacctacacagtaaggtattattagtcccagtttatagatgaggaaagggaagtctggacggttgagaataagttcaaagtgatacagtattgccaggtctaaaccaggcccctacctcaaatctccaagatgacagtagctgctcatctgacctgcgcacatggacccccgcctcttggtcttggcactcatctgtccaaggccccaatggcttcttgtctccctccagagtagacagcaggatccacacaggctgtagaacctgtgcccaccccatgatcactcactccgctgctcactgactcttttctgccttgttctgctctttcctcatcggcctcctcgtacttcaggtactctggactaactgggactctttaaacaaaacaaaacataaaaacccaaacatgtttgggctgaccagatgactcagtggttaagagccctgactactcttccagaggatgtgggttcaactcccagcaaccatatggtggctcacaaccatctgcaactgtagcctcaagggatccaatacccacttctggattcagggagcacaaagtatgcctatgatgcccagacatccatgcaaaaaagacccatacacataaataaattgaagcaagcaaacaaaaacccgtacaggaacctaaatgactgttgtaggcgtcactctctataaaagacccaccgtgagcctggattctccctttccaccttagcatctctgtaacggtcaggtgtaccatataattgttagtccacatttatagatgaggccactgtcgacccactccaaccccatgcatgttaagttcacgagggtgagatttctttcccaatctgttccctgcccccactctaccccatagcccaacactgtgttctctgccattttcctgagcaccaaacagtatacaggcgatcagtaaatgtttgttgaccgacgatgaatgacactcgggtgtctaattgccaaacctcagaatactgattcacacctgcatctattttctatgtaaacacacacacacacttctatccctgtgaacttgtcggggttgctttagaatgcatggctacgtgaaaccacagactaagccatgcaaatatatgttgaacagatactgcctttagcttcaaggtcactcttggagtgatcctaagaaagctgttaacttgcagtttctgatagagccaagctaagaacttgtggaaacaagcttctgcctgtaagaatactgcctccaaattgaagtgtggctatctgtgagttttttgatgactttgtctcttggccaaaaggatacactgtacttggcattgtcagccttgtggaagatggagttatgattaagaaatatattctctcacccagtctactgtctgcccccaccccatgcagtgtgtgtgtgtgtgtgtgtgtgtgtgtgtgtgtgtgtataccagcgacacacatatgaagcaagaaatgttacctatttatagaattttattattggctgaatttccaatggagagtttttcagagttggggtgggggtggggttgcttccaggtatcacgtgactaggaaaggatatggccttaggattaatctataggtcttactattctgatcttcagaatacttaatagaaattatatttctttttgtttttttaaatgaaggttgttcttggtgagaatttgacttcaaactgtccagaggttatttatgaaattaaagaagaaacgcctgtgttctacaagctcgttcctcatcccatgaagaacatctacatctacctaacagctgggaaggaggtaggtgaagctgctgcttactgctcctgacttatgaataggaattatctcactgatgtcattatacagtggcaaagcttttactttgagccgccaggtttaaacagcgctgcgggctttgagaagacctatggtgggccaagagagtagaattaaaacccgtagtgactgtcatcagtaactaagcaagaagtattacccatttagacaattttattattggctatatttccagggccagatttttcagaggggggtgtacttgcaaatgggcgcataatcagcagagtaactgaatttacacgtttattgtgtgggcactgagtgcttagctgcatttatgagtgtgcccaatgggactggctttggaacttggggttaataccaggccaccatctcatacacattcatgaaccaggaaatgtatatcactcatccccaccccgcaaactctttaatttatcgggatgtttgtctttttcttgtctctgcttactgaagtgaaaacaatatcttttcaacattttatctctaaaaggaaactatttttttttttttttactgaattcttacaatatggaagtcattgtgttttgtagggtctgtatgtgtactgggttgtgtgtgtgtgtgtgtgtggacacatgcatgtaataaagaatactaatgaaatatgttaatgaaattattactccacttatatatatgagcagtctaagactgggaaaggcaagcagttccaggagatatgtgtgtatatatctgacgtgtatatctacatgtagatacagatataacatatctctatgtattgtctttaacagggctagaactcaaactcggtcctgattctagaacccatgctttatcctggcctggtagttttgatccatgaccctctgaacacactaagtaagaagaaggcattcgggacttaaataattacacaatggatgtcacaggggcccttaccctccccccatttgtcacttcttcttttttagccactctcaggaggagagcaatgactgtcctacgtgtgcttgcctttttgagtcacaggctaggggtgacagtatcaagtattcttagaaaggccacattgctcttttcagtttggaaagttggatatatccagtgatcccattaagatggtctcacatctgactctcccttagcctttttcggcttacaccacggccttctgcgccggtctactcagtcaaacactgttatgtctcttccctgggatcccagatttgaaagacttttgtctattcaacaaactgtgtttatgaagtaaccattcccattcccaggctttatttatcaaggacatctcaaaactgccagccagagtactgactgtgctaccacgcaacgctgataaaattccaaccccctccccccaccaaagcaaagctcctggaagtctggcttagtctgtgcatatttttttccattttgcttttggagatactgcaaagcgctcataaattcccatccctatgcacaaagatacttgtaggactcagaaacccagtgctgtgggcgctgtagtaggctgtagaccttgtactgtgtgctgaagacccagtgctgtgtgctgaagacctggtgctgtgggttgtagaccttgtgctgtgggctgaagacccggtgctgtgtgcttataaagacacagtgctgtgggctgtagaccactgtgaaagcaccaatagttcatagatcttcacttcctagaaagtaaagacttccagtccctaatgacttacagcctgaagaccttagagacagttttcaagggggtggggagggtgtcaaaacgtgtcgtctctatattcttctctttagtataattgcaaaaggttctattgcttagtcaactgtggtaatcctagaacctagcaggcagaggcaggaggaagacaaaaaaaaaaaaaagcttgggctagatagggagaccctgtctccagaaaaagactgaagcaaaattctgctacttggctgtgattgtgcaagtgtgatcacccaagagtccaaatgcaaggagagcccttcctagactctaggaagttattattaattttaaaaagccatagaaaaaatctataaagtggtattaatacgtgcccactaaacataatcatatgcagatatatgtactgatgagaaataggttcacagtatattcattagagagcaggtctaatgtaataattatagtatcttatcttttacgtagagttatgtgggtgcttaaatatgttaaatttatagacagtataatttgaagaatgttctagagacttgtattctcctgaaggttcttagcaagagaacctcctttggtccattgttattaatgtctctacagtattacggtgctggacagattcaaaggctcgcaagtctgtgctaaggaaacttactgttcacgtttgctggaccacagcaccattttctcccataacagcaatagcgagtgcttatgacacaaattatttagtatgcttctgagactatgcttgtaataaccctgtgaagtcgattgtcctagtgccatctttacaggcaaggaaacaaggttagagagattacatgacacttaataaaatccctcagaattagaaagatgttttgtgagttataaggaaataaatatccacattctcgttaattccggctgcgcctgtcagcagcgcagaggacctaaaccgagagggcgcagtgatcctgcatgaagtcaacctagcattgaaggatcctcctcagatatgccttgttttcaccacaaactccttctagaattctccacttctctacttatacttcccagcatgcacagcatcccaggataatgagttgtacaagttttcttactacctgctatgtgatttttgccttcaggaaatgtgctaggcaccactcgggtactccaaacttacctctgcctcggctcacttccaagatcagcccagcaccattgactaactaatggaaagtgggaaagaaattatcttaacccccccgccccctttgtagtgctgggaatagaacccagcacctcgagctacacaagggcttggctactaaactaccctgtcagccctgtctcctctggtttctttcatttgcaaccccaatggaatgggtgtgagtcatcaagccaggagctgaagtgatggcgataccctaataccacttcatttccgcatctcttgccggactcatgctgatcattctggggcagagtcatcacgtatacccggatactcatttccatagcgccactgattatactgactgtccctgtatgaaaacgaggagacctggctccgtgatccctatggaagtaattatccacagatcagaacctgaatttgggaggactcacttgagaaggctctaataatatagactcctaggctctgcccccagacccgggaagggtctgggccgcaggggagtctgggaatacagttctctcttggtatttttctgggggttggattcacaacgccctcaaaagtttgcatataacctgtacatatcctcccatatacattaaattatctttagattagttatgatgcctgatagaatgcttgcctataatgcaatacaatgttaatagatataaatcaccctactgtatcacttagggaatgagaggattgaaatgcactgtgcacgtataggcacagtgttgttttcaaatgtgttcgatctgctcttggttgaatttgcgagttcaggcatcactggggtgaacagggatagccttcggtactttgagaagtttcccacgctacaccataacctagaactcgagatctgccattggatgctactgtggagacattcagggctcaagttgacaaatatactctttgtgctgtatgaccctccccccagcccccagtgttgcttgtgattccatctaatggatgccctcctcctttttcaggtgagaagaattcctgttgcaaactgcagtaaacggaaatcctgttcagagtgcttagcagcggcagacccccactgtggctggtgcctcccgttacaaaggtatttcctgaatcttttctcaccagctcacattttttttttcagaaagtgtcatgcggcccaacacttgttgccctactttaatgatccattccacgctgtgacgaagcagagctctccaggactgcaatgtacgatgtaaccataattcattcttaaagatggttcttgccatgtcagtatcaagtcatttgacccaggctacacagggccacccggtctgggccgtgacttgagacgggagaggctagtgcaggtgggtttgctttttatttcctaccaagttagccaagacttcagagagaggcaaaaggttcgcccttggagacgataaaaagaatagcaacgtttgaaatttttcaaatgaatcctcatcatgccgtgtattctgctcgctcggcggaagccttattattaatggcattgtcttcttgcacaccatatagccctgggcctgatgtacaatctcagtctccaggcagaatctgcccagcttggtcttgaattacgatgtatgcgacccatctaggctcaagggcgacttgtagcggcttcctctccatggcagttcttagcatcgtcgctgggaccagcctggttggattcactgttgctatggtaacccagtactccagctctcgctatagaagcaaggaggaaagagccttcactgcagctcaggcaggaatgagaggggggaaaaaaacaagccacatagcagtggctgtcagattggtgctttctgttttttaaaggtgaacacagattaaaaataaaaataaaaagagcagagcaggtagggaaaggcggagggcagagcgaagggacggtagggggaatgaagggcgatagagaagtaaattagagagctcctgggggggggtgcgggggggggggtagggnnnnnnnnnnnnnnnnnnnncgtgaatggagagggtgattatgatgtaagggagaggctcgggaaacaaactaaaaatatggagatggaatggattaagagttcttcatggaggaagtcacaatcttagctgctgcaagagctaggactgtggctgccctcctctctgcacccccttgcgggggctccttccctcagaatctctggcagacaaaagaaacagggccaagaaaattctcatgaataattgtaattggggtaggagccttttcttcttgtcacatgcccaagagtagacttgaagaaattaactgatcacagccagtattatatggttgctgtagttcttttttttttcttcttttctttttttttaaagatccattccatttatgttgcatctctgtgtgtctttggagagctctggacaggagttcattcatggatggtggtgacagtggtggtgtttaaatagccgtgactacttgtttaacaagcttcagtcaggagttggtgggagatgcccaagttggtaatagaattttggagttggttgtattttgatggtcctttcagaagccttaatagtatccgagcagggggcaggggtggtgctagctggaaagagatgttcaagagctgagtgctgaagtacgggagcactcaagtactagagcactcaagtactatgatgtttagaaacagaaggggtggggaaaacatgaggaaggatcagaaaggggagagacagcgtttaaggaaggagtgtgttgccaggcaagggaaagggggaagagagcaacgtactgtgccagctcctgccaaggaggtcaaaggaaaacggatccgttggactaggacagggcgatcgatgactgtgacagaggcccgtttttggaagggtgctggagctacaaaaggacaatgagcagtgagtggaggagctccttgggggtgttatggggaacggtagaggagatatgtcgccgattctgaggcaaaacgtagactccagacagtttaggattctaaagtttatttgtttttcattacattttaattgggagtgggatagtgcacgttccatagtgtgtgtggaggtcagaggaccgctcatgggagttgctctcttctaccagatggaccccagggaccaaactcaggttgtcaagcttgacaggtaaaagcacctgccacgctatctcaccagtctaactttagaaggtgttttgttttgttttgttttgttttgttttgttttgttttgtttttgttttaacatacatagaataatggtgtctggagctgaagaggtgatggctcagcccgtctgtaaagtgcctgctctgaacgcatgaggctctgagtttgtatctgcagcacctgaaaatgtcagccatgctagtgtatgtcagtaatcctagtgctggcgaagcggagacaggaggatccccggaagtccactggtcagatagtccagtcaaattgatgagctcttaagttcaatgagaggccacaccctcccgtaagcaagcgcaaacaggcgcgcgcgcgcatgtgcccaatcacactccacctaccagctttttttgtgtgtgttgttggggaaaattccggtaggaaggagaggggtggggggaaggagggtgaatattgtggtgtgttgtctttcagcagatgacagaaaatatgacctaatcacatcagtggggagggtagcctcagtccaggatgggagggaaacagtagtgtggaccccagagctcgtagagatagatcagacctcagggtatgtccatattgctcggaaccttctttgtgaccttagaccagcaggagccaggtgtctgtgtgagcccggggagagggagccgtgaaatctgaggaagggaagcaggaagcacacaggagctcaggtaaaggacacacacagagagaaaatagagtatggttgcctggcaatattggggcgcacctgaggccgatgatcttgcctttgaaacagaaagcatgggtttgctttgctcatgtagtctagctccagtcccatcatgggaaagtacggaggatagacttcagtttagctagagtttggggataagtacatcagggtggggctatgggatgacattgatgtcacctgtgtgcggtggagggaagtagggacacactgtggatgggagacatgagaggggggaaaacaccacctggactgtgtgggggtcaacgctgaggcgatacaggtgtggaggtaccgggaatggtaaggtctacaggactgttacgtcatggcagcgagggtggagaacaagactactgtgtgagaaacagggacctctgtgtgtcagtcgaagccaccaggaacaaggatgggcccactggtgaagagtaaaggacaaattagtcaagacctaaaactaactagtaaggtgggtgagtgttggtcctgtaggttttgtgtaaggagtcaggatggtatctattgcaaacatgaacttgaactctgagagatggtcagaaagagaggaattatgtggaggagggctgtcaggcccagctgggccacctctagtaagttaaaggaagcagccagccctctagaacagtggtcctcaaccttcctaacactgacactctttaatgcagttccttgttgtggtaacccccaaccataaaattatttttgttgctatttctttttattgttttttttttttttcaagacagggtttctctgtatagccctggctgtcctggaactcactttatagaccaggctggcctcaatctcagaaatctgcctgcctctacctctcaaatgctgggatttaaggtgtgcgccaccacgcccagctttcgttgctgtttcttaactgtaactttgctgtgcgatttgctattgttatgagtcatgacataaatctctgtgatttcctggtggtcttaggtaacccctgtgagtggatttttcaaccctagagaggttatgaaccacaggttgagaactgtcgctttagagggacatggggaagctgtgtcccctgggggaacagtgagccagaagggagttgttagagaattgggtgaggacagcaagccattcttaacagctcgctgtaaggtctctcttcaatttcccctgttcattatctcgctcccccacccttgctgtacactttccagtaggaatgatcctttaaaaaaagaaaaaaaaaatccccactagacggtgtcctccctagattcattgctcccaatttctcctctctcaaactcagcctgatctcctgcttgcagacaaggcattctgtgatttgcagctccgacctctctcatgactctctctccttggtctcactgattgtctttctgattcaagaatattcctgcccagggcctttaccttgaatttaaaagttctccattttagcacactcttcccttcaggagctctttatctgctatcctagaacgtatatctatgtccacttaactacccaacatcagagaagcaacccctacccactcagcaaacatagcggggtcatggttgacggtccttggtagccacgtcccctcacttggctcccagttggctccgttctggcctaagataaaatgaaactaagcttcagatctgtgactcatgttaagctctcggtaccattcaaaattaggaattctaaaggggatgtttttggtgtggtggcgaagcatcccactgtgtttattttaaatgtcacagatttatttagaaaaataatttcttctctgtcttgagaaggttgaaccttcttgtatacgtgtcttgaaagtggatttgggtatggtggggggccaagaaaatgataattaatttcttttttatttggtgttaagaatagtctcccagtgtaataagcagataaaaaaaaaaaccaactaagcaagcactgaggtctagtattttactgtgcgaacctcaggttcaacctgtgctgcagttgtctgtgggtggaaagggaattctttttttcaagctgaatatatattggagttggaagcagtttctcagcttctcccgtatttcgaagcccagcacatgtgttcagttgtggatttccagagaactggcaatcccgagccgatgagcccgacaaggttccaagagttcatttgcaagtttgcttggctcacacgggtgcctttcccacagaaacaatgtcaccaattgagggtggattcccaagccagcccacaaaatccatttcctcttaatttcaacaaacatttgttgaatacctaccaagagcccccatgtgggaagtgagatggctatgtgctgttgagaaaacccagatgtccttcttggctgtaaggggttaacaagcaaactaggagggcagacaggtctatgccagtgatcattcattcagccgtccatctgaccactgacatgtatgaggtacccacgtgttataagcctgacatcccattcagaggcacagttcccatctgaatggcttctctagtctaatgatgggtaagcgtcagtagattctgagtttcttttgtttgtttgttttgtttgttggtttggtttggtttggtttggtttggtttggtttggtttggtttggtttttcgagacaggggttctctgtatagccctggctgtcctggaactcactttgtagaccagactggcctcgaactcagaaatccgcctgcctctgcctctcaagtgctgggattaaaggcgtgcatcatcactgcccggcagattctctttcagtgattctacctaatgagcaactgcctgatccttagaagtctaacgagcaggtatttctctacatttattattttcactcatggatgtgcttgtcagctgtgggaggaggaagaggtttgtgtcgtgctatcagcgaaactcaggtctctttcatgtgtctgtcattgtgtacctactcttaagtcagagagcagatgtagaagatattgaactaagttacatgatgcactcaaagcctctgcgcccatcatggttatggatattctactgctaacacaagctccacagccaagctcgacattagtagggtaaggaaatagaccattctattccgtccagtcagatgtatcataacatggcacggcaaatagcagtagagatgaatcattctggtacaggaagttttggagacttgggaatgtgcatcttgtctctctggaataaaggagatgaataggatagggggctataaggatagacacagaagatgtagggttccatggagacacagatagggcatctaactcccatgtgaaaggttggggaaagcttcctggggaagagatgattcaggcaaatctgaaacataggcaggtatcaggaagggaaactggctgaggtaacaggttggcgaagaatacacttaagttcctgaatgtgggtgtggatgcgtgtatggcatgtttggggggtggggataagaggacatggtcaacagggcagatgagtcgtttagattttgttagaagaatcttgtggagactgagcaactgagcatacaatctggagcaagatggacttgggtcctcgctgggagctggcagaccagtcagcaggtggttatagaaactggggctgggttagcgcagtagtagttggaagcaggtacattggagagctatttggaagccaacactgacgggacttggtgattaattgaattcccccttgagcatggcacactaaaaatagggccataaaatagaagatgaagatggccacgatggaagatgtattctttcttccttgacccaacattgcacaaagaaaagagctgacactcaaagaagctagattctccctgtggcccaggcactgggttctaaggagagcacccgggtcaggtgaggaggacttctgagagatggcagaggggtgtatgttctaactcttaccagcaatacatatgcagacatctgacttgggggaccagacagacagatgtgtccttcactgagcagggtgtaggaggggctatctacttggggtgagcggcaaacagcatcgactgccatattggcacactgggcaaacagcatctactgccgtattggcacactgaagggcacagcagggtaggaagaaataaagttcctaaggatgattcctatgggccgggatctggcctttgtatgagtagcctgtttctcttctacgccaaagcagggttgatggtggtacccatgtctggggctgctgagaggttgaaatcagataatatccctgaaactgcaggcaggagcttgctcctaggaagtgctatagtggatgtcagtaaggaggccgggtcaccctcagcttcagtgggagggtagcctgaaactgggcctggaagaatggtgtcaatttttctctgagggcagagggtatgggagattctacaagctgaagaagagctgagccagaggtctgtttagggagtggcaggttggatttttttttttttttttttttttttgtctctaggatactggttaggaaggaaggaagggataaaggtgctgggaaggatgaggaagtggaagctctgagtttagatttaattagtatgtgctgcgagctcattaaagagctttaagcacaggactgtatctttgaaagatttgtgacttgcaaagattatcgcgacggcagtcgagaggatgaagtgtatcaaggtgggcagcaactatacttacctcctgcaatttgtagagtgagtttatcttgtatctcttccggggtcatctgctcggtggctatttcttgggcccagttataacaatggaacctagactgggtccttctcagaaaatgggctatgcaggaacagccattcacactagttccttaatagtctccatgcacagggtagagacagagcccccaacatgctaattacagggtatctggatccctcttgattatttgtataaatttaacctcctcctatattcttctgcacattttccccaccgtggcaacagttggaagacattcaggcaacccctagaagctgttttgaaattttcatccactcttgggctgttctgcatgtgggattctgaaacatcatttctcagctcagcctagcggcaagcaccccatggtccagctcctgtctgaccactgacaggctggcaggagcagagaagggaaactttgtcaacagccgactgggagcactttctagagcccagcttgctctcctctcttgaggactctcctctccctaagaggcatttcttcaagaactctggtttaattggtagccctatgggaaccctgcccaccacgctgtgcaatgacagtccatggggcacagtacccgtggccatgctcttcccaagccccaatgaatgatctctgttgcagatgctgagcccgcagcatcctgctagccaaagccagccgagtgagctttctcagagagtcttccttggccacagaactccatgcaactccaccctgtgcctcctgctcattcttcctgacaccctaagcagtcaggaatcagtatgactgtcagcctgctttttagagtagaagacaggtgtgggctctaaggaatacttggtggcttcagagaacatgaattgtttttcccccctgaggtgctggaggtgaggactctgaagtggggtttcagtggaccataatagaggtggatggtgcttctccttgatgttgtagaaacacccccattcattcccctttctagcttctcgaggcacctcacattcctcctcagctgccccttcctgccctttcaaatcttaacgatgcagcgtctccagactctgctggttctgtactcctctctctgatctttgtgctcacatcgggctgcagaataatgtcaacccctaccttaagatccttaatttgcccaattttgcagagtgtccaccatgaaggtgacatcatagtcatgagtactaggttgtggacatctttagaagccatttttcaccagcctcagattatacctacctgggtttatgtccagttcccaagccactccattgtctaccattgtagggaagaggcaaagagacaggaaggagatggtgtccctcagagaggacaaagctggaggagcaagggcccgcatggacattacataataacctgtggactgagaaagagaacagaactcagggccctctccagttgcataaactactctgcacattcatccaacagatactgaacacctactatgtgtcctatgttctcagctctaggatttttggtgctctcattaagttacccagagtctcatgcaagtcttttgagcaagggattttagtttctcggagttaccataagggaagttgccacaaagttggtggcacttctgcaagacagacatatgaacccaaggtgtcaatgtggccatgtatcctgtgaggctctagcgcaagatctgccctctcacgtcccatggtggttcctgtggctccttggcgctatctcctgtgatcgccttccttgtatacatccaaacctctctctccttcctcctagcaagataccagtcagtgcagacgttaagcccaggataatcccaacttgagctccttaactaattacccctttaacgactgtatccaaggaaagtagcattcggagggtctgggtgggcatgtcatcagggaggaagagaccagtctcaaaattcacaaggaagttgcataggggaaggcaagcaagactaaataaacttgagaaagggaaagagggacactgagtaggagtggggaaagctggcagttttaaattgggggtcctggaaggccactgtaatatttagcagaatggccagcaagaagacacttggagacagaagatcattacatatctaccttccttctttccttccttggagctgaggatatgtcctcccatgtgcagatctcaggcttgaagcctgtgcagtgacacttctttatggtccagtgcaactctaatgacagtgataatgataatgatgagatttggggcggcccctccttcttgtgtgaggaccccattgtgccaactaattgtatagaagcaagtagggcaactgtctgtggggtggaagcagtggggagcagagaggaatctgctgttctggccttggggccttcctgaatgaccctgacacagcctgaacctgggcatctgggttactgtggatgctggaagggactcgggagaccttcccacagtagaatggggtcttgggacaagcgaagtctcctgggttctttatccccttaatagttgctggaagatccatgggctaagcctattgcactggctggttttatatttcaacttgatacaagttagagtcatcagagaggaaggaactccagttaaggaaacgctgccttgagatccagctgtaaggcattttctcaattagtgatcagtgggggaggacccagctcatgatgggtggtgccatccctgggtcctaggttctataagaaagcaggttgagcaagccagtaagcaacaccctccatggcctctgtatcagctcctgcctccaggttacagtcctgcttgagtttctatcttggcttcctctaatgatggactatgatctggaagtgcaaagcaaataagtcctttcctccccaacttgcttttgggtcgtagtgtttcgccatagcaatagaaacgaagatacctacttgccatagaagaaaaagaagcacacaattgttgaggggcacagctccactattggccccacaggcagttggcagttttctgtaccttatacataagccagtttggtttgtttggtaaaagttggccacaaggacctcaagcctcagcatttcaactcccgtacttatctgcaccatctctttaagtgatgctctaacttccaacaagccccattaagagcaccccttctagtaaatacatgttttaatggaatagagtttttttttttttcctaatgacctatctgtggcagggcactttcataagaacgtattgatcggctttttaaaaattcctcaaatgtttccacttgtctctgtgacctcgtgtttgtcctgttctcagcagctcctccacatctgaacacagtgttcagatctgcattctgagccctgcctgccagtctttggttttgctctcgtaccatcttgaaatgctaggctgtttgcattctgctatttggagtgtgtgctgtttctgatagttgagataggagttgatatgaacctcagaggaagggctaatagtattgctcccacccagtcattgctagggaaatgggccctcaacacctctacagttcttcctaatgacatagggggtgtataaggtagaggtagaagccagaccatcctgggccaagaggcatcactttctcttctgtctccatgctgcctagtttttctaaatacctcctcaacattcttccatgtaaggtctataccagaattgaaaactgagaacttttggtacaccgcacttgtcacttgacgaagaactgcatagagtgaaggccacacatcacttttgtttgagtgtttcggtctgcaaatgtgttttaggtgggctaaacagctctaagtttcaagacaaagactgattttccacaatgccagttaacagactgacctaatggacaaaaatcaataaaatgacttaggcagatatctggaagacatggagaagaatttagtccctttcaactttaattctcagcccaattcagataaactttgctgaacaccagcaatggaccagacccttttctagattctgggggaaacaaagatgaacaaggctgtgtaccctagagaataaaaaattagtgtggggaggagacagtcaataaatactcttaatagctgatgtttgagacacaaggagatacccaaacccttttctcctgggagatggaagagctgtaaaagtcttggaagaagccttgggctgtgcatgcctttgtatgtaggaacacattctacgtagtgaaccaatatagaaaagctatgtgaatggacatatggtcaaccttattactaagacctacctagtcattagcattttgtatttgtttaaggtacaagttttctgactctgccatggacattattgctgtcttagatactgctctattgctgtaaagagacactaagaccaaggcaactgttaaaagaaagcatttaattagaagtttacttacaattttaggtggttagaccatgatcattatggcaggacacagacaggcatagtgctggagcagtagctaagaccttcacatcctgatcccacaggcagcaggcaggaacagtcagttagacagttttggtccggtgtgggcttttgaaacctcaaaaaaagcttaccccccagtgacacacctgctccaacaaggccacacctcttaatccttcccaaacagttccactaaggagcatttaaacataggagcccatgggagccattcccactaaaaccatcacagtttcccaggcaaaactgatgggaattgcttcctaatatgtgtgagtgtggaatttctagtcccttaagataacactctgcaagtgttcagggttggcatatcattcatccttgccttggtaagtcacaaagcatgcataattgaggcccccagaaggcttgtagcaggggacctatttaatttcatgtgacttctatgtcccaaacttcttggcatgaacactatcatctcactttgaaaatccagtataacccatattttcctttatggatatgtcctggggaaaccaagtgtcacttgggtacttacgatgttcctactatggaagactataaacattttagagacagtagagagaatgtgagggctgttgacagacaccatgctaactactctccatgtaccttagtatccttctgtttgtcatggaggtggtaacaatgataacctgtttcatgaaggttaatgagttcttcccactggtcatagaaatagtgggagagccatagcaacgggagggtgttatgttgtgtatgcctccatataaagcctgtattggaaacagtccctagcataacagtgttgggaggcaggaggttcatacatatttaggtctacactcatgaatagcccaatgccagttataaaagagactcaggctgcaattctgatttcttactatttcgtgcacatacaccttctccttcattgctgccttctgccatagaatgatgaagcaagatggttctagctggatgcaagaaactgaccttggacctcctatgggcccttggagttgtgaaataaataaataaataaataaataaataaataaatttcctactcatgacattctgtcacaggggcaccaaatggtgtaaggaaaagggccccttggtgacctgttgtattgtctactgcagtgtcgacatggaacagtggatgcaaaaatggtcttggaaagccatactgcctgatgcactatctcaatccctctgtatactaacagcaccttaggaaagcaatgcggagtcttgtaaaagctgttccccctatctgttaatcagggacaatcatggtaactacttctttagtttagtttagtttagtttagtttagtttggaataaatgagtcaagtcatgtgaaaagacatcgcatggcatataagacatttttgccttttctaaaaaaaaaaaaaagtagtctatatttctgtgttattagcatcattctctcaaatagactgacttgcagacccagtgatgaagagccagttgttttttttttttcagcttccttagcaagttattttggcatcctcccccccccccaacccccctgatcctgactctaggagcctttaattcagagtttggtttgtcacagtgacttcctgttctctttcatttaatggagtctgactccttcatcttgtggactggcaactgtaatgaatgtcacccgactcttgagaccacctggtccctcctttgtgtgctgtacctttcctaaagatgtacacccctgttgcaaatcacttagcaaaggaccttgggatgctcttggagcaaaccacccccctcttgaggatgcagttgcccatgtgagaggagcagagctggattgttggtttgttaaaagttttctgataccttatcagtataggatcttggggacaggtcacactcaccccacgttcaagccaattacctgatatttagttatcgaattccttcagggactgtctgctcttggtgaacaattagattagaggatgctgatgaaattctggtggcaggaagtgggagttacatttctgagctcagagtttctatttcaaggttgagtaagtggtaaatttttactgagggagtctagcctaatagagtcagattctcaaggtctgtccccgcccccaccctggcgcagtacgtggatggacacttcaacctgcctggaaaacttcaggtttcaggttttcggaagcgggcctccctgtccttcatgttggcatgaaaacaattaataatttaagccagacccattttaaaaaatagaaatgctatacaaatacaataacgataaatttaaaagtcgatccagttgggcaccattcccagactaccaactgagcagacacacaaataagtaaagaagaggaaaaactgctatataatgcaaatggctgccatctccttgttttctgctgttcttttattgcagatatataatatcaaggctacattatgggtaaataggttttgtggcctaacccagaaaacctaatcacagcttataatattatttctatgaaggaaatatattttatattataaacagatggttggcaagcagtatttggagcacaatcagtttgtaaggctgggtctaccggggattttaacctttaacagaactggatgctcggatgttgaaaccacaaggcatcttagaggaccccggtgaagtgattctctccagaatcttcaccaagattttcatcttaaaaactgcctcccccatctttgttctttggttacctgagacccactttcccgtcttggctcagcctagccacgctttctaaattctgttgagaccccaggaaactgggaggtactctgagaggccttatcctgtgcaccttataaaatggtggccagggtcctaggaggctaccagtgagagagcctgtgtgcctctgaacctaggtcatgctagaagagtggttctcaacctgtgggtcttgaccccttcgcagggcgagtgaccctttcaaacacacatgtttacattagaattcataacagtagcaaaattaaagttaggaattagcaacaaaaataaagtttggggttgtctcaacatgaagagttacattaaggggttgcaggatcagaaaggttgagagtcattacaacggaaagagaactaacgggaaatcactcagataagcacccagcacaggtgctgttgctgccatgtttgggttgtggagtttttcaggtatacgatgggctacacagatttctactgacttcggaagcaaactcaccacatcggagtggtttctgagtgtcagagagtgagcttagcagtgtccggaagctccattggccacttgaggctgagtagcttggaacatgttttctgggttgcagatggggaggaggatccattttcttatatattcgggtggctgtattaaagtctattattattttgaacaaattgagtctataacacatttctagtaagctgagaagagacttcttaaatagttgcatgcactaattgttaccacataaagagttttcacctaaggaaagtttttttttttttaatttaaattaactttttaattcccttcaggaaatttttttctttgcagttggacagttttatgttctaactttcaagtagatttgtatctacttattgacttgatcacgtaggcatgagatctaactaggaataggaacaaaataaaataaaacagtgagttagagttttctagaggaaccaacacacacacacatgtatgtatgtatatatttatttatgtatgtatgaaatcagcctcattgaaatagtacaactgctatctcatatctgagaacctggtaattgcttggtccttgaggctgtgtgcctcagcagttagagtaatcccacaatgacagtctcacaatgggggaagctgagaacccagtagttaccaagtctacaaggctgggtacgccaacaatctttatctcctgccaaaaacttggagtgtttctggagagccactagtccccagtcaacaagagcagcctggaaacaccagctctaactctaatgtcaatgaaggaaccagcagcagcagaggcaggtgaattaattaaagcggcaagatggaggaccaagtgagcaaaatatccattttaatttgggctgctaccaggaggcaccatcctctttcggggtggttcttctcagatcaagcagggcagtcagggctgtcctccggtgaggctttttactcaggtgattctaatttgtgacaagttgccattagggccaaccagcacaaatagcgattgctttcagattgatcctattgtgatttaaatatgttccctgcaaaacctgtgttctcctggagttgggaggtggggcctgttggaggtggggcctgttgggaggtgtttatgaatgagggctctgtcatctccagacaggcttgagactgtgagttctgtctctcactctcgcctttttcttacccttccattatagggtaatgcatcaaaacatgcccttgccaggtctgggtccttcagccactgacttgtaaaactataagaaaaaaaaatatattcttcacaaattactcagtttctggtatcctgttataattatacaaaatggaattagcctcataattggtactcagtagtaaggctgagatataatcaatacctgacagcgtgggcctggctgggaactggtcatgggtagaagctgtaagagcctgggacattgggagggggaaaaatctatcgcagtgtgctgattcctttaaaaaatatttattgcagtggtgtgaatgtacaatacttagatatgctgtatatatagtgtaacatctgtatatttaatcataaaggcagataattgaaaacattgtaaaattaagcacttcaattcttgttaaatatgaaacatttgtatcttgtaaataaagacatccttaaattggttttggaaaaaaaatatttatttttattttacaaatatgttagagcctgcatgtatgtaagtatgtgtaccatgtgcatgtctggtgcccacagaggccagaagacagagttggatgcctagaaactggagttataggcaaacgtgagctacccagggtgtgtgcttgaattgaacccgggtcctctgcaagtccagcaaccgcccttagttgctcagctatccctccagcccactaagggtcattctaatgtagatgtacagattagcaatgtggaaaaagcctgggacttcctagagattacaggcacggtcgtgatcagaatatttgtagaaatatggaaggtgaaggcctctgacagggtctccagtgaaagtgaagtgcaaagatttggaactgggaatagaggccatctatgtcagttcctcttgtgttgctgtgctaaaatgctagaccaaaagcaacttgagaaagaatattttagcttacagtagagagaaagaagtagtcatggctgggaatgcatgacctggtagcaagggtgggaaggtggctggtcacagttcatctgcacatgagaagggggaggggctataaacctcaaatcatctccctcattacataattcctccaacaaggctccacctcctaaataacctccccaaacagtgccaccaactgagggtcaagtactcaaatacatgggcctatgtgggacatttctcattcaaaccaccacacaaagacagtgtggtgatttgaatatggttggcccataggtaatggtactgttgggagctgtggccttattggaggaagtgtgtcactgcggttgtgggctttgaagctctttgtggtaaagagcttcttcctagctgcctgaggatgccagtctttctggttgtcttcagatcaagatgcagaactctcagatccttctcgagcaccatgtctgcctgcatgctgccatgcttcctactgtgatgatcatggactgaacctctgaaactataagccagccccaactaaatgttttcctttataagagttgtcatggtcacggtgtctcttcacatcaataaaccccaaactaagacacctcgttaacagttacaaaggggttggtagaactgtgcccatgatctaggactctgtgaaatacagattcggggtttctggtagaagaatttctaagctaaatattgaagaagctgtgtgattaccttttactgaaagaataaaataatttaaatacagagtttgtagttaaaagggaagcggggagaaatttttgggaaattctcacctggccatataaaaaatgaagaggcatttttagaagatggaattaggagcgtggccacgggaccacttactggagattactatatataaaaggcaaccaggttctagtcatcaagagtaacaggagaatgacctcaaagacactcttcaaagtaggttggacccttagggtaaagctgccagagaggttccttaaggtccccagcattcatttgccaggccactttgggactttgctgcttgtgttctggttcagtgttccttggccatccaagctatggctcaggcaggcatagatacagcttggattgacattctggagggtcaatgtggtagaccatggtaggtagcatctacttggtactagttttatacctatgcatagttcatgggctaggagcctatgatagccttcatctaaaatcaaaaggctatcacgggcagcccgggagtccatgcagaacttactacagggataaagggagtgtatgttgagagtatttactatagcgatgtctagaagcttatgggaatggtgtatcttctgagacctcagaattatactaacactaaacccttcagctgcaggtaccagacctaacttatgacagctactaaatggactaagcccatcctagcattagtagaactgcctgagtgcctgtgccaggatgtggtccatggacttaaaggaggttattctggagcctgaagagttaacgttctcctccttcctgggctgtagattacatggaatcagtttctgcacacttagtttttcttatggaatgagaatgtctgtctgcctgtctgtctgtctgtctcatctttgcattttgggagcacatactatatttacattcaaaaatctcagggccggagatgaatttgtctctggatgtatcagacataggttctcacccacagccactttaggtgagagcccagattttgagttagtacggagccaactaagtctttgggggctgttgagatagaatgaattttctggcctggttttcatgggagagggacatgaagttttagggtcagatatgccatggtgtggcttgagtatgtccttctcaaaagcctgttcgaaacctatactctggtcggtcagttttgaggggtgaggtggagattaatgggagatcaagagcaccccacccccaccatgaaagggagaaactagcaacagtgaattctgtgtcttttttgacatcctcttctcccagggaatgacacagccagagatgtttcaccagagtcaagtgcccagtcataactatcccagtttcttaagaaataaatctttattttttttataaatatatgagtctgggtcttctgccaaagctgcacagatccttggaagagggggagcacatgccccagcataagcaatgaacacatacacaaacatacaaagaacacacacacaaacatacaatgaacacatacacacaaacatacaaagaacacacacacaaacatacaaagaacacatacacaaacatacaacaaacacatacacaaacatataaagaacacatacacaaacatacaaagaacacatacacaaacatacaacgaacacatatacaaacacacaaagaacacatacacaaacatacaacgaacacatacacacccctgacattttctccagaacacacttgggctaagatgactccagtttccctcctattcaaaatggcctggcaaagtggaacgaaaaccagttaagagatctaggaatttggctgacaagagagcttgcttgtaatcctagcccttgggaggtggaggcagaaggatgagacacttgaagccatctttgccctcctacattgtgattttgaggccaccttggtctacatgagaccctgtggaggatggagacagaaactggagaaggagaacctgcccatcgagtggtcaagtggctcatcaatcgccaagtggaatgatattttcatgtcattccgggaatggcttgagaatttatccatttggccatttccttgatgggtccacaagaataagaacgatttgtttcaacagaaatcatcccaaaccccctggttttgtttactaagatgtggaagcgctgagctctgctccccctccttgagaaatgcgaatgtgtgggtaatgtgctgtcgagattttacaatctgcaatatttgagaagtaataagatactgttgttggttgaccatctggttatacatacttggtgttgtggtttgcttttttattctttcatttttattgttttaaactggtgaagggcaaagaatgagagttagaaaaaaattcagatttggctttcttatacaaacaaagaattcatatttagatgtgcaacccagttagttgttgtttctagggggagagtaaatgaacagtccagtatatatgttctttcattttccttttcaaaaataaataaataagtaaactaaccttaactcctaatttgatcttcagctccaaacttttggcttatgtgaaaatcagtctcgttgcctgaaagaggagtcaagcataaatcaaagctctagaaagaaaattcaccagcagaacggtcctatagagatttcatatttcatccattcactcaaaaatatttatcgaaaccctagtatttgcatctcgtgctggcagacgctgagggatttgctaaagaaacatcaagatgttctccctcccttccaggggcttagtgctttctcggggagaaatggcatggccatgtgaaacagttaagttgtaattcaagacagcatatgattaaataccaaaatgtgtggttccgacaagaaatgctatagttcagagaagggagtgataactttgtagcatgactggtttttctgcctacaaattggcaaattgtagcactatttgtatgaaatattttacacttgcttttttggcagccttaggccttgactcccagtcagcattaagagcctgcaaaaatatttgtactccagtcactgtagaattggcttaatttttctccccttctttctcctatgcagaggaagtgccttggtacaagccagagggcccaggagagacagggagttttgagtcatgaactttttcagatacaaataaggcaccagccttgtcattctctgtactccagagctgccatgctggcaaactccctctgacattgagagaggtctaatttgaacttaatgtctgtgacggacgagtgagccattatgggtcagatagatttatggccttggagaatcactaatgaaaatccctttggttatgaagttggagaagggctaacccagatgtaggaagggttgagacacatatgtgctcctggggagcccagttccctggtgggtgacaagctaaggggacttgggaatggcggctagaaaaacttaccaacttcccattctatatttgtcatatccaaatgagcacaaaactcaaagaaaagccataagactaaattgttaagaataagagagagatgataggtagggcttccaggggagggagggggacaccaaccctacccataaaaccttcgaccctgattacaagatatctggggataaagatagagcagagactggggggatggccaaccagtggctggcccaacttgactcatcccatgggcaaaaaccaattcctaacactagaaatgatgttctgctaagcttgcagacagaagcctagcataactagcctctgagaggcttcacccaacacgtgatggaaacagataaagagacccatagccaaactttaggcaaagattggggagtcttgaggaagaggaagagagaggttgggttgagggagctggaggggtcaagcacaccacaagaatacatacagaataaattaacctgggcccacgggagctccccaggactaagccaccaaccaaagagcatgcaggggctatacctacgacccctatacatatgtagcagatgtacagcttggtcttcatgtgggtcccataacactcggaacaaggactgactgtctctgaccctgttccctgcctttggctcccttcacctttcagggctgtcttgtctggcctcagtgggagaggatgcacctagtcctattgcaatttgatgtgccaggttgggctgatagccatggaggctgaagggaagggggagttgggggaggggtgggagggtgggactgggagaagaggagggctgtgatcaggatgtaaagtaaaataaataatgaaaaaaacagaggaagaagaaataaaatcttttgaagtcaatgtatcgtttgggccctttcataactgtgctgcccctcagtgattgctgtcaccatttaaatgtgttggaatctcatgaactaggagttcttagttttcttttaaaactccacagttgtttgctcaggctcaccttcattttaatctttgcctggaaggggtgtggtttctcaagctactccatgttactcgttggactgtctgcatggtgctgtgtcacttggcgatagggttgcacttggtgttcactcccctcattgggttggtggcccatctgggaagttaaaagtgacccggagtgacccgcgcatcaaggaagccagtgattgcagtgtgagagcatctattcatcaaaggacctggccctggccacagcttaagatttatttggggcatctcctgagctggctgacctgggagagtggccttgcaaaatattttgctcgtatcttttgatataatttggtatctgtctaaataaatgttctggagcagatggttacagaatgtcttatcatattcttgggcagactctgcccttgaaatattttcatttaatcatcatgttgcaaagctcaaaacagtagctttattatttcttttgagcacaaaatgaatctcactcaataggttggtattctggttaatgtattgcaagcctaaaatatattcaaaatataaaccttttctgggctggtcttaagcggaatttctccacaggcactctttattttagaattcatggaagagtatccttccatttgaagtatttgatgatgtcatcttgggtgatagcctagaagctgaagttcaacatgttgtcaacatttgtcctctgtccctaaacctgatgaaacacacacacacacacacacacacacacacacacacacacctctgctatttctttgttgcttttcatgagtttaatatcaaatcccttttctcattcaaaatcaatagcctaccatacaaagtgctttgtactactgatcatgagaaagctgtaattaatgtgtgtgtgtgacaatttatcagttggtgtcttttgtttgttttgttttataggtgcacttttcaaggggattgcacacatgctgggagctttgaaaactggctggatatttcatcaggacctaaaaaatgcccgaaaattcagatacttcgaagcctccgagagagagtaagaggaaataattttatttgtctttatgatattgtctttatgatatggtacagctgccttctgggtataaagaaaatcttttcacaatgaaataggcttcatgacaggactccattcattctgttggtgaatggtaagggcctgccagatgttgtctatctgcaaagtgccaaggatgcagtaatagccaggtcattcgtggtacagcccacccccatagaggctgccatcttgctaagtaaagatgacctttaggggttgaaatcaaagagaagatgcattttttttatgcagaagatatccagcttgattttaaaaatagaggaacaataagctcagacttatagttgagtagatccctgcaatgtggatctcagtgggattttattttgatcagccagtcttaataccgctgtcttcagtctttgaacaactgccggtgcaggagtcaagcaggagcatgcaccaaagggtgattgggtcccttggaaagctcctgacatggcgtgaaagagggacacagagagcgcattggagcagagccttccctgatgcccacacccaccctgccttgaggggaatagaattccttacatgatgctgtaaggagacatttcctccctaatcatggctcttgtgttatgagtaattgcacagagtccccgtcagcagccagttgacctgtcgactgcactcactgtgttctgtgtgaatgccacattaacaaggaaatgggccactttctcttctcgctttgccatttcaaatagcaagaaccacgccacttaagatgatttaacatttaataaaggaaagccagggcatttaatgagtgataaataataaaagaaccaagctttcaagtcatgaccgatcagaactcatggattgaaagttacttgctattgttgcttcctgtcactctctgaagcaagggcgagctccaaatctccaaactcctgccagctccgtgccagggggtcagaatcagagtaagtgaagttcagccatccatacacaggtgtagtcaagttcttttcttactgatctgaagaaacagccggctttgatgctaagtgctaggcaaaaagcattaagatgttttgatatcctcaggactctgatacatggttaagattatgcaaggagtttttctctttgtcattgaaggaactgttaagggtgatactataccttagaatagaaagaaaaaaaaaatagcttgcttaagtgccgcttatacagttagcttacctatctaggggtggtatagccaaatcaccatttacatgtcatctggaacatttaaaaaaacctgtttccactcactcaggagtagtagatcacccctgtaatcccagtgttcaagaggcaagggcaggaggatccctgtgagtctgagggaccagcctggtctccataataagtttcaggccagctaggactccatagtgagaccctgcatcaaacaacacagagccaaaaaccttgcccacaaccactcgttcccccaccctgtgtccccactgtggcttaccgatgggcctggccgtcttcccatgcagccattacatcactgtccacaaatcagagataagttctttttttttttttaaattcacatgctactatttcacgtgtgcttgtgcatgccatagcatgactatggtcagaggaagggtggagtgggttctcttcttccaccgtgtgggtcctggggctctgactcaggttatcaggcttgtctataggtatctttacctgctgagccacctcactggctcaatgatttgctaatttcccttcaggtcttctttaaaactatctctgcacttatcttcctcccaaccaagggattgaatcttatgcatgccagaggcaagcactctcccacttagctgtactcattagctctagattgttccttttaatactactgatgcggttcgacccctctttctctcttcagctctccctgctctctctttcttctcccttcctgctttactgccgtattaccagacctggctccttctgatcatgctgtttccacgtatttcttactccctggccatctgtgacgtacatgaaagcctcaggtcaccgtttcaatagtgcccgacccttacctaaagagatggcagtctgtggttgttcccaatacaatctattaggtaaggtcaaagagtatttgctagctgtccatcatatgcctgccaacatcctagcacctttgcaggtatggaataaaaaatacattacagaaccttggctcataagaagcattatttcattacccaaaagcagccagagaataggatgtcttcatcttcactgagggattcataattaaaagaattaattagagaagcacctgttagtctgggatggatttctctaaggtttttgttgagcagaaagaagaagaagaaggggatgtagtctcctattgaaccgaaatttcttgttggtgctcatctgtctccgtgtgattatgtgagcattgtcttagtcagggttctctaaaggaacataatttagagggagggaaggagggagggaggaagggagatatgtttgtgtaaatatatatatatatatatatatatacatatatatatatatatttaaaaagggatttactaaaatggtttatagactgtagtctgagaagtcaaaaaatcgatgtctcccaaccacaaggccaaggatctagtagttgctcagtacatgagactgcatatctttatagtcccaatctgatactggaatcccaggtacattctagaaagcgtctaggaagaaggctctgatagcggcaaagaaatgcttcagtaacaggatagatgaacttgctagcaagagtgagactaaactggcaaaaagcaaaagcttccttcttcgaggtccttttacgtgggctgccgccaaatgtggcctagatttacagtgaatcttcagatctcaaatccaagcaagaaaatgctcacagctgtgcccagttgcttgggttatagttgattctggatgcagacagcttgacaaccaagatcagccatcacaagcatggagatttgtatggaggcattggttccaagcgcggcttatgagcatggccttcccagttgaatggctagctaacggagaagggaggccagtaaaaccggaacccgagtcacggtgcagacatggtcccatggcattacacatgcagttaagaacactgtgctcaacacatacagagagtgttagtgttcagtgaaaatcattaaccaataagaatatgatggattaggaacagaaaacttttttttcttcccacaaaacaacctggtttctaaaggagaggtggcaaagagactcttccacaaatcagaacggaaaaaaattctaccagcactgcttgtgtcaacagtgtctcttggccagtcgtacaagaagcaagtagttgggggctggagagatggctcagtggttaagagcactggctgttcttccagaggtcctgagttcaaatcccagcacccacccacgtggtggctcacaaccatctgtactgggatccgatgccctcttctggtgtgtctgaagacagctacagtgtactcatagacataaaaaaaattacacaaagcaagtcatataaataattgaaatgaaatacagaaaaatgtcactgcttgctaaccctacactgatgcatatattctaaatatattcatttgaaaaaccattgtcagattccaagatgtaagttgcttgagagagcacacgctccctagcatcgccaaaatttaaaaatatcaaaaactacactaaataaataaataaataaataaaaatacagatgttcaatcaattctcagcattcatacagtgtgtcaggtaaacaactatcaacttccagtctttggaaaaaataattcatttataaaagcaatggaagtattcaggaacaaacttcagaaacaacatgtatttcctgtatttaaaagttacttttaagctgagcaatggtggcacattcctttaatcccagcacttgggaaacagaggcaggcagatctctgagttcaaggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcagaacagagagtggtctgttgagcctatttatagtttgtcattgtataaccttctcaattagaaacataagtgtaaatagatatgtagaagatatctcctttggaaagtaggaaaaacatctatgtatatccataaacatcccatgtttcttaggagaatttacttccatgacttatttttctagattttgaaatgagtaggaatttactttatattaatactgtatttatttggaataatatgagctgatttgaatatctagtgtgtgtgtatatatatacatatacatatacatatacatatacatatacatatacatatacatatacatatacatatacatatacatatacgtatgtatatatatgcatgaccactgttaataattataaacaaatgcattattacacaaatacattgtctgtttgtacagtatgtatataatggtcaatggatgacaacagtagttcttaatttgttctgactttaaaatagtaagatgattgatagaatacaactcaaagatgaatacaagaattttaaagatcagatgttataaaataaggagaactagaattttataaaaagcaatgacttacaaactatggaaacattcacttcataattcatgttaaatttaaaagtacataattcagggttgatgaaagggctccactgttaagaacactgccgctcttccaaagctcgactcctacgctgagtggctcacaaccacctgtaactccagatctgacggtcacttcctgcttccataggcaactacacacacacacacacacacacacccacacacacacacacacacacacagcataccctcacacactctctcttaaatacatacaagaaaataaaacaataaaatatttaaaaatatataaagtgaatctaggataattgagtaacttacataaagagtcacagaaaatggaatcatatgtcacatagtttgaaggtatgataattttctttagctctgaagtatgtagtgacaaaaaaaatatttatacaatcagtgtactttaaaaacagttttgggctagagtagtctaggcagtagagggattgcctagcttatggctttaaccctcaacactggcaaaagtaactatagaagagggaaaatgaattaataaggcatatatgtctgcaaggtatttgccatagctaaaatctctcaagacaagaaaactagggaaaaagaaaaagagaaagattaatacacgaaaaagcaagtagtcaaaggcaaacgtcctcaaagagcaggtttgggaaagtagctataaatatggaaataggttcaaccttgctagttatggaataaatacaaattaaagagataataagttatgccaacacccagtgttgctgatgccaattagcacaacccttttggaaagcaatttggcagtatgtctcaaaagtaataaatatattcagtttgtttaaatcgctaattccaggcatagaatccaagggagcaacttgaaagaagaaagccctacgcataagcctctatggcggcggcgtttatagcattagaaacctgtttggcaataaagagaaaagttaagtaaaataagatccttgcatgtccacatgatggaatgttctacagcagtgagttctttggccctgtgtttactgcagtctaattgattttccaaccatccctgcatcccatctgaccccagagtcctaccctttcctctttgttcagctgtgctcaacaaagagccatgaatctggtaagggttctcatattgggctggggaagctctcttagttacttttctgttgctgcaatcaaacaccaggaccaaggcagcttagagagaggagagttagcctgggcttgtggttccagagggacgtgagtgagtccatggtggtggggtggaggcaagggggcaaatggcaagaggggatgggaggcaggaagctcaccttgaactgtaagcatgatggagagagagaaaaaaatagtgccaagattttaatctcaaacacacacacacacacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctccctctccctctccctctccctctccctctctctcactcatacacacacacacacacacacacacacacacacctttgcttcctgactctgagcccctcccactgtacctgaaagagtatgctggcttctatttcctacctggctgctccttcaccatcgttcccttgatcctgctcttgccaaggtcactgttgacctctaccctaaagtccttgtcctactgggatgattggcagtgttcctttataattaattaattaattaattaactaattaatatttgcttacttatataggtatatgcttgtatgtggctatgcatacctatatagggcagcaggtttcctcttctgtctctcttcacttactcctttgagacgggtctttccctaaacttggggctcacattttttttaccttagtctggaaggtagcaagctctaatggtccttgtgggtccacttggcttagagctgaggttctaggcatttgcagggataaccagccttttgtgtgtgtcctggggtccaaactccggtccttatgattatggagtgatcactcgaccactgagcacctcgaagtcctgaccaggagcattcatgaaaccccctcttccgttgcctgtgcataacacaccctgtcttagttactcttctattgttgtgacagaaaaacatggctgaggcatcttgtaaataaggcatttagttgggcttaccattacagggatgtaggtttactccgtgaggatggtaaaggcatgacagttcagacagcttagagtttgtatgttgatccgcaagtagacagaatgagacactcggaatgccaaaagtcttttgaatcctcaaagcccacccccagtgatacacctcctctaataaggccataccttctaatccctcctaaaaagtttcatcaattggggaccaagtattcaaatatatgagcctgtgggtgccattctcactcaaaccaacacttaacctctccacttctccttatgtcacatcacatcttgttgactctaggaaaaaaatatgtgtgtgtgtataaatatatatatatatatatatattatatatatattatcacatatattatcatatatatagtatatcatatatgtaataaattatatacacacatatatacacacacacatatacataaacacacacatatatgtgtatatatattccagtttggactcattctttttactctttgtccatacaatcttatccacttatccacttccatggctttatatatcttccgtacattcagatttcttttgtgtctagccagtatcgattgatcctctgaccttcaggcctatcttgatatatccttttgatgacatacaagtatcttgaacttgagagatccctcactcccttagcaagtcccacctcagcatatacttaccacttctgatgctttcatccatcagtcttctcaccagaatcctcacattcacatccctcccgccaatcctgttcatccaacctccagatggttctcctaattggtctgattctttctatttcactctgccactatagcccaggcttctgtcatctcttgatgatgtcttgatgccatgtgaccctctaggttgactctactgggatgtctgtctgttcttctgtaaactctcaaaggataaggactgtagttgtttagctagctggttacttggtgccttgagcagcatttggccatgttaggagcttgttatttatttatagaataaataagcagaatggtttcagttatgtaaaaattatgtgtgagaactggaaggaagtggggaataattaaacagctgacgaaaatgggatttagaaaaaccactgatgaaggaattcagagtaagagacacacatataagaaatatgtagttatgcaccagcgtgtgtgatggagagagtatcatgggataaagaattcaatatgaccgagagtgcaggcccctgagaagataaactagcaaggacagtttggagttcattcccatactcctgtgaacttgtggtggtacatgcctgttaacccagctcctcagaaggctgaggcagggggatcacaaatagaagccagctgggatgcgtatgtagaccggttgtaaagtgcttgcctagcgtgtaccaggccttgggtccagtccacagtgtcacagataggtaaaaaatgtctcatatagatgcttagacttcaggccaggtgaacttggtctgaaggaacctgcttcccacagctttattctatggactgaaaacacattttttaaaaaaatattctaagattggggtatagattcagcaagctgttaggggtccaggagagacagcagggaaggcataggtggccatataggaggtctgagcagagatcaggaggatgagaatggagaccccccaggtggtccaggccgctggtctccatcacaggtgaaagggctacctggtccgccactcagcttcccacccttaacccatctgccgcctgaagtcagttgatctgctagcatttaaccctttaacttcccttctcaatgagagagctgccttgattctttagatatttcttgtggagaaatgtgctttaggagtttgggacttcaagtcttgctttttggtcctcctacatatgcactgtatgcctctgcgcatgcacagacactcagaaaaccctcttcctgtaaatctcctcggggatttgaccacatggtaaaccatagctaattttaaaagcagattgagctattatctggtagcattcataggaaggaataaagaggtggcaagggtaccttaacacccaaaagatcaaggaacagcctcttaaataaaccatggattagagtcatgcaaatgaaaatacaatcctgtgtttgcatgggaatgcttaataatgtagagacatatggttcaccaaaatgacagaatacttttgctgtttcagtaagatacatcatcccctcaacctctcttggataattgtgattctcaaaaagatgaaccatgtctaggaatccctatgaaaataaagataaatcaggaggcatttgccttattagatatttaaagtagtaaaaacgtagtgaccatgggatagaagtagattccaaatatattacacgtattatatggtaatacattgcaaacaggacactgtggtggtttgaatgggaatggccctcatacactcctgtgtttgaacacttggccatagggagtgtggccttgttagaggaagtgtgtcactgtggagacaggcttcaaggtagtatgtatgctcaagctatgcccagtggggcagacagtctcctgctgctgcctgtgcatcaagaagtagaactctcagctccttctccagcaccatgtctgcctgcatgctggcatgcttcttgctatgacagtaatggactaaacctctgaacctgtaagtcagcccccagttaaatgtttttctttataagaattaccatggtcatggtgtctctttacaaaccaagaccaaacaaaacaaaacaaaaacctaagacagatatcttgagggatggggagatggctcagaagttaagagtgctcgttgctcttccaggggatcctggtttggttcccagaacacacttggcagctcataaccatttgtagctccggttagggttagggttagggttagggttagggttagggttagggttagggttagggttagggttagggttagggtctaaccctgatacaggcacatatagatacatatacatatatgcaagaaatacatttatacaaataaaatacacaaatctaaaatgttttctgaagtaaaagtgatatcttgcttcagtggggaaaggaaagggtttttttgttgtttaggaaatggtgatgatatagctaattagccatctggataaaaataaaattggacttttatcccacactatagatacacaaataaattccagatgggttaaaaatgttaagtttaaaaaacaaaacagtaaggaggatggaactatttaattcttgtctgtaagctagagtttaggacgcatttaatagtcaaaacaagaacactgatatctgcttacataaagagatgctgtatcaggctaagagattagacaaacaaaagtcaaaacgaacggtagattatgagaaagtgtgtcagaaatatgacagataaggattaatatctacgtggtgcagagagctcttcaaaattgataagaaaaatacacagcagaaatgtggtcaaaaacttggaatatgcgtttcacagaagaacaaatcaaacacccagtaaaacccatctgtgttttaataccagctccctagagaaactctccttcccatggcaggttgtcttacttagggtttctatttcctgtgaagagacaccatgaccatgacaactcttgtaaggaaaacagttcattggggctggcttacagtttcagaggtttagtccgttatccttatggcaacgagcaggaagagacagtgaaccacgtttggcctggcttgagcttctaagacttcaaagccaacctcctagtaaatcacctcctctgacaaggccacacctcctctgacaaggccacacctcctaatcgtgccacaccctctgagcctatggggccattttcattcaaagtagcacacaggtctacaggtgatttcccataaggctttaggagggataccgacggtacaaaccaaccgtgtgatatgtgtcttcctccctacacagaccacagtgaccattgtgggaagcatctccgcaagacactcggagtgcgtggtgaagaacgcagacacgggcaagctgctctgccaggggagaagccaactgaactggacctgtgcctgcaatatccccagcagacccagctatagtatgtggattcctctgggcaatcattatacagtcaagaacaagagcctctcctgagttcagttactgggggttggggtagttcccttcctgtctctttacctctggttctcacccaagtcttcactacatactacccccatctcctgagtctactccagcccctcactttctgatgtgactggggagagatagggaaggagacattggctaagagagcttagtaatactaatgtaatattactaggtacctataaccataaaggcacctttatgtcttaggattttattgctttgaagagacaccatgaccatgacaactcttagaagaaaaacacttagttggggctgggttaagtttcagaggttcagtccgttgttgtcatggcaggaagcatggcagcatgcaggcagacatgatgctggagaagctgagagttctacatctggatccacaggcagcaggaagagacagtgagccactctaggccaggctagagtttatgagacttcccagcccaaaccagggagacactttctccaacaaagccacacctactccaacaaggctacagctctcaatagtagtgccatccctatgagcctatgggatcattttcattcaaactacaacacctggggtggatctctttttgggtgatatcagtcctgcaagaaggaggggagataagccagagaaaagagagaaaggaatgcaaccagagaccagcttgtgtactagacagaagaagagaaaggggcttaaactggggaactaaaaaaaggctctctatgagtggagcaagcgggataggggcagggaggaccagacagcaggggagctaggggacaatagaagaccatgtgaaacgtgggctccatcctgggacgtctcagctacaagtagcacagtcagattcattagcaggaagagacaattgtggatgatctatccctggagaagataagccccatggggcaggaaccttgaaaagtttgttgctgtgcatagcattgtatctagcccagtatgtcagtggatttttagggagtagatggacaggtgaatggtaatgaatggagaggaaagtaaagaactgaaattcttggttcctaaagagtggctaatagaaaagccatcgaggtggtccagacaagagagactaagagaaggtactcgaggcgaatggatgcaaagtggacatctagggatgtccaggaggctcaaaagaggattcatgagtctgctaagatggaaaagacttgggagagttaaggtgatggtgggcgcctcctagaatgttatcacactggagctgtttgagttgcttgtgagcagcaaagttactattggataatgtatagatggaaatttattgcttatagttccagaggcaggggatcctagatgagggcatcagacaattcagtgtatggtgaaggctttctctctctctctctctctctctctctcactcactctctctctctctctctctctttctgtctctctctgtctctctctctctctgtctctctctgtctctctctctctctgtgtctctctctgtctctctgtctctgtctctgtctctctctctctctctctctctctctctctctctctctctctctctgcttcagagatgatgcccaatcctcccttataaggacaccaatcccatccatgaggtgttaaatcatgagtcctcatgatttaactacttcctgaaggctccacctcatgatattatcaaatcgagtgttgagttcccaaataaaaatgttgatataccaaacagcaagcctagagtgctcagttgagccttcttccctcaagagggaactggatacacaaagccagagtcacaagctaaaaatgtcccttgaaatcactggatctagatactttaaaactgcatcagttttctactttgtcaccactgtactgtctttcaaatgcacttctggtgaaattgggtcattaaagatgcagatcttgctcacgtataaaatatcactctaagtatccaagacagacttagaaagcttggctgaatgcaacaagctcaggtatctattctttgtgctcagctgtctaaagcaatggatgaaacttagtttgtgggttctctatctgtctctctctgcctctctgtctctgtctctctgtctctgtctctctctgtatatgtagcaaatcctcctgctttagcctcctcagtgttagaacatatatatgtgtacacacacacacacacacacacatttctagacatgatccatcatgtctacattcctggcctatttgggctggtcttacctctcctgtcaagtcttgttttccatatactttgaaacagtggagaaaggtcacctctcccatacaccttcctagtctctctgccacacctttggttttccagaagcacctctgtcttgtacctaaattctacatggagttcaacctccgcacaacatggtatccccttgacttctgtttcttcttcaccttggctattttacctcctctagaactgtaagtgcttccagaggagaggctgtgaatattcatttccctgggaaatttccaacatgttgtgcacggttggtgctcagtaaaacctgacttcttgggcaccctccctgggcccttgtcagttctatgggaatgcattttcgctgggagtccctcagtactaaatggccatgtgtgcgttccactaacatgcgtcaagtgtctgtgcagatgctcctgccgagaggtcgtgtcagccctccagacctccttgtctttaaaacaaaagattatcatttcacataagcccactttgcgtgagcagaatgctgggtggaattccagccacacagagaatcaaaggagttccttgtgctggaagagaggcatctccacgcaaggatccttagagtttgtgaacagcgcactaatacaatgccaggaaggaacatagggacgatgtctacaaagtcaggccaacttctcacaatgtcaagactcccatttaacaagcctcatgaattcctacaagtaagaagatattatttcctctgtattagtgctggtccttgcttagacataataggaccacagtgatgttgctgtggaccacggtacccaaaggatggtctgtgtgctcattatgttgggaggggcgttacaatattcaggttctgagaccagcctcaggtctgcagagtcatggtggcttagaatacagctctggtgttgatatttccctaaagcctttctgattctgaccaacagctgggtttgatttcctgctgcctcagatccagcattggggtttaaggaggtaccgaaagcagcatttctctactgctgacttagcataggttttacccctccccccattttattctattggagttttccaaccaacagataaggttttcagaagcaaaccagaacaccttcacttgacagtaggtgactccaaggagatcattgggcctcaccccagggtacggcgttcagggtttcttaggtaaatatttactgagtgtggatggctctgaaggtgcagggtttcttttccggtgctggcattcatattccaggcacttcttgctcggtgacttgttttattctcatgccttggccaattacaagctgaggtagtgatcccagcgagagcatgggatgtaaatgggctgtaaaatggcttttcctggtgattatctgtgggagccttggagctagcatcaggctcagtctgtttggaggcttatgctgtgcactgcggctgcctgacatgaatggcccatggggaaggagccacacactgattgaaatgttggtgaacagctggcacacccgtgccctctgtgtagaaaaggcaagaatatttctttcttccttttgcatctccagctatgcttgactatggcggggacccacgatgaatgccttttcccttccctttcttttcctccagatgtcttagttgtcaatgcgaccttctcctttccgtcttggaacttatcagaaagattcaacttcaccaactgtgcgtcattaaaagagtaagattggctttgacttttaaatgttctcattgcttttaaatttatttgttttgctcctcgatttcctaaagaactcctttgcgaactagaactttccaaagtgccttttggagcatggcctaacgggagctaggagagccacggcggtaataaaccgtgctcactcgttcaagccctaacaagaaaactggagcagcctcagagagcatgcgccaaggtgtccctatcaacagggaaaggtattttccccagacctggaggatccctgaagaaaggatcagtaaggaataccactaactcccataatgcaaatggctctgggagtttggacagagcagtaagacttgcgaatgaggacaagttgaagtctccttcaccaaaaaggcatatccattttgctttctctctgtggtgctagggaactggacttgtgggccttgagcatgctaagcaagtctaccacttagtgaccccagccctgtgtcttccatttatttactattggccccaattcagctatggaccctttgaatttggactacagctccctcttggctcctaaagcagagaaaaggcagaggaaatagtctcttcagaggcccatcctctgcagctgggacagaggacactggtgggctgtattaccagaggtgtgttatccattctgggatgtgattggacatcagcataggagaacagcttccagcctggcccggaagtcactataggaaaaagtgaagtcagatggtgttaagttaccttttccaaagaggtgcattgcaaggccacagagagtcattgctgtctaagaagcagagcgaagttagggaagaaaaatagaactccaacccaggtaaaaggaagagagaatgaagtagaaattaggggtgcaaggacagtttaaagatgtcttgctgtagatcccctgctctagagcccaggtagaaggaaatgacataccccagggtcccaatgctaggtatataccagacctcagagccagatccaccagcctagagagctccttttcagggaactccttggggaacaggcttcctccctgatatgtagtctgttttctgccctcagggaacttctttctgtctgttaggatctccggagcatatatgaactccaggccaagtgtactccctctgtccggtttcctcatcacctcctgctaagttttcttgaggcatcccttggacagctctccagaccagccccgatctttcttctattaataatgtctctccctgatctccaatcattccttatgcatggagggcattctcaggctctccacagtcacccacgcacaaatgcctcctttgattctcaggtccaactcttcctttggttgtaaagcaaacagtggtgccccatcctctctgcctgccaggaaatgctttgtgtctcacaccgtgttgtgggcagcacagctgctccagacagcgcgggctctgctgatccgttgagtggcagccgggagagaaagatctcactttatggaggcttacctgagggtaggcaaatagcaaccaggttcagaatcggattcagtgggttcctgttatcaacagaccagcgggtgaccccagcttcaggtctccatggcaacacctctgtaagtgtgatgacaatccatcaactcacagggcttcccagagaaacacataaagccttgctcgcttctccaacctcaaaggaaatccttcctccctttgtccccctagctagtcaaagactttattattaatagtagtatcattcctgtatgttctcaacctgtagcgccaccgagggaagtttctagaatatgaataattccctcaaagtacagaaattaagttgtttattttccgtgtcaccagatgcccggcgtgtatcagaagcggctgtgcttggtgtaaacgggacaagaaatgcatccaccccttcaccccctgcgaaccatcagactatgagaggaatcaggtaaagtgacatttcgaaatatgacagagatctatcggaagcaagtgcctgcgtgcgcacagccccacccctttctgtgtgtcacactcccatgctgaggggatgttctccaatgcaggagctctgtcaagttgctgtggagaagtcgcccaaggactcaggaggaggaagagtcaaggagagcaagagaaacagaactgacggggctgtgcaggtcaggctcaactttggtgctggtaatggaaagacaaaatccccttttgatggcaataacaactcttactactttgggtttctgttgtaaaattccccatcttataacctcagtccctcctcccccacacacacttttttttttttagttcatttttaaaccaagtttcacataattggctcaatacatcaaaggctttcacattcacataagagaaattaaaactttgtaattgtgaaaaatgatgcggttccagtagaagtggaattgtaaaggtgactttgtggctcactggggaaagtacaacggacagctgagctgacctcagttccaaccagatactctgacttcactaatgaccagcactgtgtgtgtggttagggatctatgcaaaataagcaaactgaccttgcttattttttgatttgatttatggagttgattgaccccatcattaataacatcaagatagaacagctgaagaatatgtgcctccctcccttgtctcaaaagtggcggaggtttttttcccatgaaagtttcctggaaaattctcttgctttgtcttcacagttataattaccacagcctagatatcagtcatatacaaaaagatggtctgagaccatgtgaatatttccgcacaggacacatgtaactctgtttagttccgtactggctccctccagttgctagaagttcattaattgtttacatgtggtaacacacacacacacacacacacacacacacacacacacacacacacacacagagtggacaggttccctccctcattctctttcgactctgtcaaattaagatcagcactggaagaaattccaagggcccagctttctactctctgaccaggctggggctctgatttagccatttgctgctacttaaggtcaagtgtcaacaccaataaggagcacattttcaatcattactgaaaagttgatagtaactttaggtgaattaagtaacaggctgagggcctgtgaacccaaatggattataaagttaattaaagcattagtgaaccttggtgtgccaatatctccggcctttgagtctctgagacttaattaagtggtgggctgctcctctggtctccgtggtttgtaaaaaatgaagatgcagtgacaggagcttggatggagaagtgagaagcttttgtcttttaattaagcttggtggtggtggctttcagttttggtaaactgcagggaccatgagatttaccatcttcactatttttagtgtgcacttccgtaatgtaagtattccttcaccctgcatgtacagccagtcactgcaatacttttcatcgtgccagactgaaactcaatactcatttagtaactcctccccccgccccggccccgccctcatcccaccccggccccgccctcaccctgcccccagactcttgtaaacccctattctattctaacccctattctatcttcaccttgtgtgaggggtttgcctcttgtgacaggcttactttatcattgtgccctccaggctcactgtgttgtggcacggattagactttctttccttttgaaggctgaataatattccagcatatgtatagaacacattttatttatacattcccccaaccacaggctctcagtttgctttcaccatttaggcattaggacaagcccagttagaaacaccggcatacaactgactcttagagccaccctgtttagttcttttgctcaacaccacagagttaagactcctggatcacactgtaattctttttactaagtgccaccatcctgtcttgcacggtactctgtctagccaagggttctactaacagggttcaagggtttctgtctctcgaattctcacggaccttttcctgttttgtttggtttggtctggtcactactgtactcacagatgtgagcagcagcctcactgactttggttgtctgctccatgcgctttctgactccttttcatttgcttgttcactggctgaagtcctctgctaaactccttcccattgacttgactggttaacttgttttcttcctttgggcacaagaagtatattctagggattagccagatacaacatttgaaagtattcctctcctattctgttatctttcaactctgttgaatgtgtgtgtgtgtgtgtgtgtgtgtgtgtgagagagagagagagagagagagagagagagagagggagagagagagagagagagtatgagagagtatgtgtgtatgtctgatgtgtacatgtgtgtttaaatatgtatgtgtgtgtatatatatatatatatctgtatatgtataaatatatatatgtgtgtgtgtgtgtgtgtgtgcatgatcatatgtgtgtgttgcaacatcccaaacccacagcctcacacacaccagacaagtactctacattaagttatatccctgaactagtcatgttctttgatacatagaacttttaatttcagtgaagtccaatttgcctattttttttttctgttgtttcttgtgctttggggggcaggctcaggagatgactactaaaccctaatgttgtgaagcctttcaaacttccattttcctctttgagttttaactcatctgtgcacaccttgcccactggagtccgtttttgtagatagagtaaagtgaggttcagcagcccttcttctgcacatggatttccagcaccattccttgaacactctctccctgggtcagtggttatagcatcctcactgagaaccccatgggcttgcatgcaagtctttattcctgaggttcctccctgtcccagtgctctgagcacccgtcttcacatgagtactataccatctatgtttatactggttttttttttaagtctgtttttggaaccagtatcttccaagttctctcttgtcttcgattgtttcataagaaaacaacacgtaaaattttcactctgttttcctctgatagtaccacctatagctgaagattagccctgctaatgatgtcaaaggtcaaggtataggatgctcattaccacaggccaccccaggctgccattttatagctccatctactgtctcctgcccccaccagccctggagccccacaccactaacatgttctccatttctatagtctggtcgcttctaaaattttatgtaaatagaatcgtctggatgtcccctttgggagattagttttttttattaaatttgtttttatggatatataaaaacagaaattatacatattaatggggtaccatgtgatgcaattggatggaaattcagccgagttcttgtatagcagtctgggcagtgctttataaatatcttaaagagaagggtgacatagtcatagcaccctgacttcttgtaccttctaaactgtgatactgtggtttaaaaagtagcgtcaccaagaaagaaaggtaggtctcaaaagaagccaaggtttgccttcaacacttctctacagattgcccttctatgtttggagaaaggcatgttgctgagactgaaacattaactttacgtacgtgtgactcagagcagaatctcaagtttggttggtagggaatggtatgccacctggcacaggagagatttcctgtgctctctctgtgaaaggccactgtctttcattatcacatgaacatgaaactttctggtttgcacggttggttctcacgtcaagtttgtgtagtagacccaacagttgaggcagagaagccaccaagagcttttcttgaattcatctgcccacatcacctcagcaccaaatgcttcctgtgtgctgggcaccatctgaggctcagagatgctgagctagagtcagtgcttcctacaggaagcgctgaagcatctgctatatgatgtcatgctgaactccatggatactgcacgcaatatacaaatgagttaatcctctctcaggacatcagccctgagactcttttccatgagaacacccatagcagtacaagatttatataatacgtatatgtatgtataagcagaacctgaaagtacaaaaactcaaagccttgctatgcacagagtcttagctcttagtttttcttgtttatttaagcccagtacctgatggttaagcacaatcagtgtggttggttaagtctttgatggatgcattgatggaaaggacttttcagcttaccttagagggacaagaaatacctaggctcaacaagacagaggagtgaatattcttcatgaagcaactgccataaataagtgtagtcatggccggaaaatccaggagacctcagtagttcagtttgtcttggcagcagaggcaggggacaaatgatagcatagaagggtgaacaagctggagcctgtgtgtgctgggatgtatacctttggggatttttgtcttgcttcttcagtggcaatgcaaagcttttcactacatctattttagtatcaatttgatcatctgagaatgtggtgctcaaaagggaggactcctggttcaatcccaggacagtcggcttcacattctcatgatcctaagacttacttgatccaggatactgtggtggtttgaatatgcttggcccatgggaagtggcactaccttgttagagtaggtgtggccttgttgggagaagtgtgtcactgtgtaggcggactttgagggcttctagtgctcaagccccaaccagtgtggaagagacagtctcctcctgcttgacttcagatcaggatgtagaactctcagccccctttccagcaccatgtctgcctggacactgccatacttcccaccatgatgataatgaactgaacctctaaaagtgtaagccagccccctttcattgttgtcctttataaaagttgccttggtcatggtgtctcttcacagcaatggaaaccctaagacagataccctgatccaggaacaccagccctaatttgtcaggagactgaagcaaagaaaagcataggcccagtaaagaagccccagatttcatctggcctagaacgagggcagccatctgctgtaagaccaatcttgatctctgctttcctgaagccatgagacggcaagttctgtcatctgactgggtgaccatctttcctttcattccctaaccgtctttcatctggtgcccttacccaatgagggaagctgtagctgccctcctgcccacagggaaggctgtaatgatatgtggtgaattgtagatgttgtctggttatggttttttgttttgttggttggctggttaggtttttttttgttgttgttgttgttgattttggtttgggggggtatttgttttgtttttgttttattcaagacagtgtctcattatgtagctctggctgtcactgtgtagactaggaactcaatatgtagagtaaagtggcctcagactcagagatccaactgcttctgcctccagagtgctgggactaaagagatgaaccaccatgcttggcctctttggccatactcataattcctcgcaatatgtttatcactatagggaggaaatcaaccatgtcaagctatgtctctgcttccctccatgacttttcaatgtgtgctttaatttctcatatagacagtaccaaatggaccctttcaagaaccttgccttcagaaggaaaattaaatttaacacagacttttgttggtttgtttatgagtagcttctatgggcctagcactgttctgcattgagttcattcacaggatatttgttgagcagcaattgtgtgtgtgttgggcaggcacaatacagacccacatggagtttgcactgtcaaacttagaatgttttggaatgaggaagtgagattcttcgttataaaaagagtcaaacactcataacgggaatagaagccaaaaagaatgtcagcgtggactgagttgactagtggcagctaatctttatcagacccttgccatatcctgaactcagtgtctgttaatctaagcttcacaatgccacattttacaggcatggaagttttacctcaaaaccaaaatgtagataagaaatttgaacccaggtatctggatagagaattttcagttttaactaccaccctaccttaaatgacctaaactgaataagtgttaagccacataatattattgctaaaaccctctctggaagggaggaaactcttaaagataatgcaggcttttctcaggattagactataacagtctgtcccatctgtgcgtcaggcagacgggagcttattctcatgggagacggggagggagaggggcatctcagggtgagggctatgagaaagaatgagccccaggatgggccaggatggccaaaacaagagtgagtcaacaaaaatccagtgttcaaactgagtcttgggagaaggtgtgttagaagcagggttaagaactatgttctctggtctcagcatcctgatccttcaggcctgatctgaggggctacattcaggatgaatggccaagagtaagttagggggtagccttggcagctccaccatgggttgtgtcagcctcatcttagagttagtccccaggtcacagaagcaagtcttaatctctcagaagagagcatggatctctgaaagtttcccacctaagtcctgaggccctgatgacctttggcagttcccagttccctgttccatcccaagttctcttttgctgtactgggactcctatgaagggctatctccttaggggactgagcatcaaatacatcgtgaggtgttcattgaactctcccattattctttgatgggattgtattctgctcttttctttccatatcacattcccttttacactttcccgtctccacggctggtcaccacaccgctcactttgtacatatgattaatatattacatctgtcctcttctcggccattaatgaagatgttaaataattctaagccaaatactcacccccgtggggccccacaggacactttcgtttaattagttgtattacctttcatctctctcatgtcctttgacttcagatgtcctgctgattttgaagccatgtgacttttcatcctgtcctgtttgaactaatttcatgagtgaaaatctgagagatgttttaccaagtgttgacttgggtccagacctacagagagcttcactatgttctgattttttttcccctaacagattaatagagtatagtttgttcttaataaactgagccttcttaatggacctctttccaatagtcttttctctaaaaatgtcatggcaatttgagttatgttggtgtcagacgtcacgcaaggtgagccgtagttaggatttctattgctgcaatacaatactaaagtgactaaaagcaagctgaggaagaaagggcttatttggcctacacttccaggacactgttagtcattgaaggaagtcaggacagtaactcaagcagggcactccactacctggcggcaaaagctgatgcagagggcatgaaggggtgctgcttactggcttgctcctcatggcttgctcaacctgctttcttacagatgccaggaccaccagcccagggattgcatgacccaccatgggctgggtgctcccccatcaatcgctagttaagaaaacgctctacagctggatcttatttaggcagtttctaaattgaggttccctcctgtcaggtaattctagcgtgtgtcaagttgacataagaccagcaagtacaagttgcttgtgccttcagagttgatcctctcagacgttttcaaggagaactgttacaggtggttatacactttccaatatcttataacggcttagttttttgaaaaaaagaaaagaaaagaaaaataaacaggcatcctgcaaactgcctgattaagtactttccaatatgctatcctaatacaaacaaatgagaaacaccccccccctctctctctctctctctctttctctctttaaacaaaatagttaaaatttaccatcacttaaaaataacccctgtctctaaagtggaactcccaggaagtggacagttcagaggttaatgggtagaaggtgttgggccaggatggttacagtcagtgatgtctagatttgatgcaggggaaccttggatatggaaagaaggaagaccctcactataggggtgaggaggcctggctgtatccagcccagttatggtttttagcttgaagggttggctacatcatgtcaggttgtaaattaactttaaattaaagtatcaaataacatctaaagtatggagggcagaaaacattatgggaaagattgttctctggtcctttgtattcattttattttttaaaaagttaacaaatattaaagaaaaaaaaccttttaatgaatcctcatatccatgacgtacagctatgtagctgtgctatcctaaattgtatattttcacagtggggtcatgccactgattgctctttagcctcctaactctgagattaaaaaaaaactctcctggaaaataaaagagctgatgcgaccctctttggaagcaaactgcaggcacctacttccataagaagccaggcctagactcggtcctccatgggcaatgtaaactcctctaaacaataagattgtcaaacgaaatgcttttgaggttgcaaggctcaaggggaaataggaagttaaaaggatatcagcctccgatggtgtttctagagcccttaaaagagcaaaatgcacctacctttgaaacaacaacttttttctttactagttacaaggctctcttatcttgtactatgaacaagaagtagcatgttcaaaagcatgctatcctgttttactatggcagacaactacagtataagtacaagaagcaccgagaaaaagacttggcttcagaggacaaataatggacagtttacaatagcggagaggtatgaccagggagcatcgctcagcgggcagcacacggggatgagcacagaagttacaggccctgaattccgatcccctaaacctagggaaagccaaacacaggaaaagccaagggcaatagcatgtatctgtaactctagcattcctaaggtgagatgggaggcaatgcaacttgtactggctggtcttatgtcaacttggcatatgctagaattatctgatggagagaacctcaatttagtcccatgagtatgtgaagcatcaaacaaggtgtaaggtaaggaccaataccctaggcagttttctgacctctaacatacacatacacacaaacatatatatatacacacacaaacatatatatatacacacacatacacacacacacacacacatatatatatatacacaaacatacacacatatacacacaaacatacacacatatacacacaaacatacacacatatacacacaaacatatacacacaaacatacacacatatacacacaaatatatacatacaaacacacacatatatacacacacaaacatacacacatatacatacacaaacatatacatacagacaaacatacaagcgtgagtgcacaaagtttaaaaaaaatttaaacacacacatatcttgcttctctaataagacagtgtgctctcttgtagagcaggggatacagatttttctctacaacagtggttctaaatcttcctagtgccgtggccctttaatatgttccttatgtggtggtgacactcaaacataaaattatttccattgctaccacataactgtaatttgctgctgtgatgaattgtaatgtaaatagttgtgttttctgagggtcttaagcgacctctgtgaaagggtcctttgtcctccaatggggttgtgacccacaggttcaggacttccatactgcaaagaacctggcagtgtgttttgaggctgtgccagctacacagtctctgttgtaattagctagagataatacacatacttctggataatgacatgtgacatgtgctgttatatgtttgaaattctattctccttttgacatttttttccataggacatccaaaaacagcagacaggatttgaccctgggtctgaagtttcctagcccttgatctgccccccaccacataccatgcctacctttacctagcagctgctggtctagtgatcagtaagtacttgatcacttggctgtcacctacaaagctaaacagcaagtcttcttataacacacacttgacatttgcaagggatttatcttgaagtcgttgctaatccccatcccaagtaccactctaggagataattccaacaccaccccccataaaatgcagtcaagtataacagaataattaaagtgaccctttcaggcacgtagtggttcaataaataaatacagggctaacgttctttttaaggtgattaaaataaagtccaccacaggaatcaattccctgatgcattacatcatcaccacgatgacattaataatggatttatcagaatctgcaaaatcaatccacggtgataatgagtagtggctgctctgccaaatagcccctgggtttgtcaggagagcagggtgagaggttgctcctaccaggcggatggtcagcgtggcagccgaccacattctgtcacccggaccagcaggagatgggcaggcgcgagacatcacagaagctggaccagtgactcagtgtcctcctgatagacgtcatccaacaagcagctgatctctacatttgtgctttggcccagtgtggcatgatgaggcttctctgaactcttaggccactttcaaatgggaagagtgtgactgtggagtctctgtatgctaagacctgccatgctttatgtcagccagagtcttggaatggagagaatctacaaaagaacctccatgatcagaatggacgatggtagcacttggggaagaggtgcacaaggcacctgggttgtttttgtcttgcaaggggggaaacgagagcccgaagggatggctcagtggttaagaataattctcgctcttgcagaggatccagtccaagttcaaatctctgcactaatgtcagatgtgtcacaacagcctgtcattttaattccggacaacaccttcctctggcccctgaagcagctgctcacacatgcatctaaattaaaataaacctttagaagagaagggagatgattcctgcctcctctaggatttgtaggggaaactgattagatcttgcaaatagaggagaagctcagagagatggcctgagtgctagggaagttaggtagcatgtaactccacaggactcagttttgattatagcccagagaaagcgagagactgggtcacagaggttacacgaatgttcacaatgcctaacttttccatacgggagtggctcaacattcttaagacaccctgtcctccgcattgaaacaaacaaacaaaaaatatggactccttcctagagaattaaattcctctgtattgacatttgtattgacggaacaatgagtccgtgtgagcctccgctggggagaccacttcccttcccttccctgggcttgagcatcatgggcctcaggagagggaaaggcagggggctctttctcaactcgaatgacagctcacgcctcagatggaatatccgggctcttcaactgtgttttcaactgtcttgtgagacaaagactaattggtttgaccccatgctgtcacatgttgagagacacgaatcttcagccctcttccttgaattcattgatttcattaaatgctgtctgcttgtgtttgcaaaatgtaatttcctagtgagttcttcgaaccgcaacacatcaacagatttcgtgaaagtgtgtgtgtgtgtgtgtgtgtgtgtgtgtgtgtgtgtgtgtgtgtgtggacacatgtgcacacacgagagagagagagagagagagagagagagagagagagagagagagagagagaaacagtgccattttgtagctttgatctgctgttttaatctcttatttccaataggtcttctacattaaggccattgagccacaaaaaatatcaaccttagggaaaagcaatgtgattgttactggagcaaacttcacccaggcgtcaaatatcaccatgatcctgcgaggaaccagtacctgcgagagggatgtgtaagttgaagcactaacaaccgatctttggtaaagttagaaacctacgctaaagcagtgttagtaggccttggtgctttctgtagtcaaatggcatttaagtattttatacatcaaaattatagtaagtaaattataataagtaaaatctttaatgattcatttgacattcaggtgggagactctggcctgtgttacatcctcagtcaaaaccagtttcaggatgttgccagtgggagccttgattggcttttaaagcagagtcaagtgtatgtagaaaggaactaacttagaattatagacatgaactttggaaacggatggatggagagcgtgctacctgaagttgaaaaggaaaaatggaagtagaaatgttgttcactgtagctttcttctctcgactggcttggttttcatttcaaataattaaattactagggcatataatagtagttaaaaaaaacccacccccaaacaaatatcagatgaagtaccccttaaagataatgatacctgtggttctttttatcctagcaatgaaaaacatatccagtgtttgttcattaatattcttaggtgaatgataacaccttcccaggggggataatactaacattatgtaataataacaccgtgacagataactttagttttctgcttgttgactcttataagtttgggttaatttgaagtttaaaagaaaatgtttcagtctatatgaaccataatactgagctaattctcctcatggaaatgcatttaagacagtctgctgaagcgtgatgttttggttttttaactaccaaaacagacttgtacagtgctgtaatctgccatgcctatttagtgaactttctgttttaattcactggctgcacatcgctgcatcccacctccacttactgcagtaaatctgggatacccatgatctcgatgggggaaagatacccatcagtggctttcctctataccagagtgaatcaacacacattaaagcctgtatctatgcaacctgggttgcttatgtgcaccatttatcctggctaaataccttatagcaaagatctttcattttgtgtggtgaaatctgtgacgttagacacctgtgcgctcaatgaagggcaatcagcttcgctgcaaaataagtcgtttttggagcattaccctgtttctggctctttatgctctcatttccattctgaatgtgtcttgagaagccacagttattaaattaaatgactaagagctctttctgcatggagcattctactaaccacatctgcatggtgaacccaggttcacaagcaggcaacgtaataacgcagttaatcttgtacccgaatccatggtgaaatcccaaaccctgttcatggaaactttgtaagtgaatggctattttttttttaagagaaaaagacaagcctagtagcagaatgatctatatccccacccctcaccttccaaagtgtataagcacatttgtgttttaatgatttgagcatggacttcctagagcttctctttagaagccttaaagatatacatctggggcaggacacatgcaaacagactccagtacctttcaaattcactttcttgtaaggtgtggtgacggtactagggttaacaaccacacacagaatatcccttcagtagtaaaaccagacccttctgtagcctcattaagctgagcaggtggcaaatacaacttgatctaaatgtgtgctttagagactcatagacattagagtcgctgatagtttcagaggggatgtcacagacggctttgatttgattgatgagggccatcaggagtgtataggacagtcccagccaatccctggtctggaagtccctgaggggcaccagccttgtgtcctttgattctaagacgtcagggttcctgaagcaggttcccctctctttgaaggggagaattcccaggtccgtttgggggagggggggggtcatactttcctgtgcttgattaaaactgcttcttcttcttcttaaaaaaaagcttttaattatggaaatgacagctcatatataagaaagatgcatataaataaggctctttataaacttaaaagttttggacattctcccaattttatttcatctttttctattgcttctccccccttcatgcccccctcccccatggaggcggcaggggcagaagacatacactgtggctggagtgtcttccaatcaaatcctggtgccacgttgtttcgtggacccgtcaatgtgtctctgacagagtagtgccaatgttaaccttaatttcttcatttagtgtgatgcccctccttgccctggtccattaggacctctgagggcaaaggaagctgcttcttcattttccccttctaagggggaatgcggatcagagagagagacacacagaagaaagaggaacccagccttagagagccagacccaacaggcggcccttgactagtccgcctctcgaaactgttcttgaccatcttcgagtgcaattcatgggtcgtcaccttgagcaatcaactgtgctaagtgtctgtgtcatgtaagagttcctttcatgacccctttctaggatccgggttagccatgtgctaaatgacacgcatatgaaattctcacttccatcaagccgcaaagaaatgaaagacgtttgcatccagtttgacggtgggacctgctcgtctgcaggggctctgtcctacattgctctgccacattgttccctgatagttcctgccaccacctggatcaggtactgtctggatccacagagggcttctcttcttccggtgaagggtgatgtacataagatcatggcgatggtagttgcacctaaattttcctcttggtgttcctcctaggaattatttctagaaaactgctcctgtctgaccacaaggactgtgagcatagcctgtttttatttcaccatggctactaggaaactcacagctcaaacgttttgttcaaccacaatgactgttcttagcccaggttgctgtggccttctgtgtcacctgccttccccattcgtgatgtaagactccccactcacaggtttcacttgctaacttttagactcagctgctttgaatgctttgggggaaatactggagcctgcgtggagcctctacatttcaaaggtcctgtttgagggttaaaaaactccaaaataaactctttgagatgaatacaatatattaatggggaaaaatgtctctctctagtcaaatttaaattcacatttaggttctggtgtataaccccaacgagattttcttcatctcacacgaagttaacttttcacgtacctttcgagataaaaccacagacaaagcaatgagggaaaataaattggaaggaaaaagagacaaaacatctcctgtactcttacttgagatgaccttgggaagcagctgggtttgctcaactgtgataatagaagtcagaccggacagcttagacagccgaaatgggagttcctccaggttgtacgtctccgaggtgggaggaagtttagccccttgcaaggcagcgtcttgcagagttttcaggcagctgtctctcccctgtccctccatctaagactgtgccctaagctttttcagaatgccatcagtcactccagtgaatgccctgaatttccattacctctttaatgaccttaatctcaggtatggtttagtggtaaaatactgcctagcatttgcctattccccacctccacccccaatctctctatcttcagccttcttctgagtcagggcttccccatgcaaactttgcagcccattggagtggcatagggaagactgagatttcaaaagcaaggctcttacctgcaaccctccgctctgagattaagtatgccctatgtataagtagtaacccggatgtggcactcaccacatagtcatggtatagctgctgacctggttaaaccttacaaaaactctgagaacccaacggtgggttgtccctttggcaggggtgaaccaaggcacggctgcagttcaagcaatatacgtagctccctgagagctgggcccaggatgcgtggtttctaccacaatactctgcttcctcctcatcaaatggctgcctgtcaccatgattgtgctgagcccctgagtctcagtgctcctcatccttgagcaagaaggaggaggtgccaccatctggaatcaggagaagatgtttgggttggttttcttaaaattgaggcagattgtcaagtggccatacagtgtctggggtggacctgccaccccagaacaagtgtctggtgacccatgagaataaccagagctgtaggcagctgtttctttcacactgggtgaccactccgatgttatctggtgacaccttgagactaggtgaaatcactgtttggttttggtgagatttgtgtaccttccccgtacactgaaatcccatatcttaaacaagaatacaaacttctaaggtcactcgccattttagcttgtccacctatcgtgtgttccctgtttccctctaaataaataaactataaataaaatataattggtgggttagagggtttggtcgtggaaattgtgagagcgggtcatcttctcatagattaaactgtaatcaaatgagatttttgtcccgtgaaatgcttccaaggtacagcagatgatctggttatgtgtggcgaaagaccacaagaaagctccgattctattaaagaatttgggcactttcccagaactgaaacggggctgacctgtatttttttatatgtatgtcttagaaaccatgagtctgcagccagtaccatttaaagacttctaaaattatcaacgtcttttaaattgaaattggttccttgtctcccaaatatgaccgagcttaacattaattgtgaatcagttaatagtttagtttgaaatcgtgaacgccggtggctcacccttgcccttcgatcccttgcagcggtgggcaaaacataaccatcatgggcagaaattttgacgtcatcgacaacctcatcatttcacacgagctgaagggaaacgcaaatgtgaacataaatgtaagttatactaaactgggggggggggggctggaggaagggtatgttttcatttctacgacttcggcattataaacttttgctttcatgtgatctatactgtctctgctgtgacggaaagatctcattcttggagttatttggggttgccgcatagaggaaccagaaaagaatttcatgtgttaagacctgccacgttctcctcgtgcgacgcatgtagcacgttgctttaatcagataacacttctgaataggtgtgaaagtcgttgtggatggttggggtgctatgtacagagcctgtgacaagtatgtggtccaacagcaccaagggaggtcggggacctgctgaagtaacattccttctcttgtcattgtctcttggtcctgtggccactgtcttccgcccctcccccactatgcttccccatccccagactgtgggaattgtctggtccccctaagggtttagttctctgagaagagccttgacgttctcacaggaaccttcagggtgaagccatgggtgtctgtgaggaggggctaggtacactgttgcttatataggtgcttcttgaatgttcttccgtttccttcctccttttctctagtgtaaagggaacagccattctgggcctcaacctgaccacttcctgccaaagccagcagtgctgagggtggccaaacactttgtcctacttgcaaccagtaggtgttcacgcctggaaacgagtgtagcgatccatctttcttacggccttgtcctagacacatgcccatccacttctggcacacttcctggccagttcccagcctcacactgagtctgattctggccattttcccgtgatggaagcctgttcagttgtgtagtggcccttggcctgagggacagcctgagccaggagacctggaaacacggtctctttcccagaacatgtcccatttattgagcacctactatatgcaaaaccatttttttttctggctgcaagaacaaagagtaaatgagcttctgcccccacaacacccaaccccaccttcatgaagggagatggcagacctgcactggcattggacactggcagcatcgttggtgacaagtgccgggtcctcccgctccttccatctctcatgagtccaagaagccatgatgtgtttcccagggaaagcatgagtgggtagggctgagactaagctaatggagttcagtggaaaagactagaccagcaagcaggtaaggaagcagggagttgattgcagagcacagaagagggtattcacctattctagacctattctagactaaaacaccactcacgtttgctttgttggaaccttagaggctgggttgggatgggtgatagagatggctgaataccatacagggccacgcaagggagaatcatcccccaatacggctctacatttccgagacagctccccatcacccctggctctgtaggcaatgggggcaggaaggtcttgggggtctttggcaaggagtggcatgagggtcattttatccacggtgcctaaggtagtttggagaggatagttaatgaggatgcttcaggcatggctgggacaggtctaagtgtgactgagacaccaccagatagatgcctgtggagctctctgctggaatgccatctgcagggtaggtctagagggctggtgatggtgaggctagccatttcagcatccctgtggatggagatgggggtggggggtggctgtgtagaagagaaagcaccaaggatgaagaaagcatgtctagaatctgctcgaagcttttcttcaggggtgagggtgggagagtcaaagaaaatagaatgaccagagacggtcaccgagaagctgtctttaaaataagggttgctccccacacaaacaggctcagtcttaggggtaaggagcgagggagaccctgttgctggtttttcttttaggacgttggtgttaaggaagtaggtattgtggtccagtgggttttcaccctatcgcagaagtgctaaggcaggaatttcagaatgtgttcaggataaagaatggtgttcttactccaatgtggccacctagatcctctgtccacccatccttagctccaaggttacagaaaacaaagagagggaatgctgctcccagcttgcttgagtattaatcccttctccctcccagtctctctcccttcctctttatcttacaatgttaaggaccgaacccagggccgtgagcatactagggaagccctctgccactgagccccagccccggcacaccctcccttaagtatctgccaacctgtccttacattgtctgcaaggtttcccctgcctgtctcgctgcgcccttgaacatggccgtgtagttatgggttttctttgtaaataaacctgttcacaaattgggtcaggctttctgcctccgtcccgtttgcacacccctcatgtcttaggggacctgttgctgttcttaagcttgtcattttctgctctttactgttgtgcctgaaaagctgcttcctcttgcggtggttagggacttctcagagggaacctctgccgtagcttccccaacttagggactctcttgctaaccttctgcagaggctcttttgacacacagtgactcaaccaggtaccaagttagaagctggcctcagctctcaactcccttcctaaagtttccgggactcagccatgcagacttgaaaggtacctgagagctttgagccaagccttcccctttcccagcctgcttctctttgcagagccaccctgtgctccccatgccatcacccgacaggttctctgaatgccagttgtgtcagtgatgctctgcatagaggatgctcgcatgtgcagaatacttcctgtgtgcccgtcagaccctaagtactttacagatataatctcattcacagtggccaacatttaattgaatgaattttttttttttaatctctgctcatttnnnnnnnnnnnnnnnnnnnnatcgacaaagctgatactgcaagcccaagcataattccaaccagaatagcaggcagagccatgcctgtgcttgttggaacggcaaagcaccgaacacaccattgtctataatcctaatgagccttgatagcttttgttctagctgtgcatttataccatagcatctgcaagccacatctccagatccactgatgactgagctgtcactctctctctctctctctctctgaacgcagaggtgacatgtctaagcagaaacccaaaacaccagcctcttaggcacaagcagggcgggcagcacaagcctctgtcggcagcccaataatctagggtttgagagtggcgtccgccagcctggctgtctttttctgcagcaggtcaccgtttcctagatgtgcccaaggatcctctgagaagagaaacatacagggtagtgtttactctgtccagcgtaagcggctctgtaaagtctattaaaaaaaataataatactctgcgagtcaggggacgcggctcagtggtagagtgcttgcctgtggtgcccaaggctccaggcttaatctccagcattataagaaaaagaagagcaaccattttctttgtagtaaaaaataattggctaaaagacaagagagaacatttgtactgggaggcagaagtgagagtgtgcttgagtcccagctgtggctctaggtaggacatctggctttcgcccccccccccccccccgaccctttcattgtttatcattttggcaagagaggtagtaagtagccatcacgaaatgagcaaccccaggaacctgctcgaggtgctagctgggtgtggcacatccaggcatccttccatttgctgcaaagttcccaagcacccgcactgggattcaaacccggcagagcagaaagcaggcagaaacagctgccttgctggagagtcccagtgagggcatgcagtgaggaataatctttagggaggactatacgaagggggaggagaaagtagactacctagggatgtctttgcacctgatggtggaaaagtttgcctggagaggcgacattggaatgtgggcctccgggaggaggagaaggaagagaaggagccacggacagacagagggaagcacaggctccgagtgtcctgaggcagaaacctgccggctaggtctggcctgaatggggtgggtcagcatggttggagtgaggggccattcccaggaggttagagagttgatggggagggccagagattattagggcctttaaggcattgctagaggcctgtgcttttgattctaggcagctgctagagagagaatgagaacagagatggtgtgagctgccgtcctataggagagagaccgttggcctttacctacccataggccctttcaacatccatgtcagagatgacagaatgaggctgggtgcagactaacttaagatcctgcaaggaaagaaaagctggactaagacctgccatcaccgcaaccatctcgcttggtgcttccatggggctcaggttcatggggcagctcaggttccagggagccgcaggtgccttggcacttgtgtgtgtgaagatgaagaagggacagatgtagcatttttcttccttttcaagtttaattgccaagtttttcttagcccctgacccttcaacctcccccctctccccaaaaggcagaaaacagaaacgaccttcagggatcatctggtggtcagctttgccaaactaattttcacctgagaaagtgacagtcaaaaccttcctgactggaagcatcagtgtaggagaaagcgaagtgtaattgcacctgtagagaacggctaggagccttctgcctcagtgtgagcccaccgctgcactagtaaggttcaggacaaagagggctagtatttaaaacccacaggtctagtccggcacacctagagatcccacccgccccaccacgtctacatctcggggaagctgacagcgcgcatgcgtatggtgcctggcgccactgggtctaacagtaccaatctgtcccatcaggtcaagctgggaaacctggaactctatgtggaacaggaatcagttccttccacgtggtattttctaatcgcgcttccaatcttgctggccattgtcatcgttggtaagtggcccgttccattttgcccgagacgttattccccaaggcttctccgtgggcaggtagaccttcagcttttgggaactctctgtttccattaaatattaatggatgaaaggccaagccagagagttgagaagtgaataacaggtggtctgtggcttctctaatgagtttttacggtgcttcactaacaaagagcgagattgcaagatggtcccttgatgtttgagaagtattgcgcagataccccacgtctttgggattgttttggaaacaagtccattaaggactcccagaacgtggtcatcctatctcatccttggcttctccccaccccctgccctgcttttcctgggaaagtcaggctttgcacgtgtgtctatgttatctattccaacatgccctgcttcctatggacatggaagtaccatactgactaccagtgggcaaatctgacctatttcttggatcctacggtaccgttttggtttggttttgttttaactgaagaagttgacatctaaaaattaggtaactcaccctttaaattcgtgttgaggggggccagagagatgactcaccagtgaagagatgctcttccagaggtcttgagttcagttcccagcagccagatggttccccacatctgcagtgaatctgattttctcctctgctgtacatgaagagagagtgctcgtatatgttaaataaatacatcctgtagtctgtatggacagtgtgaaaggtctaaactctaaggtcccagttttagcttgcattcgttgttagagcttggcaattgctactccttgaagacagggtgttcgccctctgggttttcaccatagtctctccatcccctaaggtctccacccacctctatagctggtgcctgcagctattttatgtccttttcattctttttcttcttcttctttatcaacagcacaccatgtttgttgattaactacaacatggcccctttctgacactgtagggcatggaggcaagggtcggcattgctgtgctgtgtgtcttcgcacccccttcttactctcgtttccaaatctgttttccttgtttcttcgtttgtttttttactgagcattggataagatgtgggtgactgggtctgtccctactttgagagttgacttaaggactagtgctttctttgggcagttgacactcctgggacgggagatatacatttgtgaagaattggctccatgaaatgaattttcctatgttgcctcatcggtgattatttggggtatttttttatgctttccccaagttgtctacctccgtcatatatctacaatttaaaatttgacttgacattttcataaattcctggctgatatgggcttcaagaagattgcttgtataaatgctgagctctgatttgagtatcaactgctgtcagacgtgttcagatctctcagcctcgccacatagtcatgtccactttgtgactcccgagaaacctctggtctcttgttaactttgtaagaagtcattttgtcctttaaggtgatttgtttgaatctgcaggacctctcaaaaccatcccgttgtgactcattctagggaggcatgtgtcacggcagctatggtaaatgtgacctagtccttcactcatgtccttagtgtaaatgctagatgcacctagcctgagcctgccaacaacagagccaggaaaccaaccctgctgtgtggatgctgcagctccctttacattctgagtcagggtagcttcctggggagccactgccccaaatgaaaaaaaaggggttctctggttgggtgagtttgaaaatcagctcttggaaatgctcagtcccggttattgtaagtacagctgagatggtgaaaaagtctagggatgacttctgtgtaattgtgttgaacagtgtttgttttctctctgtgtctatgtctctgtctgtctgtctgtctgtctgtctgtgtctctctctctctctctgtgtgtgtgtgtgtggtgacatacataggggtgcccaaataccataggactcgtataacagaggaaaaatttgtctgtgtgtgtgttgtgcccgaataccactgcagacatggaactggcagaggataacttcatgttgctgctcttcaccttccaccttgtttgagacagtgtttcttgtctgtaccctgcatacactggggtagctagccttaggattcctggggcatctcttgtctccgcctcccatcttgctgtgggtgtgtctggctttacgtgggtccctcagatcctcctatttggatggcaaacacttttcccccaaccccttttgtgtagtatctgttaaaagttgagatccttctgggatcatatgagagctggcaatcgtttgttcctcgggtcgatgtgattccttgatttactgcctgtaatctcttctacatcacagctcttatggataaggcaggcaggcaggcacagagatgctaagggatttgctcagggtcacacaggtagtaaatgaaacgacagagcggagatataaacccaagctccaggattcgttgcactgactactcaaacagcatggttcagagcaaggtgatgtggacacagaggccaccagctatgggggctctccatgacttgcctgttacatcaccccttcttaaacggtgcaagttaggctcctgctgcgaggagggatctgcagcaaggacacatctgtgttttccttcggtatttgcaacgctgtttcgtttctccagatatgattagagatgtggggaaaagaatgaaccatccacaaatccagtggctggcttcagggaaaaacttggcctgcttccttactttccagccagctgggacctttggttccaagtgaaggttatttgattgtgttttcactttaagatgagtggaattttttccccctgttacatttaacaccttcctctttagaatgacctttaatgggggagctggagagatggctcagcagttaagagcactgactgctcttctgaaggtcctgagttcaaatcccagcaaccacatggtggctcacaaccatctgtaatgagatctgactccctcttctggtgcatttgaagacagctacagtgtacttatgtataataataactaaatctttttttaaaaaaatgacctttatggaaatggccctttaataagaatccagcttttgtttttttttcattttgttttttgtggcattgaggttggaacccaatctcaatggaacatgctaggtcagtgctctgacaccacacagaccccccccccccataaagtttttacatgctcttttctatgcataattctccctctatctctcctccctgtttctctccccccacccccacccccacccccattttcatttctgtgttactgcaccaacctgacccagagtctctgtcccctcagtggctgtggtggtgacgaggtacaaatccaaggagctcagtcgaaagcagagccaacagctggagctgctggagagcgaactccggaaggagatccgcgacggtaggctctgagactccgcgtgcgcgtagcaaaacaagccctgctcacttttattttaatttttgcccttatgtggaaactgccacataatgagaactgattgtgtagtagaagacaagctgagcagcagggcctgggcctgggcctggctttgtgttctatttcggctcttctctgcagccaaccaagtaattatctattgtttcttctttaatgaaaaccaaggtcacactctgtgttagacaaaacagcagaggatcttatccattgtttgcagagttaaaatattgctcttgggattctgtgttgcaggctttgccgagctccagatggataagttggatgtggttgatagctttggaacagtacccttccttgactacaaacatttcgctctgagaactttcttccctgaggtaaaagaacactgatcatcatcctcaggctgagccttgaataataatgcgacatcttgccttaagtccgggccgagcagggaagaggataattattaattgcattgattagggtagagggcagcaacaggctactggcaattactctttccctggtaaggagtacaagtttagagtgatgggttttgccatatatatatatatatatatattttactaccagcttcaaactgactccgtagctgggaagtgagctaattcattttaaaatcaataaattgtgggctcgccaatttgttgtgtttatctgcctgacttgcactgctgctcctagattattcgctattatttctccattggaaacgaaaggcaggatcagccaaatgggggagaaattggacacgcagggaatctgagttgatggcaggcagttttagccacgtgaagggtttatggtctcttctttgacagtttttctgttagtagatcactttgcttgttcaatagatataggtgtctggaatgagatgtgagtggttctagcgcttcaagtgtacagagagccctttgggttggggtgggtctcaattctgttctgacacccccatttcctcacacattcttcagttaccttcccccccacccccaccccaagcctttgacaagaacactcacccattctgtctcaccacgctatacctcagctctgccatattgctctgctggtctcagagagatgccctctgaattagagctcattagtccctcccatattcagatctgggccagtcagcaaagttagaaatctcttcaaaccttgactgtttttggccagaagcctaagaacataggcacatgtggttggcaatttctagtgtctctacaagtcttgcaatggatatatat

SEQ ID NO: 1436 - DNA, 2407 bp, Mus musculus
atggaggtctcccggagaagacgccgccgcgccccccgtaccccgccgcaccgttgcccctgatcgcctatctgctggcgctggcagcgcccgcccggggcgcggacgagccggtgtggcgatctgagcaagccatcggagccatcgcggcgagccgggcggacggcgtgttcgtggcgagcggcagctgcctggaccagctggactacagcctgaagaacaggctctctcgcctataccgggaccaagcgggcaactgcacggagcccgtctcgttggcgccccccgcgcggccccggcccgggagcagcttcagcaagctactgctgccctaccgcgagggggcgaccggcctcgaggggctgctgctcaccggctggaccttcgaccggggcgcctgcgaggtgcggcccctgggcaacctgaaccgcagctccctgcgcaacggcaccgaggtggtgtcatgtcacccgcagggttcgacggctggtgtggtgtaccgcgcgagtggcaccgacctctggtacctggcggtggccgccacctatgtgctgccggagccggagaccgcgaaccgctgcaaccccgcagcatccgatcgcgacacggctatcgcgctcaagaacacggaggggcgcagtctggccacgcaggagctgggccgcctgaaactgcgcggtagtgcgggcagcctgcacttcgtggacgcctttctctggaacggcagtgtctacttcccctactatccctacaactacacgagtggcgctgccaccggctggcccagcatggcgcgcatcgcgcagagcacagaggtgctgttccagggccaggctgccctcgactgcgaccacggccaccctgagggccgccgcctactgctttcctccagcctggtggaggctgtggacatctgggccggcgtgttcagcgcggccactggagagggccaggagaggcgctcccccgccaccacggctctctgcctcttcaggatgagtgagatccaggcgcacgccaggagctgcagctgggactttcaagcgactgagcacaactgcaaagaaggggatcggcctgaacgggtccagccaattgcatcgtctacactgatccactctgacctgacgtctgtttatggcaccgtggtgatgaacaggactgttctgttcttggggaccggagatggccagttactgaaggttgttcttggtgagaatttgacttcaaactgtccagaggttatttatgaaattaaagaagaaacgcctgtgttctacaagctcgttcctcatcccatgaagaacatctacatctacctaacagctgggaaggaggtgagaagaattcctgttgcaaactgcagtaaacggaaatcctgttcagagtgcttagcagcggcagacccccactgtggctggtgcctcccgttacaaaggtgcacttttcaaggggattgcacacatgctgggagctttgaaaactggctggatatttcatcaggacctaaaaaatgcccgaaaattcagatacttcgaagcctccgagagagaaccacagtgaccattgtgggaagcatctccgcaagacactcggagtgcgtggtgaagaacgcagacacgggcaagctgctctgccaggggagaagccaactgaactggacctgtgcctgcaatatccccagcagacccagctataatgtcttagttgtcaatgcgaccttctcctttccgtcttggaacttatcagaaagattcaacttcaccaactgtgcgtcattaaaagaatgcccggcgtgtatcagaagcggctgtgcttggtgtaaacgggacaagaaatgcatccaccccttcaccccctgcgaaccatcagactatgagaggaatcaggagctctgtcaagttgctgtggagaagtcgcccaaggactcaggaggaggaagagtcaaggagagcaagagaaacagaactgacggggctgtgcaggtcttctacattaaggccattgagccacaaaaaatatcaaccttagggaaaagcaatgtgattgttactggagcaaacttcacccaggcgtcaaatatcaccatgatcctgcgaggaaccagtacctgcgagagggatgtgatccgggttagccatgtgctaaatgacacgcatatgaaattctcacttccatcaagccgcaaagaaatgaaagacgtttgcatccagtttgacggtgggacctgctcgtctgcaggggctctgtcctacattgctctgccacattgttccctgatagttcctgccaccacctggatcagcggtgggcaaaacataaccatcatgggcagaaattttgacgtcatcgacaacctcatcatttcacacgagctgaagggaaacgcaaatgtgaacataaatgt

SEQ ID NO: 1437 - protein, 802 aa, Mus musculus
  VARIANT (1)...(802): Xaa = Any Amino Acid
GGLPEKTPPRPPYPAAPLPLIAYLLALAAPARGADEPVWRSEQAIGAIAASRADGVFVASGSCLDQLDYSLKNRLSRLYRDQAGNCTEPVSLAPPARPRPGSSFSKLLLPYREGATGLEGLLLTGWTFDRGACEVRPLGNLNRSSLRNGTEVVSCHPQGSTAGVVYRASGTDLWYLAVAATYVLPEPETANRCNPAASDRDTAIALKNTEGRSLATQELGRLKLRGSAGSLHFVDAFLWNGSVYFPYYPYNYTSGAATGWPSMARIAQSTEVLFQGQAALDCDHGHPEGRRLLLSSSLVEAVDIWAGVFSAATGEGQERRSPATTALCLFRMSEIQAHARSCSWDFQATEHNCKEGDRPERVQPIASSTLIHSDLTSVYGTVVMNRTVLFLGTGDGQLLKVVLGENLTSNCPEVIYEIKEETPVFYKLVPHPMKNIYIYLTAGKEVRRIPVANCSKRKSCSECLAAADPHCGWCLPLQRCTFQGDCTHAGSFENWLDISSGPKKCPKIQILRSLRERTTVTIVGSISARHSECVVKNADTGKLLCQGRSQLNWTCACNIPSRPSYNVLVVNATFSFPSWNLSERFNFTNCASLKECPACIRSGCAWCKRDKKCIHPFTPCEPSDYERNQELCQVAVEKSPKDSGGGRVKESKRNRTDGAVQVFYIKAIEPQKISTLGKSNVIVTGANFTQASNITMILRGTSTCERDVIRVSHVLNDTHMKFSLPSSRKEMKDVCIQFDGGTCSSAGALSYIALPHCSLIVPATTWISGGQNITIMGRNFDVIDNLIISHELKGNANVNINX

SEQ ID NO: 1438 - DNA, 177587 bp, Homo sapiens
  misc_feature (1)...(177587): n = A,T,C or G
ggacttccagcatccagatctgtgaggaaatacactgccacccagtctgtgatactttgttatggcagtcctagcaaactcctaatactaatagtgctcctaacacagcactagagtcctgataataataatggtaatcataataataacgttttttatttatggagcgacttcctgtgtgccaggcattgtgctaaatgctttacacatattatctcatttaatacgcatgaaaatcccatgtgatggatgcaatttttccaacccacgatgaggatgctgagggtcagagagcccaagcctacgtagttattgagtggtgggactgggtctggaacctaggcctgactgggatcactgctggcctacagtgtctttgtacaaagaaaaaggtgccacttcctttgggaacacccagccccaagccagggtgcaaggtttggtaaacagaagacaggctgggttttaattcctctttcctccttggctgggtgcccttgtgcaaacctaagcctctcagggtggcccacactgaggcccaagctcttaatcattacaccggactgctcagtgggccagggtggctgggggtaacaccattgccaccgtcgaggtaggatcagttgggcacgtaagggactgtgagtgctggcaaggcaaaccttacctccctcatggctgggaatgagatacgtgggagcccaggtccatgagttctgggacccatgtgggtgggcttccaacggtcctacaggacaacgacaaatggcccttgacttagggcaattctgcttatttctaattggccccagaacagttctgtgtccagtcctcagtcagcaagaaatccagtttgccaggatcgtgcccctaggattacacagctgtcctttcgccattatccccatgcctcctcctcctcccaccaaatcaaagagaatgagaaatgcatcttcgaccatttggctataactataagtgtgcctgtcctcacaattaaagctcctgaaagttccaaatttgctgctttcacggtgggaaaaaaaggcctccgacagcgtaaatatttaatcaccattaagaatgtccaataaatgaggggaatcaggtttcaaattgactggttcagatgattaaagtacagaagtcatagcagggtaaaaataaagtaccctctaaaaaagtagcatcttgtgggcaggggcaagatggaagatagcacgttgggacctctcaaggccgggccgggcactgcactctccaggcagggccgggcgagtgcggcaaccaccgtcactctccaaaggcttccgtgccccctggggcagctgagcggggtaatgccctccgtgatggagagcgcgtgtcccacagccgggccaagacggtgcccaaccgcagatagccccactctgaggatgacagcagcgaggaggagcactcgcacgacagcatggtccgcgttggaaccaattaccaggccataattccggagtgcaagcctgagagcctcgcacgctacagcaacaagaagctgaagggggtgctggtgtggtcacccaaccactgtgtgtcagatgccaaacttgacaagtatattgtgatggccacggagaagcatggctacaacattgagcagacgctgggcatgctctggaataagcaccatgtggagaagtcgctggctgacctggccaacttcaccccattccctgaggagtggacagtagaggacaaggtgctgttggaacaggcctttggcttccacgacaagtgtggatccaacagacgctgcccgacaagttgatttccagcctggtgaaatatcactactcttggaagaaaacccacagccgaactagcatgacggacagacaggcccggcggctgaggggctgcaaggacaaagaagacagtgatgagttcgaagagagtcgaggaggcctgagtgaaggagagcccgatgctggacacccgaagagagaggtacagagcataaagcagaggaacagcagcctgcgccaagccctggagggcgccattgatccactccgcgctctggaggccaacactaagttcaactcctgctggaccacagaggagcagcttttggctgcctaagccatccggaggtatggcagactttggggctattgcagaggtgattgggaacaagactctgacccaggtgaagaccttctttgtgagctattggcactgcttcaatctggaggaggtgctgcaggaatgggaggctgagcaggatggggcccgtggagccacagtccccgtggaggaggctaggagaggggctcccttgctagccccagcccaagaagaagatcatgaggtccagattacatcgatctccatgtctgtgtcccgatcggtgcccccctgcaccacccccgttccacctcccacctccctgccctaggtgccccctgctgctgaggccacctttgcccacggctcccactctgctctgacagccacccacagtgcagcagggccgcttcctccagccctggttggcccccaaccagcgcccaccacctctcatcctccccgctctggctgcctgtcctggccctccgcccctacccaccctgattggagcccccagtgccctcactctgaatcctgaggtcctccaccaaccacaggctccaggacctctttgctggccatccccaggcatctctggtgtcactgaggacggaaggggctagggctcttgccaggtctttccaagacccagagctgccgacagcccagcctggacctgtgggttctgcatgtgttcctggcagctgggcctgtctcttggggccatggcccgggctcaggggcctttgagctggactgagggcactttcgcttccttgctgggactggaatggctgcctcctagttggctggggcttggtctctgggccctgccctttgtgtgtcgggggtagggaccttagcgtgggggtgggacaggacagttgggtgtgctggctgttctcattcctcttcccttcttttagcaatcagtcttgggtgaggtgggaagggaggctgcagggggaggtggcagaggggccttacagcagcagaggctggaagggaagttctgtcttcaggggccagctgggaaacactaaggagctgagggtgcccaccaggcccaccttccagaagcttggagaaatgtgggttgggaacttatgcagacatggatttacttttcaacatgttttaaaagttaaaaaagaaaaaccttctaaaaaaaaaagtagcatctttagagggttcctgtctctactacataggtttccttgagtataaaggaaccaaaaacatccaagttatctcttcattattagtagggggcgacatagggtgaggtctggagatgaggaagtatagcaatctcttaataatcctgctttggtaataatgaatatcaatggaatttctcaactttattgaagggacagctggagttcagacttaaggagaaatgtcttaaaaggaaaaagcggcatgcttggttttgtatcttgtttgaaaatatatttcaaacgttcagcagaattttagagatcataaccaccctctgcccccaccaccttctgaacccttagtccccagtagttctgatttacttttaagattcttttagttttatgttttaactgaaaaaaaaaaaaatcctgcccagccaggtttccatctgtctgtatcaccgggttgaatttagtgtaggaaagcctgtgcaaagggaataaaaatgtagctttttttccattgccagattcaggggaaccaaccatttggaaacaaaggagttccattttgactagcagcctttctgctttccatcagtggacaaagtgaatgtacaggtttaaacatcatttggggtcacctctagatccatgtttggaggtagattggtttgttagttatgattctggcaggaaacaggtgacacatgcaaacagatacattaattgagggaccatggccgagccatgccaggatgaagggagaccagcagaggctagccacagcgacaaccatggaatcccacaggcctgaggaggagggtgagggagtggttactgggtccacgaaaggctgtggctacagtgtagctgtgagagaggacagcccacaggagctgtggccttgtagagggacacagccatggccaatgcatagatcagcagagagggagctgggagaataaatattcaaacttcaccctagctgtccacccctagatctctggctggggcttcccattggctgaatccaacgagaagccaaaaggcaagggtgatgtccataaatgtcaaacttctgggtctcaagcaaaagggggagcagtggggaaatggtctgcagggagaagaagagactattcaacacagacggggaagaagaactaaataggaaggactagggaaggggtgaaagagattgcggtgatggtttcaagggtgtagacttatctccaagcacaacatgttgtatataataaataggtatggatttttgtatgacagtcatacttcaatgaaggctttgtaaaaaaaaaaaaaaataggggcaggagagcgaggcaaacactcggtcttccatgaactttgcatttgggattctgtgcgtggggatgagtgcctgagagatgctgtttggactgccatattcccagggcttccccaggatgggtgatgagtggggctgcccccaccctggggccatacgccaaactgcccgaccgcaagagcccatgctcagagctgatattggttgcttcctcccgaccttggtggggctattttctagggagtggcaaggacataagaatgagaagccacaccagcttggtggagagcactagagggctcactgcgaagtccagcaactttattgtcagctcagagcatctccccaccagaatctcaaggaagcggaagtacaagtggctgtgaagttatctgcgtgtttatcttatcttctgctattcatttcaagagttggagttattattaataagaaggcctggtttctggcagctcttctcttagaatgggtttatgccaagctgccagttatcagaggattcagagcctaggattatgctgacagcgagtctcagagctgtgatgggagggcaaagacacgggaaacaacgttgtattaaagaggaatcagcgttttgtgtctagtccttgatgcccttttggcttcctatttccgaagaacagcaaggaaaatacaaggagagacagactggaatcctgtgaatatcagagaaaagcttgattttcaagagactgctcaagttacagagattccccaaatctgaagaagtaattaactgatgagttcgcatacttcatgcagggtgaactccagccggtctagaaaaacactgtgatggttgatgatttaccatactttgctttcaaccagtaattgtctcagattcttaaccactgatggttttggtgaatgttttggagaaaaggctcgagagaaacttcatgacactaaacatactctctgagaagtgtggtgctagaatgctaaggtgatgtcctagacttcgcagtctcttaaacatatctgacattatattatgctatggcatgctatgctatgctatgctatgctatgctatgctatgctatgctatgctatgctatgctatgctatgttatgtctttttaggcaatagctcatccctccctaaagcagagtgaatgctcttatttagcttaaagacagtcattggactttgagtaaagagtcattttcttgtacgttccactccaccctccagtgtacatttgcactctgctggcgaatgaccatgagctattaaatcatgacatagaaaaagatgacaactgtaatgttgggagtgacccccaagtcccacctactgaaggaacaccacaagccttcctcactttaaaccatggcatgggggcactatcaccaagcataagaatgcccagcaatcgtctggggccatgttgggtgggcagagaggatgaggcactgagttccttcagccacgtcttaactgtgccatgtcagagagacttttcatgttgattgaactgtgtccaactcatctctcagcaccaatgcgaacttattaaacagctcttcctctaatcttttttcaaccatctactcatcagcagactagaaagaagactggctcatttctttttcctgtcagccaccaaaagggcctgggagctttgataagggcctcgatgtggaagaccacatagatatcagcaaaactgtggaggaagaagtggtctgcttaaaacctaagaggacaatacaggtactattccacccactgggtggtatttccaaattctgcacagggggttgtagctatgtagatgaggcttagagagaattcactgaccaccagaacaaatattctcagttgctttcaatctctgccagccaagtcatgctacagaccactgtcagatgaaaaaaaaaaaaaaaaagaaagaaaatcagaaagaaaactgaagcaccaatgatagccatcttgtgactgtgaccaattgcctactgaacagttcttaatgtcctgggccccagcaggaaaccactgaatctataaagtcctgtccaccagaaatgagtctgattgtggatggcctggttaacccagattgccttcggtgcctgagggacttgatattttctcattatgaagactttcccatctagtgaacgctgcaaataaaactgctcagaatcggtctgaactgcctgtttccgtggtagcaggcctctgtctggaggataaatctgcaccatcttcttttttttttttttttttttgggtttcagccagttgtgttacaaggagttccgaaatgtgctataagtgacacccaacaagatgggctcggccagttggagagggaagctttgtcaccaaagggacttgcacccctgggccagacggtggtgtccaagagaaagtgatcaaagagatacagaacccgcatgcctaaatatttatttcagttgttcgtatttcccacacttttcaaatgtgaacttgtgtcctgaaggtggagctttagtacacaagaaaattgggaaggggcaaacatgtttgtacaaaatgggggtagaatcagcaaagaatgcatttatatgcttcctcgtcgcctacgtttttcatgccaaaaagttagcacagattctgatttctttcaccgtaggagtctgcatacaattaaatgggaggcaaaagaagcccactcttaagagtggggcttatggtcccagtagaatggcagggaactgtagccatcaaagccatttatacttcttgtgggtagtatttttaagatgttgtttctttttcaaaatgaagcagcaatgaactgagtagtgatcaaaatgccgcaccacagagtatgtttaatccaaatagctcccaagatggtctgtgactgattgtaccaactctacgggacttagagaaatgacttggttaccagtgaagtaaaactatctctggaatggaattgaactgttgcttctcagcacatagcgacactgccaccgctggttcacggagccagtgaaggtcactgagttctgcatcagtcacagggaaaactgtcaaaacaccagcgcataaatcccctactatgctgtggagggggtctctgagcttcggatgaggtttttaaaatattgatcttcccacttccagaggtgcaaaaattctgaaagcattccaggagggcagggagtgggggagcaaggccagatattttggagcaggtgaaacatctgacttgtcttgcctgagatgtcccgattaacaccaactgggtactttaggcctttccccttcttcctcccctctccttatggacactccaacaccatcatcacagcacaaagggcaacctcatatctcgtgggaaggcattttctgcctcctgccaggcaaagataatgttatccaattgcaaatgaaaggcttatgaatgaaaagatgaccactctgactttagtgtatgagagccactgctgaaatgataggatccttgaacttcacatctagagcagaaactcacacttctcttcttctccctccacctcacccttctttccttaagccttccagaactcctgccatatccctcagcactggggagaacttgaagcactgttggagaagtttgaaacctgcaaccttcggcaggactcagcatgggacaaaagccacctcattcctttcccttcccaaaacagcatctcgagctggggaacttggagggaaggaagaaaggggatagcagccaattgccctccctggggcctggggtctggaaatagcctgggaaggaacagagatcatttcccaacgatccatagaggtcctcagcaccctccactcctatgcaccccctggctcatctgccagactgtaagggtgctgatggtgcccgcagctgccccgggaagctgggaggcatttgtgcatcctctgggaagccccattccgagaaatcatgaacctattccccagtgggcaatgattccctgtgcttcagaaattcttggcggctgtgggggcaacccagctgttattcaccctctgggtgaggtggtgagacctcagggggtccaaaggataaaagtgggtaatgatgagacagatggagagcctcgagggaaatacggggacttgggtctaatagtagaaagcagggcgggggctggttggtgcatttaacttgaggaacttttcagtctcactacagagaatgatctctgggggattatggcaatggccacaggtggcacttaactagagccaggtatgtaagaggccctggggctagatatggattcgaatctcggctctgatatctaccagcagtagaatgccagcacgttccacaacctttctataaccattctcctggactactaagtagggatgacaataacagtcactaattaatagggctgttatgagaattatgagtcttaacccatgtggtgagttcacaagcgcacccggcacgtagtaagtgctcagtaaatgttagccccgctcattaggttagatggtgagcagaactttccaagtgctaggcttgagagcctgggactctgttgccaagggagattagagaacctttgcaaatatgggcgctccggccctggggattgtccagaacgagagtgtggcgcctgcctttctgccacctcactcatccgacccggggaaacccacaccctgtcacaggggcgccttggtccccggagtctccggctcggccatgtctcccgcgcgcctccccggggcctccctctcgccgctccacacctgtcagccgctctcgcagcagccctgtggcccgagcccggggcctcagctgcaaccccttcgcaccctggatcctcgctccgcgcgcctggcgtatccccgacccggctgctgtcgtaaacaaaaccgggcgttggagcagcaccgcgggcggacgggcgcgggagcccgctccgtgcgccgttagcgcgccccgggagccccaggcgagccaagggggcgatggtggcggccgcggcggccgcggcgggcggctgagctttgttatgaatagatgaaagaggccacctacacagtaacccaaattacgagacctccctcctccctatctcaccgaatcaagaggggaggggagatgggcgtggagggagggcgggcgggcgggcaggaggcggagggcggaggaggaagagaggatgaggaagggggccagttgcatcccactttcacaatgggaaagtgaaacgcacaagcgcacccaacctctccagccctccccgcccgcctcgctcctctccgcccgtcccctcccttcccctccgcgcctccccgcgagcgccagcgctgcacacaggaactctccggcgaaggagggcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtttccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacctggagcacggcctgaggtccccaaagggagagtgtaaaaaggggggcggggagggttggagttagactcaaaactctagtggctgcatcccattgccatccttccctgtccaaacggggacgcttgtttggggctgagtctcctcgcgcagcccctctttcccattcgcttctccagacttctctgtgccccttccgtgtagtcccagcaggcgtgtgggtctgaccctcttggtcaacagttagcaacacagtgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctggggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgcttctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaattatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttaaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctgccttgccaccaactttgaatccactttcataactgtagcaggttaactgcagctctcaaatgtgctaaggcaaccgatttctgtagaccctctctctaataatcttctgtgatatttgtacagcacttccacatgtattatttcttttgagccccgcatcaagtctgaggttgattctatggggatgatttcattttccagatgaggaggctaaagatccgttaagcagcttgctcaagatagttaagtgccaaagccctccaccttaaatccaggtcttccaatgtctacatctctactcttcccaccaccccagggtttctcgaactttcccttgaaggtcccctaattaaattggcagcaaacaacctcccctaggatgtggggttgaggctagagggtaacctcagaaggcagtacatgcctctaatcttggcttgtgttttagaacttcatgtggtctctttcctttttttcattcttttttataacacacctgtgcttggattagtataaaaatgaatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccgccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcattcaccatatggggcaaggactgtagttatcatgatgattagagatgagaaaattaaggcccagagagcttctgttaggttccatagctggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatgtccactgccatggacagtctgtcagcatggacattaggtcctgatgtcaaccctaacctgtatggagcaagctaagcccttgcaactgctatgctaagaccagctttttgtggacacaggcataggatagcagagaatccttagttatgagctgagtttctaggtttgcattggtgaccacctgaagttctgactctggcaggattgtagtttcttaactgtgaacttctagacagtgttggtgttctgatctatacatcatctcaaagggtgttctctgttgaaccccccatacctagcatagtacccagtatgtagttgggacttcagaaatatttgttgaatgaataaatgaaggatcgtagagaatcatgttggaaatgttttctctactcagcagcaacactttctgggagtctggtcacctcatactcccttaatcattgtctttttcttaatgcctgatgtgtcagggccccttccttccttagttttaggttacatggtgtcctttactccttcacctcttcccaggtacttccattcattggaataccaggcttctggtgttgccaatctgagagttacttttgaccatggaaacctagcatggttggaacttctatggtgtaatttttgattgcctttcaactatgagaggaaagggctttatgctgtaggcagtggtccttaaagtgtggactgtggcccagcagcatgaatatcacctgggaacttgctagaaatgcacattcttggaccctacaccagacttactaaatcagaagctctggaggttggggtgggactggcaatctgtattttagcaagctctcaacgtgatttgaagtcatgcttaggtttaagaaccactattgtaagataaaacaattttccttgtgttccaactgaggcacctaggataggaacttgtcgcattttttttccccttgcattttacttagggccataaaaagtaaccaacacattttaccacctgatattccttattccctcctcactgatcaaaggcagtacctagaaagccctttaaagacttgccatttttgggcttagagtctgagtctcaaaaacctgtaagccatagtttaattagctccttcactcttgcatataacagtttatttgtatttcactcccagatgtggggggatgtctagagtcgtctattgtgctgtacgccagaaccaattccgcacaccagacattctctccaagggtccattctttacaacatcagtcctgttaccaatttctatcctagtcatgtacagttggttgcatggaataaagatctacttgagtaaggtcagataaagggatgagggatattgtggacagaaacacatggaattacatggtaatctaggaataaaagcaatgctgtgttatggttatgtgcacagtcactggaaccaggtcaattgggaccaaagctaccagttaccagttgtgggactgtagacaaattattcaacctttctgtgcctcagtttcttatctataaatagtgatcctcttggtttcataggattattgtctggattcacgagttaataagtatagaatgaatactactaactacttaactcatagtaaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactccctcccacctgagtatgcctcaggcctgccttgatccccactgtctatcttttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagtggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctgtattatttagtccaagttgccaggagagagatagagttgagtccagttcatctttcccaccagatgatgagcccgagttcagtgtagggatttgtaacccttggggcaggtgctggcccctggtccgactagaagaggatcaaacatgcaattgtccccagcaggtgctgcaggtggattcccttagaacaggatggcggaagagccacaccaagaccaacatcttgattacagtagcatacagtagtgtcaaatctgcctcccttaaagttttttgatgaccactcccttccccaaacatgcattggcacacagatgatgaagactgggaaaccccaaagtcgacttgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcagcaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgcctttaaaataaattatcaatcggaagctccctatgagaaaaaggttagaaaattatcattaggcagggagcagatggcgcatgcccataatcccagcaccttgggtggccaagacgggtggatcacttgagcccaggagttttaagactagcctgggcaacgtagcaagaccccatctctacaaaaataaaaataaaaatcttagccaggtgtagtggcacatatttgtagtccaactgcttgggagtctgagacagggagatcgcttgagcccgggagttaaaatccagcctgaacaacgtaacacgaccctgtctcttgagaaaaattatcattgacttggttctttttgtaagaccaattaccaagcgctgggaacatgggaggaagcaggggttgggagtttccggagccctacaacttgccacaccccatccgggcctgtccctgaggcatctccaaggaacttctagagcagggtgtgaaaaccatggctaaggttgatggagtaaaacagcgggattataaacagacacaatctgaatgtgttctagaaagattactcagaagataaagtggctgcaataaggttggaggcaaagcaccttattagaaggactatcatttgttcgaatactttcttgagctcctattatgtgccaagcaatgtgtggagacatttatatcatggtaaatagggtagacaataaacatttggcaaattaatagttacttttacattaagatgatagctaaaatttacagctcacctactgtatatcattattctaagcactttaccaatattaactcatctaatcctcactgcaactttacaaaatgggctgtattattactaccattttaaagatgaagaaacggaggcacttcactaaacaggtaatgtagcagaggcatttgggggttgcaggtgttggggtaagttctctttaaggaggccgaattgacaccaggaagataagaaaggccggttgcaggtttcccttgcagatctgggaagagcagtgctggcagactggagggcatgtgcaagaactcaaagatggaacatcctggtcttggtggttgtggagagcaaaatgctagtgtggttgaggctagggaggtagaggagagagtatgaggggaggaggctggagaaggaagcagcaggcccagcctgcaggcctccttggcaatgggaaggagattagattttcttctccgagcacaggagagcctttgaagggaagtgaaatgattggatttgaattcctaaataacggctgccctgtggggaatggatgagagattggccacagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagggagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcaggttggctaacacatggtgagtgagccctcagtaagtgtttctagaactggaaaaaaggtactcttcatctggtggagaagatagtgattatagcatggtgagatgagtgcgtccaagaggagttgacactggggctctgttttgaggaaaagtaaaagctgggcagcaacagggaagtgtatttccttttgactcccttcccaattagccaggattccttgtcatcccctgtctccccgcaacctgactgaggaagcgtgttacctaacacaccagctgttcctgatcatcgccccttggtcttctcctgaggctcctttctctatcattgaccccttttaaaaattggattccgagtgcaaagccttgcttctctgaggcaatagaggggggaatagcctagagcagctggtggctgtaggtgtaacctagtgtcagcccccgcacttagcaatatgtttcttcataaccctgcagagctcttgtgctgtagacctctaatgcagcctgtagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccatgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtggatgagtggatgggtgggtggatgagtggatgggtgggtagagaaagctcagaaaggataaatgactgtctaaacacttacagctcataagtaatagagtttgaacttgaaaccacatattttttactctaaatcacttgttctttctattcttccatgctaccatcagctacttttatttgaaaggacacaatgatagggcatgttcttaaaaatatgcatttgaatcatgggaaaggacaatcctattattatttgctttggtcagagcacacctaaagtactgtgtttacttcttagaagcacattttaagtacactgaatctgttgactgttcatggactgagatggcgagagacttagaaattgtctcttacaagctatcaatgagctatggatgtgaaattcagagaaggccagtttacatggtaatgggaggtctggggtggttttctattgctccccaaggcagaaccaaggcccagtatttacaagggacgaatcttggctcaattaaagaactcagtaatgattaggcctacttatcaatgtatcataattgcctgatgagatattgactgaaagtattcaaacattgacccatgtatttatttatccctttgataagcatttattgacaacctactccatgccagatgctgaggtggatgctgcattcgaagtgtagaatacaatactattggagatagtcagtcttataaagatggagtctactgggagacagtaagtttttaaaaacaatagttataataagtattttgaaggaaataaatggagtgctgtgattcagaataaaaactgaggtaggaacgggaagagctatggtcatgtgtccacgagtaggtgacattcaacttgaaacctgacagattgaaaagagccagcctacaagggagtgaaggggggtggggctagaagaagtagcaagtgcaaaggccctgaggcagaaagatggtaatgtgtccagagtctgaaagaaagtgactggacttggggagcagaagcagagtgcaggaggagaagaatggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacaggacagctcccataatgaggagccatcccatgtagaatgccagttgtttcctcctggacaagcactggtggactgagtctctttcaattctgagaacctagggccaggtgcggtggctcacacctgtaatgccagcactttgggaagctaaggtgggcggatcatgaggtcaggagttcaagaccagcctagccaacatagtgaaaccccatctctactaaaaatacaataattagccaggcatggtggcaggcacctgtagctactccggaggctgaggcaggagaatcgcttgaacccgggagtcagaggttgccgtgagccgagatcgtgccactacactccagcctgggcgacacagtgagactctgtctcaaaataataataataaaaaaaagaatctaggaaaatgcagtttcacgctatctgccattcatatacttttgtaaattatttgagtcaggtcgtctttttataagtaattgactgaaattagccatagggaggagaaggaggttgtgggggtggggaagggacataaagcgggaagaaggaaggatgaatcttggagagtgggactttgctggtgggttggcctgggtggctgggaacactggggcccgtcgagggaggggagagggtagaaggaggtgaaatacaagcttcaccaccttgcatgcttcccacggctgtgctgcacaccagtgatgttttctggtctagaggctgcccagctgtgtccctaagcacactttgaacctctccttttggtcatttgagtccccagtgtaaattcttccttcagacgatcagagagctgccataacttagtcagatcccggtcaacactgtatacactagaatggagaaaagcaacccgagccttcctagctaataaaatcactgtccgacttgggcaaatagttgtcctttccatctccttagctgaataaaagtaatctaattattttcaaacacatgatttcatctggacctcacaacaacactgagaggcagggcatgtggtattattaggtccattttacagatacagtcactgaggttcaggagacttaacttgctggaatcaagcagtctataaggcacagagcaggggccagaacttgggtgcagggctccttcaggggtttcctaatggcaagtgggccccttgggaagtaacagaaaatgatgaaactgcttcaaaacaaagggatcccaaagggaacagaatataaaattaactgcccaagaaaggcattttgtcatgtacaagaaattgataggtacccagttggtatttcctcccacctggtaaggtaaaatcaacatacaggaatccttttagcaccttgggggtaaaacacttgactcttgcttggtgctcaacattggaggccccagttttgtgcccattccctcccgatgatgccgcaaaagctggagcatggctgtgagcaccctgcctcgatgagccgggccatctttcacatggtaggggcagggccaagctgtggctcagctctagagggtgcctttcacaccctggaatgcatgactggcaccccctgcagttgtgcagggcacaatgggagagtatttattgtccatgaaaaatcatatgaagcagctgcaaagaagtctaattgttttcctcatgatatgcccatgactccctgcacacacacacacacacacacacacacacacacacacacacacacgtacacacacaaacacacacacacctcaggagctttggtcccagtttgctatatcaggcccaaagctctttctctctttcagcccaaacatcgcttgagccaaggtagctttctcctccaactgagaaaagtttccctcttagagccggcaaacgtgtaggcgtgacgttatgcttagacacggcaggaaggagaagcagagtgacaactctgagggaaccaagaaagcccaaaggggagacaaggtttagagcgaaatcaagatcggattttgtcatgaaaggcagaactggcaaaagcatcattacaaggcattaaccttgttacacacagacgaacaagcagaggctgggattcagaaataaattacacataataaactagacagaataggctgagagcaacattagcgattatgccctaaggggagagaagggcaagatagaaaataggcccgaaaaaaagagagaaagaataatctctggacacagggggctgactgcactgtttcccccttcttctgcctggctccctgggtattaacctcacttttgtgaggacgtttctccggagcctgtctttcttttgttttcatttgctgcaataagcataagaaagccattcaaagggttccttttcccattcacagggacctgtccatttctgtgtgtttccagcacaaaagaatccatttccattcagccagagcagcccctagagttttcatgaggtccaagcctcctctcctgttttcttccaggctcgctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttccttttggttccaagtagcagaaaacgcaaccaacagtggcttaaaccatgacaactattgttaacttagtaaaatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgttatcaatgaggaaacttattcccagaaatccttccagtggacttctcacatctccctgcccaggactgggccacatgaccaccctcagctctaagggttaggaaagccagtgtctggcaatagggaatggagctgccatttggcttggcccaacgatagcttccaccaggcttgggttcattgctgtctgaacaaaattagggttcttcttggcaaagagaaaataactgccatgggtgtggcagtaacttgtgtttttaaatgaagtaatgatagcaagcatgggttatgtgttgctatgtgccaaacctgttctaagctttactgaggcttacgcacaaactcacccagtcctcataaaaagtctgtggcataaaaagtctgtgctcttatcatcatttccatcatatggaggagaaaactgagtcacagagagattaaatcacatttacaaaattacttagctagaaagtgacagagccaggagtcaaacttaggtggtctggctggctctctatgctatactgccttcattaggtaagatgataaaatacttcaggtagcacacagtaagtattagtacatgttagctggtattattattattattattattattattattattaattattactatcatcatctcttttttgtaaccaccctgccaatcagacacatcagccttattagatactagaaagctaacccctaacagcattaaattaattgcccaggtcacacagtgagtgagaaccaagctcaaatgtaaacgagtgctgggtgttctctcaagtttgagaatgttgatttaatggctgcaccacttacccatgctacttttttttttttaaggtaaggtctcactttgttgtccaggctggagtgcagtggctcaatcatagctcactgtaacctggaactcctggactcaagtgatccacctgtctcagcctcctaaataggtgggacaacaggtgtgtgccacacatctggctgattttttatctctgtagagatgggggtcttgctatgttgcccaggctggtctccaactcttggcctcaagcgatcctctcgcctcagttacctatactactgatcccggacttactttgaaaaaaaaactacaattgttgaggacagccagaaatcagagaaggacaccgggaaaggtgagatggtaatttgggacggatttttccttgttccgttttagcttttgagctgcctctgttttcttggatccagtcttttgcaaacaggatctctcatcccacctcaggaaaggctacccatggttcttggtgaattagaacaggtacagtattaagcacctactgtataccagacctggctgtacactgtcccacctggtccttgtggataatctacagtccacatccattactttttctgtgttgtgagatgaagggaatggagtcctctagccagagatagtggtattagaacattctggatacccaggcagagacgatgccctattctccgcgttagcctctctgcagtgttcaaatatttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttccctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataatataatgaagttaataagtcttagcctccccctccccaaatagggcgattttaggagttgctgtgttgcttactgaagtttgctggctgcaacttcaatgtgcctttaaaaaccttagtacagttgggaactgagctctggcagataaagtgtgctatcacactgtgttcagtagctgcagacggcaacggctcttcctagctccatatcttccagagatttgtgtaacaaactcagtttcctgtcgttgaaggcaggatgcagcacgaagcacttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctaccccatcgtccacaactgtatctttaccttttcaccccctcaactagctaccctgtctttgggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaagaacttcatgaactccttaaagacccccagaaatggcctggaagaaaatctggaattctgtatgtaagaatgccccgtagccatgtaatgaagtatcagctaccttgctgcccaggagtgcaccaagatgtttttccttccttactcataagccagctgggtgaggtaaatggaggtctggtccctaccccaaccctgactcaccttcccaagacatgtaaccttttagttctagctcctttatcatggaaatgtacaaagcacctgatttctcacaacttgaaagagatgagagattatagggcttgaaaagaagaaaaaacaggtgttctttccctccagcccacttaccacccacagagggggtttgttttttgccctttgtacccacacacaccacagagaggttagagatctaaaatcctttgagactcctcttgacttttatctcagaggactatttcttctccactgtgtggacacaccccggtcaagtgcaggtttttattcacttaggagaggggaagaggggaggaggagaaaataaaatcagagataccaaatgacttgtctgaagttatctagcgttcatcttatcaatgtcatcagcaagcatttattgaagaccttctgtggtctccaacaacattcctggtcaggaactgcaccatttctatgactaaagactgagattccttggcttctctgcagccatccatttactctcagctcagatttttaatcgagtaatggtagatctgtttccctcaactgatctcccacagataactcgctgtgtgactttaggtgaattgcttaacctctctgagccttcatttccttaccagtaaaatacagttctactagacaacccagaaaaacgctttcctcttctgaaagtctctaattctgtcttctgcacacgtattccccaccatccccatccccaagccaaacctatttacttgctcctgtttgatcctgtttccaaatatgatcctgtttccacacttgctcacactgtacctccagcctgaaatgcttttttcttttttctcttatttacggcaccttatgtgtctatgctgtggctcagctcaaaccccacctcctctttgatgacatctaggcctggagtgaccttgctctcctctcatttcctgaaatactcatgatctatgtcattcttgtggctcattccaaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacgtctgtagctccaccaacctggtcaggcttattggacccatttgcctggcgggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagccgaccgaagtctcgctctcctcaggatctgtatggggtacccattcagaagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcactaagatcccctatgctgcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctgacttgccccaccaggctccctagggcagctcagtaatgcccaagcctctcccctgtatcctgtgtacagattcttggatgtagcccctgaatttacccagaatcctgaagacccaggatcgtgtggatgatttggaaactaccgataatcctcaaatccctttattcagaagctttcagcttctcccttgccaaggcttgtcaccagaactgttagaaaggatgaacactgatagacacaagcttggctccttaagccacagcgtgggggaactaatgagcggcaaaaaacaaaactcaacccaacgcagacagtaggaggaggagaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtcgtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagatggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagtcgtcagcatctccactgagatcagctgaaaagtatggtcacactgaactcagctttggggaattcacactgcacgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttcctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaataatctgtcccagagcccgagcttctatcccccaactaaactgcattaactcttacagagcttagtagagtttgagagctggtttttgttatatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacctgtgcccccacacctggctaatttttttgtatggacagggttttgccatgttgcccaggctggtctcaaactcctaggctcaagagatcctcccacctcggccttccaaagagctgggattacaggcatgagccactgcacacggcgccactcagggatttcgtttattcaaatcacagcaaaattaaaccggttccaaaaagttctgtctgaattcaaacagaagcaaaaactctgtactgcctaaagagtctgccttgactctggttattgaagtttttgaatgaatgtcagagaaaaaaatcttttgtaaaggcaagctgtactatatacccagaagatgttcaaataaggaataggagaacttggggaacctagaacaggacctgggaccggaagtggtggtggtggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactgtatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggcttcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaaatggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttgggtttttgtgactcattgttacttcctgcattgcttcactgatcatgttctttttccgaggctgcccacctaaactgagctgaggaaggaacgtttcccttgctccagtcttgctggcttttgtctgtgtgttgatattctcctgaagtttgcaattagaaagtccaagtgttccattagtgcctgtgggctggggctcgggctaggtgagagatgatatgaacactgacctgtcctttagtcatctgagagagatgagactccaggggccacggaagcagaaatccctcacccctctgtgtagcacatttgggacctttgtggtgaaaactaaaacttcctcttgtcctgtcctcaggattatggagagcattgtttgcataatctagcaaaaagaaaaacaatttgactcactcaccctcaaggatttttaaatttaaatgttatatatttatttttaaggtaatacaatgatattgtttaaaactcaaaagaaccaagaaaatattccgtgaaaggcacctggtcttgacttccaaggcaaccaatgatagtagtttcatgggtatctttccagagatagtttatatctgtctacaggcaaaagagtgaagatattcttcctcccttttgttgaaacataaaacacagtaaacatatatgttatatatgtaaaaatacctgtatatgtaaatatgtctatatttatagatatatgtacatatttcatataactttaaatataacacaaagagctttctaattatttttatagctaaatagtatttccttgtttgtactatagtttacttaaccagttccctattgctggagatttaagttgttttaatcttttctttataacatacaatgctacaatgaatatatgtcatttcatatatatgtgtgtgtgtgtgtgtgtgtgtgtatatatatatgtgtatatatatatgtgtgtgtgtatatatgtgtgtgtgtgtatatatatgtgtgtgtgtgtatatatatatgtatatatatatatacgtatatatatgtatatatatatacgtatatatatatgtgtgtgtatatatatacatatatatatatatatatatatgtatatatatatgaggggctgcagggtccaagggtatgtcctttgtaattttgatagatgatgccaaattaccttctagagaggtctggcttccaccactgaggaaacatactaatttaaacccagcatctatggctatcaggacaagcttcagtgcaagccacgctaagtagctttttcaggaaactgattggtaaatcctgggccacagaactttttgataacttgtaaaaaaagaaagaaagaaaaacaaagaaagaaagagagagagagggagaaagaaagaaagagagagaaagaaaaagaaagagagagaggtaaggaaggaaaggaaaggagaaaggaagggagaggagaggagaggagaaaggaaaggaaaagcttccttgccacaattcagagttctagagagaatattgatgcttcatttccaaggtaccaagtaaataaatcaatgttgcacccaactagatcttgctgaccatctgtatcaatgatgctccaagagtaaataaaataagcccccaataaaaactgcagtgcagctcctaatttacgtaaaatggatgagtggtggtgtaaagtatgtttttactttgttattttaaagcaaaccccacagacatgatgtcgtttcacctcaacatatttcgttatgcatctctcaaaacctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatctgcacaaagtcctcaaaccaaatttggttgttctattatctagagcagtctcctcccttacttttattccctgccactgacttaactgaaaaaaccaggtattttgccctatagaatgtctcttatcatgtgtttggctttttgcttccttgtggtgtcatttagcttgttcctctactcctgcttcctagtgctaaatggaagttagtgctaaagacttgactagattcagtttcaactttattggcaagaatacattatgggtggtgctgcccaatgatgcttttgccatgatgaattcctgaagagataccagggcagcagcttctcttctcttgacccttccttgataatatttctatcagtgtttgtttaaaaaaaacaaaaactggcttcctgtttctctttccctatacaactgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagcggctgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctggaaaggagaagtgaatgcgggaagttgctctgtgcaaaattgataagaagcctttggctaaacagcaaatccctaactgccatcaggatatgtgggaacaggcatattattgattagtagatgtgtgaagtagactttgtccaaaaagaatctcaggtgccaaatttttcttttgaaaccatgcgcccaatgtggctgatgtctacagtggtagagatatgaatacagataatctatctggatgtgttcaaactgacaaaatgttgaacaccttcacttttcaaagtagtgggtacaaattgtgttaggtacaaagaagattaaaggttaggtacaaaggtgattaagacatggtcccaggccaggcacggtggctcacgcctgtaatcccaccactttgggaggcagaggcgagcggatcacctcaggtcaggagttcaagaccagcctggccaacatggtgaaaccccgtctctactaaaaatacaaaaattagctgggtgtggtggcgcatgtctgtagtcccagctattcaggaggctgaggcaagagaatggcttgaacctgggaagcagaggttgcagtgagccaagatcgcaccactgcactccagtctgggcgactgagtaagactccatctcaaaaaaaaaaaaaaaaaaaaatgacatggtccctgcgcaaaaggagcttgcaatctagtaacagattattatctattgactattgattatgtgctaagcatctttcatagttcttatttgatccttacaaaactgtaataaggaaggcactattagccccattttagagatgaggaaattgaggcctagggagattaagttaccagttcaaagtagtgcagctacttaaaggatggaggcaggatgcaaactcaagcttaagccaccattatacttctctagcactataggattcgagtctcccgatggctcttcatacccacacttcaaaccctgccttcttaccatctcctcttgctccttgacccaaagccctgccatggcctcctctctctcatctacagtaaaaggcaggctgtttacacaggcccacaagacccttgattatcattcccctgttatcttactatcttactgttcactcctctacctctctccactgaagccaccctggcctcctcccattttagtttctttgcactgacagggctgcttttaagaacatgtttcattcaagtatgaaaataactcatctcctgcaagtctaaataaatatcaccttttcagtgacacctaccctgaacatatattctcttaacccctgaccccactatattttataatttacttttttcttattaatagtctgctgttactcaccccaccatacacacacaggaatgtaagttctatgaggtcaggagctctcccttccccattttgttcactgccatttttcaaacacccagaacagtgctgggtacataatgggtgttgggtagatgtttgttgactgaagatggatgaagctcaggtgtgtccaatttcaaaaccactgagtactgagtcacacttgcgtatattttatatgtgaacacaaacctacttgtctgtatctgccaagttaatctgggtcacttctaactgtatgatgatcagagtatcctgtgcaaatacatgtgggagctacttcctttaatttccagtctctcttgagacagcactaatgaagctgtcacttgtggcttcctatagggccagacatggtcagaaattgtggtcagccagcttccacatatgaggatactaccccagccctgaagagcggctttttttgtttgttcatttttggtaactttgcctttacaaaagaagaaatattatgcttgttattaccagccttgttgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggcggaggttgcagtgagccaagatcatgccaatgcattccagcctggcgacagagcgagattccgtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagtttaagcagtgccccaggctttgaggagacccgcagtggttcacaggcacggaattaaaaaccttactgactgtcagtaagtaagcaagaaatattatctatttagacaattttattattggctatatttccagtgccaagtttttcagaggagggtgtgcttggaaatgggcgcataatcagcaaggtaactgaatttacacatttattgtgtgggcactgaacggttagatgcatttatgaatatacccaatgggactggctttggaatttggggttaatatcaggccacagtctcatacacattcatgaaccaggaaatatatggtactccccctccccctcttcatttatcttgctgttttggcttttcttttgcttctgcttactgaaataaaagtaatatatttttatattttcttcatctttaccaagtgctgtcaccaagggaaggggaaaagaaactaattgttaatgagtctctactatgcattagtcactattctttgcatgatctctgtctaggtgcatagaattgtgtacatatacatacacacaagtgtagaaaacagtgttaatgaaatgtgttactgaccgggcatagtggctcatgcctgtcaccccagcactttgggaggctgaggcaggaggatcacttgaggccaggagtttaaggctgcagtgagccatgatcaaaccactgtaccctagcctgggtgatggagcaagaccctgtctcaaaaaaaaaaaaaaaaaaaaaaaaaaggctgggcatggtggctcacacctataatcctagcactctgggaagccaaggcagggatcacctgagttcagacgttcaagaccagcctgggcaacatgatgaaaccccatctccactaaaaatacaaacaattagctgggcgtggtggtgcatgcctgtaatccccagctattgggaggctgaagaacaagaatcgcttgaaaccaggaggtggagtttgcagtgagctgacatcacaccactgcaccccagcctgggcaacagagtgagactctgtctcaaaaaagaaaaaaaaaagaaagaagaagaaaaagaaatgtgttattaatttaataaaaataaatgtgttattaatttattttatgtgaagaatctaagacttggagaggttaaataacttgttcaagaannnnnnnnnnnnnnnnnnnnagaggttaaataacttgttcaagaatatctgtatctatctatctatctatctatctatctatctatctatctatctatcatctatctatctatctataggttagcctttgcagggctgtgacaaaaactcaaccctgattctaaagcctctgataaatgatattaaatccaaaatttgtgaaaactggacattccctggctcagtggttttgacctatgaccgtttgaacatggaaagtgcaaagaagataattgagacttacataattatataatggatgtaacagatactctcagcccaaccctggttttccattcttttcctttcagtcattctaaggaaaatagcaatgacagcaatctacatgtgctttttgagtcacagataagatgtgcaagcaatttgtagtttctggtattcttataaagacgatactgttctttgcacattgaaaagtcagttatatcaaaatgaccacactgagatggccacatcttcccacagagcttgtaaaccagtccttcaccatatagaatctcctatgccaatttgcttcaccatgcagacactttgtattatgtttcttccctggggatcccatctttgaaagacttttgtctacccaacaaactgcacatattaagtaacagttcccattcccagggtttatttatcaagggcgtctcaaaactgccggtcagagtactgactgtgttcccacatggagctgataaaattccaacccaaagcaaagaaacttgatatcttccttaatccatgcgtgtttttccattcagctgtctgaaatattgcaaatagctcataagcccccattacttccttcatggatagtaatggaaccccagaactcaggaccccaggctgggaaccattatgaaaagccaccagtagttgatgggttcccactttctagaaagcaaaaagttctagcctctgatcattcaaagcctgaagtcctgggaagagtttttgactgggcatcaaagctggttagccctgcattcttcactgaggattactgctagagatcctactgtttgaactctggctgagcaaatataacgcctaaagagacaaagtccaaggaaggctcttggggagataagaacagccaaactaataagctatgggatatccataaaatggtatgatacggggccgctaaaaataatcatatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttctcctgtctcagcctccctagtagctgggactacagtcacacgctaccatgcccggctaatttttgtatttttttttttttaatagagacggggtttcaccatactggtcaggctggtctcaaactcctgacctcaggtgatccacccacctcagcctcccaaagtgctgggattataggcgtgagccacctcgcctggccctctctcatttttttttgaaacagagtctcactgtcgcccaggctggagtgcagtggtgtgatcttggctcactgcaacctccacctcctgagttcaagagattctcctgcctcagcctcctgactagctgggattacagacgcccaccactatgcccagctaaattttgtatttttagtagagacagagttggccagactggtctccaactccaggcctgaagtgatctgtccacctcagcctcccaaagtgctgggattacaggtgtgagccaccacggccagccagtgtcctccctcttatacagagttatatttgtgtgtttaaatagactgagtaatagttctcagagaatgttctggagacccatattccacagaatgctctgagcaaaagtggtcccagaaccagctgttacttactatacccctcctggaatactgtgaggctcagcatagtcaaaggctccgagaagccctgtgctaaggaaacccgttttgctttttcagtctgaggttttatgtttgctggatcatggagcccttttcttgcataatagcagtaaccaatacttattgaacatttagtacctgtcagacaatagttcataataaccccatgaagtcgtgatccattttacagatgaggaaacaaggttagagagattgcatgacacttattaaaatccatcagtgttacagaggcatttgtgaactacaaggaaatacctctattctggttaattccggctcaggatcacgggctgccagctgcatctgtcagcagtgttggggactatgaaatggaagggcgtggttatcctccatgaagtcaacttggaactgaaggatccagctcaggatagtccttgttttcctcacaaaatagagaaaaatagagaggtcccttctagaactccttatttctctaacctgctaaagaagttatttatactatctagcatgtacaacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgaggtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatcatcattagcagatcggaaacccaactgggtgtcagactcacctgagagagagctcttaaaatacagattcctggccagacacagtggtgcacgcctgcaacctcagcacttttgggaggagtgctttgagcccagaagttcaaaaccagcctgggcaacgtagtgagaccctgtgtctttaagaaaaaaatcttttaaatgaaaaaatacaacttcctaggctctgcccccagacttagcgagagtctctgcggcagaggcctgggaatacgcactgtcaaaagctccccaggtgattgtgatacaatgacttcatgtcctagatcttgagacccactgcccagtgccagtatggaggtgttgagttcaagttgataaataggctctttttggcccttcattagataaggtgttgtagttttcctgctgttgcttataattccatctgaaccattgtcctctttccttttaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgctccgcagaagcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggatttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacaatgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccacgcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttgaagttgagtttaaagattgttaggggcaggcgcggtgactcacgcctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtgagttatagtcttttgtttgttttgagacagggtctcatcctgtcacccaggctggagtgcagtggtgcaattacagctcactaaagcctagacctccccaggctcaggtgatccttccactgcagtctcccaagtagtggggaccacaggtgtgcaccaccatgcccaggttttttttgtattttgtagagacggggtttcaccatgttgcccaggctggtcttgaactcctgggctcaagcaatcctccttcctgggcctcccaaagtgttagaattagagacgtgggccaccacacctggccaaaagcctgcttctgctcttgctccctcacccctatcccagtgcgctccaagaagagtgattcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgacggtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttggtttcagacagcctgggttctggcctacaatgaaatgaaactaagtctcatatctgtgactcatatgaagctcccagtaccattcaaaattaggaattctaaagggggatgttttcttataatggtagagcatcccactgtgtttattttaaatgtcatggatttatttagaaaaataatttattttctctgttgagaaggttgagttttcttgcatacatgtctagaaagtggaatggtggggagaggcaagaaaactatcttcacttccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttggcatgcagaatgcattttcccatagaaacaatgtcataaattaaggattgattcccaagccagcccataaaatccaaaattatttaatttcaacaaatatttattgaacacctagtgagagcctaatctggggcatgagatagctaggtagtattgagagaaatcggatgccattcttggctttaaggaactcgcatgctagctgggaaggcagacttatcaatggccaacattcattcattcaatcctacatccaatcacaaatattttttaagcacaacaatgtgctaagtcctatgctcagtgctcaggatacagttctttcttgtctctatagagcttgcaatctaatgggggatataatgtgtatcagttaggtttctgatctagtaatgctgtataacaaacaacccccaaatccttagtggtctaaaagagcaaacatttatttacatttgtttttcatgctcatgggtcagcctgtcagctatgggaagaagggtggggtcaatgtcaagctgaaggttgagttcaggtctgtttcccatgtttctcattctgtacatgctcttcttaaggcacatagaagtagcatgagagaccaagctaaactagacaacatgttctaagccctggctgacatcatgctgactaatattccattgataaagcaagctgcatggccaagcccaatatccatggagtagggaaatatattccacctactctagtggaagattctgcaaagtgacctggcaaaaatgtagtgtgggtgtgtcattctagtacaggatggattgaagaattgggagcaataatccactcttatcaataagtaaaggagataaatgaatagagtgtcataagagctagcatgggggaagtttagggtttcatgggggcacataaaattatctaacccaaacttaacaggtcaaggaaggcttcctggaggaagggatatctaatctgaacctgaagggtagggggatatcagctaggtaaagatgaggcaggggaagctggtgtagggaccaggctgtacaaaggccaggagagcttggcctgaagctcagtgtggacgagcttcacattaaagaatttgaattttgttggaaggaccttggggagccattgcagggctttaattaaaagtgcgaccagatcaggtgagtgttttagaacgagaactctggggtgcaaggtggaccggaggggactgagaagagctggcagatcagttagcaggtggctgtaaaccagtaagagaccagggactgaattagaatgatagtagtggtgagggaaggaagtgggtggattagagagctatttagaagatagaattgacagggcttagtgattaattagattcccctttgagtctgacacactaaaaatagggccataaaatgaaaaataaaatctcaaggtggccactgtttttctggaagatgtatcctttctcctttgatctcagtcttcatgaagaaaacaaacaagtgatacccacatgtacacttgattcttcctgtgtcccaggcactgggctaggcaccaggttagaccccaaaagatgggcacctgagtcaaatgtgggagggcttctgagagacaccagcgctgagtctcagagtgtgcagtggggtgagttattgcattgaagctggtgttgagattacagcggaaggagtgcaggcatctggctggggtgaccagatggacagaggtgtcggttactgagtagggagtgtagaaggagtggcctgtttgggctgcatgggaaacgcggggggtggacttccacactggcaacatgggcaggacagcctatgaggacagaggaaaggtcctgtgtttgtctgtttttgcactgctataatgaaatacctgagactgggtaatttataaagaaaagaggttagttggctcatggttctgctggctgtacaggaagcacgatactggcatctgctcagcttctggggaggcctcaggaaacttacaatcatggcagaaggtgaagggaaagcagggcacgtcttacatggctggaacaggaggaaaggggggttggggaggtgccacacacttttaaacaaccagatctcaagagaactcaccatcacgaaaacagcactgaggaaatggtgctaaaccattcatgaaggacccacccccatgatccaatcacctttcaccaggccccacctccaacactgaggattacaattgaacatgagatttgggtggagacacagatccaaacgatatcaggtcccaaatgcattttgctttggatagaatctgggctttgtgtgacctgccagtttcttatctctgccacttctcctcttctataaagtggcatttataattggccaggtattgcaaaaaagtgctgggattacaggcacataatcctgggattacaggcactttgggaggccgagttgggtgaatcacttgagcccaggagttcaagaccagcctgggcaacatggtgaaaccctgtctctacaaaaaatacaaaaattagctgggtgtggtggcgcatgcctgtggtcccagctactctggaggctgaggtggaaggatcatttgaacataggaggttgaggcttcagtgagccgtgattgtaccactgcactccagccttggtgacagaacgagaccttgtctcaataataatagtaatagtacctgcctcagaggtttgctgagagaattaaattccataacgtacatcattgtaggcccagtgcctggctcctggtaggcaacgaagttgtgtcaactgtcatttggtggaagcccaaggaggcagtcattacttgtccctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccactggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcaccctcccaacacttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccaacaccccagagtaacaaatgaaaagaattacatgagttgcttgtggacacgtcccagctcctttttttatcttgctctcctgtcttgagggttcttctccaagtgacactccttcctcaagccccccaggcctatcattaacctgctgggatccttcccaccaggactgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagcgagttctcactctgagttcacaggagatctggttgtttaagagagtgtggcacctgccccctcacagtcttgctcccaccctagccgtgtgacacacctgttctcccttcgcttccagcatgattggaagcttcctgagcccctcaccaggagcagacactacccatgcttcctgtacagcctgtaaaatcatgagccaattaaaccccttttctttataaattatccagtctcaggtatttcttcatagctatgcaaaaaatggactaacacagggtcacagaaggctttgcagtagaaaagtccagatggatgtgactgttcctcattcagaaggcggctgcagtgccccttccacagggagcctgcctcgagtccaggcctggccaggagacagtgtgcatgggtagagaagaatatgcttatcatacattagacactaccttgcacgttctgtgccatgttccatttagtcctcctggtaccccatgaagaaagcactattacaatccccacttcttagagaacagccttagcttatgtatagtttcccacagctgcagaaacaaattcccacaaacttggcagcttaaaacaacatgcacttgtgatcttacagttctggaggtcacaagcctgcagtgggtttcactgggctgaaaccaaagcattgacagggctgtgctccttctggaggcccttctttgccttttccagcttttggaagcagccagcattccttggctcatggtcccttcctgcatcttcaaaaccaacagtgtggcatcatcagattacattgggcccacccagataatccaaaataatctgcccattttaagatcctccacttactcacatctgcagagtcccctttgccatgtcctatggtttgaatgtatcccccaaagttcatgtattggacacttaatccccagtgcaacagttttgagaggtggaacctttcggacgtgattaggtcatgaggactctgtcctcatgaatggattaatgacattatcacaggagtgggttagttattgcaggagtgggttacttatcacaggagtaggttcctgataaaatgatacattaggcccctttctctctctctctctctctctctgtctctctctccctcgtgctttcttgcccttccaccatggaatgatgcagcaagaaggccctcaccagatgcaggccccttgaccctggactgcccagtctctagaactgtaaaaaataaatttattttctttataaatttcccagttagtagtattctgtaatagcaacacaaaatggactgagacaccatgtaaggtgacacagtcacacattccagggattaggacctggacatctttgggggccattattctgcctactactggttgtacaagtaatggattcaactctgggcttagctctagctcctaagccattagagcaaaacaaagagacacaggcaagggacattatccctcatggcagtgggtggagaggggagagcctggagcaaatggccctaatggagcatttgtgataactgctatgtataagaaagacacggcactcagggcccacctgagtcagagaaaaccctccatcttgaaagcttaggcaaccatgcattcatttaacaggtatttactgagtacctgatatgtgtcagtcactgtcctaagcactgggattctaagcactagcagtgagtaacacaggtcaaaatccctccacacgtatgttcattgcagcactattcacattagcaaagacatggaatcaacccaaatgcccatccatgatagactggataaagaaaatgtggtacatatgtgccatggaatgaaaaggaatgagcagccatgaaaaggaatgagatcatgtccttttggggatgtggatggagctggaagccattatcctcagcaaactaacgcaggaacagaaaaccaaataccgcatgttctcacttataggtgggaggtgaacaatgagaacacatggacacagggaggggacaacacacataggctcagctaatgcaagctgagcttaatacctagttgatgagttgataggtgcagcaaaccaccctggcacacatttgcctatgtaacaaacctacacatcctgcacatgtaccctggaacttaaaatgaaaataaaaattgaaaaaaaaatccctgccctcatggagttccctctagtgaggtgttttagtttcccaaggctgccataacaaattactaccaacacaaatttatcgtctcccagttctggaggccagaagtctgaaatcaaggtgtcagcagagccgggctccctctggaggctataggggcaaatccttcctcacctctcccagctccgggtgactcctggtgtttcttggcttggggtaggataaccatctctgccttggtcttcacatgaccttcttctgtgtgtccaaatctccctctcctttctcctagaaaattcccattcactgggacaccctaaatccaggatgatttcatctcgacgtccttaactctttacatctacaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgccttcatgggctattgcactattgagtggaatggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgggctgagtccatgcatctgggttactgtgaatgctggaagggatttggggggctttccaacaccagaaggggtctgggggtcaacctgtgtcctgtgggttctctacctcctttttcagctgtgagaggagctatgagttctatgtatttcaaagcagaaggcaaaggggatagcagtgctaaggggcacctctccacccttggtgtcccagacagttggcactgggaaagtgctcgccatgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaactgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaaatgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcattgcccacaaaagaaccacatggagcaaaggccacaaacccattttgtgtgagtgtttcagtctgcaaatgtgttttttatgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagctgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatgacacaaccactatcctccttccttcactaagttctagccaagctggtctatttcatcagttccttgcagagaccatgctttaagtgcactcagatactttgcacatgctgttccttctgcctggactgctcttcccactacttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcaccggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaatatttgtagaatgaatgccaggtatggtcttaggccctgagggtgcaaaggtgaataaggtgggcctttccctttgggggatttacagtgtagctggagagacaggcaggcaatcagcaactaatgcagtatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagatagactcatcaaccaaacttacctggggatgagtttgaagaggaaggcaggggccagatcacagtgttggggtcagagatgggcatggaaacatgtattgcagactgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccgtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattgagtaaaacttgtattttcctatatgttcatgtcttggaagaatctacttgctattatgctggcatttgtgatgtcgctgccctggaagccttcaaaatttttgagcaattaggtgtagtagtaagagatagatgccagtgccagacaccatgctaactaacctctctgcacctccgtttctcaacctctgacatggaggtggtaacaataacacctacttcatgggctggttgtgaggattactgtgttaattcccagaagtccccagaaacagtgcctggcctatgggcactaggaaggtgcgatggtttgaaaatgtcacctaaaaagcgtgtgttgggaatttaatccccaatgcaactctgttgaaaggtgggacctagtgagaggtgtttaggtcatgagggctctgcctttgtgaatggattaatgccaatcatagaagggcttcaggctgcaaattcagtctctttctcttgttcacatgcgcatgccctcgctctctcttgctcttccacctcctgccatgggatgattcagcaataaggccctcgccagatgcaggcccctcgaccttggactctccagcctccagaactgtaaaaaataaatttcttgtctttataaattacccagtctgtggtattctattatagcaacacaaaacagactaagacagatgggctcagtcactattagctattctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagactgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatagaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattagaaacagatggtttgcaagaaaacctttttgggagtagaatggatttctaagtccagggccgcctgaaattttaacctcttgctagttgtgtggttgtgttgtattcacagctagtgatagaggaaaattagaggcctctcagaatgcccacttctgtgttctcccccaaatccttgctaaccgcttcatcctacagtctctgccttaccttctgtcttctctgtttctggggtccccatccctgtgtcctcatcctggcccagctccaccctgcaaccactggttgaggtcccaggaagccaggaggaactatgaatgtcctctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatataaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggattttttttttttccttcaggcaatcttttctttgcatttgggcaggttctgtattctaatttgcaaataggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaagagtcctgtgtgacaatgagattttaatttaattagggcagtggctcaagtgtttatgcacttgaccgttgctcttgttgatacgcaggaattagagtgatagctttcaaaaggaattatttcagagtaactagctttgtttactaaaatatgggagctataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgaaaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttctttgaggagcttagagcttacttggggagaactgagatagacttatgaaatagttaagttgtaattcgaggcagcatatgattaaataccgaaatatgtacttctgacaagaaatgctataggagttcagaaaagggagtgataactcagtggcactactgttttctgcctacaaattggcaaattgtagcactatttgtatgaaatattttacacttgtttttttggcagccttaggctttgactcccaggcagcattaagagccaacaaaaatatttgtactccagtctcttcggaattggcttatttttttttttcttataggcagaggaagtgccttacacaaaccggagtgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtctttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaattgaaagagagagagagtagagaaaggagaaaaaataaaacctttaggaagccaaatacactgtttgggcccatccattcctcattccgctcggatcccctccgggactccccgtagctgaatgtggtcatcatttggttgcttttcaatctcatgattcatgtgttttcagtttcttttaaaaattcaccatcactggtttaccacccctgcattttaatcttcagccttgaggaggtgtagtactagaaatatttcgttctttccttgatgctattcaatggaatatctgtggagtccaacaccctttggcgataacgtgctgttggtatttgttcttcttgctaggttggtgccccgtctggtgaggcaagggttcccaagttagtgtgacctagagtgactgacacatcaagcaagccagtgatctcaccactcagcttctgagcatctctttatcaaagtagttggccctggccacagcttaagacttatctgggtcagcctctgagctggctgacttgggaaaatggccctggaaaaatgtttcacctatatcttttgatataatttggtatctgtctaaataaatggtatgtagcagatggttatggaatgtcttatcaaattcttaggcagactctgcccttgaaatttttctatttaattatcatactgcaaagcacaaaatagtaactttgttattatttttaaacaaaatcaagttacacaataggttgatattctgagaatgaatagcaaacctaaaatttatacaatatgtgaactcttccttgagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaaagtctggcattttgtactgaagccaagtataagaaagttttaactaatgcacgtatggggtcgctgttttaactaacacacgtatggggtcgctgttttgttgcctcgtttttttaggtgcacttttcaaggagattgtgtacattcagagaacttagaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactccattcatttagcactcattaacgaatattgagtgcccaccagatgccatccactctgcaaggtgctggggatacagcggtaaccaagtcacatcatgggcctgctctcatggagtttgtcgtcttgtggagctgaagatgaccctcaatggttgaactggaagaaaagttggacttctaatgttgtagaaatacatattgcttttgaaaataaagaaaaaagaggttcagattcatggtcaacgagataccttaaaggtggcttaattgcagaattttgtttagtgtaatggtcccttatcctaatgtgttgaggcttccccagtaaccatcttatgaacatagcttccaacagtcttggtagcgatggagagaagaccaacatgggcagtgaccattgcaagtgaggtcctttggaaagccagtggacccttgctatggcagcaccactcttgacaacacatcagtcctgtcattggatgagagaagggagcaaggagcatatttaagcattttcaaatgcacacgccaaccgtgccctacggaaaaagggaattcctgccttgcagtctcagtggtgctataaggaggcattttctccctaatgacggctcttgtgttatgaataattgtacagagtcctctgttatgaataactgtacagcagccagctgacctgtctgttgagctcactgtgttctgtttgaatgccatattaacaaggaaatgggccactttctcttttcccttacactttgccatttcagagaaatagcaagaactttaccacttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcgctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacaaccactggtgttttcttcctcgccctaagtcccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccctgacctatggagacggcagtctagggttgtgttcagttccacctattagctctattcaaaggctatttgctacctgcctatcatatgcctagtaacattctagtcactttgtaggcagagaaaaacctccatataataagaacctctgttcacagaagctttatttctttccacaaaacaattaaaagatagtacatcctcatactcactatgggatcagcattaaaaagaaataatcagagcaattccagttgtcctggagggatttctgtgaggttttgttgagtaaaaacagcaagatgcataaaagtgttcctagcatgatcttatattgatcaaaaaatgcccctgtatatgtttatgtatatatgtctctatatgattatttgagcatgggcaaaaatatagaagaattcaaacaaggttgtaaacatgggctcccctggtggaatgactgatgtggtggagaaggaaagcagagatatgtaataaaaatagaaaagacggccgggcgcggtggctcacgcctgtaatcccagcacgttgggaggccgaggcgggcggatcacgaggtcaggagatcgagaccaccccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgctctccagcctgggcgacagagcgagactccgtctcaaaaaaaaaaaaaaaaaaaaaaaaatagaaaagacacagaaataaaattattattgttattatttattatactttaagttctagggtacatgtgcacaacgtgcagttttgttacataggtatacatgtgccatgttggtttgctgcacccatcagctcgtcatttacattaggtatttctcctaatgttatccctcccccagccccccaccccccggcaggccccggtgtgtgatgttccccgccctgtgaccaagtgatctcattgttcagttcccacctgtgagtgagaacatgtggtgtttggttttctgtctttgtgatagtttgctgagaatgatggtttccagtttcatccatgtccctgcaaaggacatgaactcatcttttttatggctgcatagtattccatggtgtataggtgccacattttcttttcttttcttttctttttttttttttttgagatggagtctcgctctgtcgcccaggctggagtgcagtggcacgatcttggctcactgcaagctccgcctcccaggttcatgccattctcctgcctcagcctcccaagtagctgggactacaggcgcccaccactacacccggctaattttttgtatttttagtagagatggggtttcaccgtgttggccaagatggtctcaatctcctgacctcgtgatctgcccgccttggcctcccaaagtgctgggattacaggcgtgagccaccgtgcccggcctacgtgccacatttccttaatccagtctatcatggatggacatttgggttggttccaagtctttgctatggtgaatagtgctgcaatatacttacatgtgcatgtgtctttatagtagcatgatttataatcctttgggtatatatccagtaatgggatttgctgggtcaaatgatatttctagttctagatccttgagggattgccacactgtcttccacaatggttgaactagtttacactcccaccaacagtgtaaaagtgttcctgtttctccacatcctcttcagcatctgttttttcctgactttttaatgatcgccattctaactggtgtgagatggtatctcattgtggttttgatttgcatttctttaatgaccagtgatgatgagcatttttgcttatgtctgttggctgcataaatgtcttcttttgagaagtgcctgttcatatcctttgcctactttttgatggggtcgtttgctttttcttgtaaatgtgtttgagttctttgtagattctggatattagccctttgtcagctgggtagattgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctagaaacattcttttacaaatcagaactaaaacaaggaattccaccatcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactgagctataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattttaagtagagacggagtttcaccatgttggccaggctggtcttgaactcctgaactcaggtgatctgcccgcctcggcctcccaaagtgctgggattacaggcgtgagccaccgtgcccagccttaaggctatttataatttatcatagcaaaaccttattaattaaaaacataagcataaagaaaaataaaaacaaaaatacaccaagtattttcttagaatatatggaaaacatcttgaacatattcaggcatgttctacatttcttggtgagaagatatcataaaaatgtcacttcttcctcacctatttttcttgatttcatgtaattccaatgatttttgagttagtgtttatttaaaattaatataaaattcatctggaatatcatgagctgatcaagaatatccaaaacatattttggaaaaaaaaaagaagtcaatttaggcaagaccactcccattagattgcaaacatagatgatagatagatagatagatagatagatagatagatatcaaaaataatttaatccatgattctggtttaaaaataggaatatagattcatagaatatagtggaaagctcagaaatagatgtaaaaattttaaagaacagatatcataaaataagaggaaacaaaaattatttcataaaatgtgtgagataactggcttatactatggaaacgtaatttcatattttacattaaatataaaaataaaatttagactaattaagaaattgatatgtaaagcaaagtcacagaagaaccaacagaaaatgaagttgaacataatttgaaagtatgatcatttattttacctctgaagcaatatagtatgtaataacaaaagaaaaatattcatatacatgatttccttttacaaaaaataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttggcagcatgtttcaaaagtcataaatatattcattccgtttgaagcattaatttcagccttagaatcctgaggaaataacttgaaagaagaaaatccctaggcatgaagatgctcttgccgtagcatttatagaattagaaacctggaaataatgaaactgtttagcaataacgaatgattcagtaaaataagatatgtcgatctgataagagtgttgtgcagcaagcaattctttggccttgtgaatgttgcgggctaattgacaccccagctccctctgcatcccacctgccctttaagtcttcactccctctttatccagcttgattcacgaaaaagccatcagcctggtaaggagtcctatactgggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcacgcccactccatgctctcctccttctctgtggccaggcctcaattcccttgctgggccttgctggtcccttccctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggtacctccatccatcccatttgctcaccagcatcctccatatccacatcccccacttccagtcctgccccatgccacttctaaggggtaccttgactgcctcgttctttcccttttcattgtaccatcttagctcagtcatttcttgatgattccttgataccatgtgaccttccagttttattctggtggaatgttctatacttctactagtctataagctctttgagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattgagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagcgctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaaccttaactaattctaaagcacatttcacaggccaccttctttaatcattatctaacaatattagcaataaggaatagttgacaaatgtatcttcacacctaggatcatcaaggcacgctgtcttaaatgaaccccagatcaaagagaaacagatgaaaaaagtcatgtgtttggatgggaataattaatatcataaagacagaaatttttctaacattaaggcatatatttaatacaatttcatttagactcagtcccctcaacccctttggataaaatgaatatagatgaataatgctcaggaaatggtaagaaaattatgaaaatagagataaagcaggagagatttgccttatcagatgctaaatatatttaaaattacaggagtaaaaacttaatggcattggaatagaagtagatcaatagattattagagcagagcagagttcagaaatagattccagataaatggaaatttaatataggacaaaatgatatttcagttcagtgggaaaaggaggtttgtttttgtttaataaatggctgtgacataattgattaaccatctggataaagttggacccttatctcacactgtatataaaaataaattccagatggattaaagatataagcttaaaaaataaagcaataaagatgttggaacaattttatatttgtccataagctagagtttgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttatttatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaaggtatgtggattcttctgggttatttttgttataaaatcaaaaaaacaagggaacctcctgagtttagtttgcccaaggaatatgaatagttccccctctgtagactcactccctcactaccccctggttcccacttttgctctgggtcctcctcacctctggtttacctcattcatttactccaagaccccactatcagatatgcctggacaatgacaagagaagggcaagttggataggagagtgcagaaaagccagatagcactgggccgactacccaaatggtttagataattcagagatctgaaaagcaagaaatgccctgggtgagatgagaaattttaacaaccaatgttccatcagtttgagttcattgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagacgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaatagtatctggcacaacgtaggcattcacaatcaataaatgtttcttgaatgaatgaatggcttgaaggtggagaatggaccaaagaagggaaagactgaaagactgagttccaaaagatcacttggaggggtccaagtgagagggaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaataccttagactggataatttataaacaatagaaatgtattgcttacagccctggtgactggggagtccaaggtcaaggctccagcagattcagtgtctggtaatggcttggcctctgacttcgcagatggtgccttgttgctgtattctcacatacagaaggggcaggggagctctcttaagcctcttctataaggacactaatcacattcatgagggtgcagccctcatgatttaatcacttcacaaaggccccgtggcttaatactatcacattgggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcaccttgtaaagctagttggttgcttttagcgcctccatccgttgcacccaacccttcacctgccgttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacacccctttggtcctccatgcacacccctatcttggcacccaggttaccagagggaactgaaaccactcatatggttgtttccttgactgtgctgtcatcacctaaattattttacctcttccagaataactgtaaatgctttcctagaagaaatcatgaatattcatttccttgtgatatttccaaatagagttttgtgcctatttggtgcttgaaaaaaagtatgacttttgcagtcttcatcaccggacacttatagattccactggagtgtattttcactgggagtccctctgagctgactgtccctgtgttcattctactcacatgtatcaagtgtctgttcagaggcttttgcagagaggtcatgccagccctccaagcctctttgtcttgagaacagaagatgatcatttcacacacaccctctgtacgtgaaccgaattttatgtggaattctgactttcagagggagtgttattgctgtggagaaggaccttaaagtaagggtttttagactttgggaaccacacactaataaaatttcaatgagaaaattagggttgccaacggagtcaagccagcttcttattttgtcaagacttagatttaaaaagcaccctctcggccaggcatggtggcacacgcctgtaatcccagcactttgggaggctgaggcgggcagatcacttgaggtcaggagttcaagaccagcctagccaacatggtgaaaccccgtctcaactaaaataaataaataaacaaacaaataaatagtaccacctcctattcctattaattcaccaaaggaaaaagatattaataccttgttattagcactggtccgtggacagaaggggatttgaaaggtgctattctgtgttgtggccccaaacctgggctctatacaattgttccatggggagcaatgcaaccacaggttcctgggtccaccccaggcttgctaaatcagaatatttaggggcatggccctgggatctatagctttgtaaatttctcaggtgattctgatagagaactgggtttgggaatcactaccttggatagagcatatatgtttaaagagatacaggaaatactacatttctctaatgctgatttagtagttttgaaatccttgttattttgttcttttggggttttctaaccaatgagtaggttttcaaaggcaaataagaaaacctttatcacagatttggtgacagttgaccccaagaagatcgtggaacccagcccatggaaactacactttagagtatgttaggtaaatatttgcagcgtggatttttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcctagtgattattcatgggaggcttggaactcgaggtgggttcagtctgtttggaggcttgagctgtgcacttcggctgcctgatgcgaatggcctatggggaaggaaccacatactgattgaaatgttagcaaacagctggcacgctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacagaactttccaaaatgccttttgaagcatggtgtaatgggagataggagagccaccgagctaataagctccgctcgcacattctagccctgactagtaagctggcgctgcgagggagagaaatcccctgtgcttaagtgttcatacccacagggaaatatgtcttcccaggaccgagaggcagccttgaagtaagtaaagaagaagggacaagccaggtgtggtggctcacatctggaatcccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttcgggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcactgcatagtttgattgaccagttatgtgagcaccaaatgggagtttcttttgtcctggcctgggaaccatggtttctatggggaaaatgaatttgaacttgaagctgagctaggaggctgctcttgaatgattagaacaggagcccctgggcctcatctcttccactgaggcactttgaaaaagatgacacaaggcccagttcaattattgctaagaaacagaatggatttaaggagaaaaaaatacaaaaattgctacagaaagcctcagaagttcatgaaaataggaaaaaagggtgtgaattaaatagaattatatagctcaaagacagttgaaagaacgtagctcccccgatgcccactttaaggccagatgaaaggaaccgactagccccaggtcccacaacttggtaattaagaaccagacctcagacctaggtcccccagggagggtgagcgccctttccataggtaactgcttcctgttaggaaagcacttagtacagtaatcacaccctgggggtagaagaagcgagcaaatcacaaacccgtgtctagctcacttaggtggccggatccacgcaaaagccagtgtgtcctctccttccacggaaactgcagtttctgtagatcagaatctcagaatgtttcctcatttcttggagaaggtataaaacaaactgggtcccccggccctgtgctagcaccccttgctagagctaaggcttcctctggcctcccttggccctgtttccagatcaaccctgatttccctttttaacattccttctcataagtgcttttcaagtcctccacagtttacccaatcatgataggtgatttgattagtagaaacacaattcttccttaatttgattataaagcaaacacaggcacctcgttgcctctgcttgccagctaacactttctgtctcacatcttccaggcagttggcagtgtgactgctggagtgagtgagggcttcctgattttggaaggcagagtgggtagaggcggggagagagagagatccatctccagagggacttacctgagggtagacaaatagcagaactggattcagaaacagattcattgggttcctattatctacagaccagcaggtgacccagcttcaggtttccatggcaacacccctgcaggtgccattccggcccatcaacctgagggcttccaagagcagggcacaaagcctcacaggaatgtctgtccagggatttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggtaaagtgacatttttggtattgtaagtcttaaccgccgggcatggtggctcacgcctgcaatcccagcattttgggaggtcgaggcgggtggatcaattgaggtcaggagttcgagaccagcctgaccaacatggcaaaaccctgcctctactaaaaatacaaagttagtggggtgtggtggcgcatgcctgtaatcccagctactcgggaggctgaggcaggagaatcacttgaacccgggaggcggaggttgcagtgagccgagatcgcgccactgcactcccagcctgggtgacagagtgagactccgtctcaaaaaaaaaaggtttaaccaaaaataaatgtttgtgactgcctggtcctaccttctcttttatgtttgttgcacactttgaatttaccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatgaaaaatgatgttgctctggtcgaaataaaattgtaaaggtgactttgcggctcactggtgaagagctggaaggaagtttagcattccatctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaatgtgtatttctctcgccttctcacaagcagttattaatccatgaactttccttggaaatgcccgttattttcttcatagtaaattacataagcccccacgtcagtcatgtttgaaaagaggggacatgtcaacgtaaacatttctgggcggaacacatgtggctgtgcttacaacttcactcagtcaacaaaagttcattgagcatctatatgtggtaaaacacaaaaagaggataagtcctgccctcgctaaccttggagtctagcagaaatagacaaattaaaaatgacagctctggggagaaaagggctccattttccatttctctaatctgtggttttgacttctccacttgctgcttacctaaggtcaagtgcaaaggtaaataagtagcatattttgaatcattactgaaaagtttatagtaacttcaggtgaattaacaaccaggcagagggaatatgaatcaaatggatatgaagttaattaaaggcattagaaaagcttgatgctcaggtatctccagactttagcagtctctgaggtcttgttaagtaatgggctccttttctcatcccattggtttggaaaactaagacacagcgacaaggacttggatcaggaagacagtggctttgtggctttttctttttaattaaactttgttgttgttccagggtttgtttgtttgttttttcgttttgataaaatacacaaacaaaatttaccatttttattgcttttaagtgtacagttagttgaggtaagtacattcacatcattgcacaacctatctccagaactcttttcatcttgcaaaactgaaactctatgctcgttaaataataactcttcatctctccttccccccagcccttggaaaccgccattctaattttttgtctctatgaatttgactactctaggtacctcatgtaattgaatttgtctatttgtgctggcgtctttcacttagcatgatgtcctcaaggttcatctgtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcggtatatgcccagaagcagaattactggattgtattgtaattctctttttggttttttgaagaaccattgtaccgttttccatagcaacgataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctgggtatcaaccccctatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtaacgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcatcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcttccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttctttaaatatgtgactcagagcagaatctctcttttgtttgatagggaatggagtgttatttgtcacaggagggatttctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaagtataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggcccttttaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttcactcttgttgcccagggtggagtgcagtggcacaatctcggctcactgcaacctctgcctccccagttcaagtgattctcctgccttggcctcccaagtagctgggattacaggcacccgccaccatgcccagctaattttttccaatttttagtagagacagggtttcaccatgttggccaggatggtctcgaactcctgacctcaagtgatctgcctgcttcagcctcccaaagtgctgggattacaggcatgagccaccgcacccggcccctccatcacttttgaatatgcatttttgatctctcacaggcaatccagatgaatgcttttggggaccttgccttcaagagtgaaattaaatttcacatataccttgctgagtagcttctatgggcctagcatagagccgggtactgtagaattaacttacaatcattcatttattcattcattcaaaatttgtttgctgagcaactactatgtgctagacaggcaggcaaagtgtgtgactgcatggagcttacatggtagaacttataatattttggaggaaataagattcattttcatgaagcagttgcatgtgcacaagagaaaaagatacaagagagaatgccagaatgtactcaaatgaacagtggtagctaagattcgctgagcctgtgccatgccctgagctcagagtatctaagcctcacaatggacctattttccccattttatagataaggaaattttagctcagagagagcaaatggtaggtaagaaatatgaatccaggcaatctgactcaacagagttttaaccattaccctacattgtatgccctaaattgaatataaacattggttaaaccatactactgatgatattaataaaagtcagtctggaaaggactctaatattggcttctcttggcattagactgtcaaagcctgcccccgatccatgccacacatgtagggtgggagcaagacctccaacctggccaggatgtgggaggagtgtattaacctcaaagacatgggagaaaggggtggggcagggtgtggtccgagggaaggagtcagacccagacacggctgggcatctgctccaagacagggagagcagaataggcttagtgaggcaactgaggccctggggagaggggagcagcaagaatctcatgcatgagtcgaatcttggccaaagggtggactttgaggggctgggtttaaattagaatcagggccctccactggctgggaagagctgccctccctggccctggagttttggtcacccagtccaggtctggggagccacactcagaaggctcaaatgccaagaggaatagcaggttgttcggagggtgggcttggcagccaagtcagcctccttttagagtctgcagctcagagaagtgagtcttgatctcttcgcacagggcattggtctgtcaccttctatctggaagtctcaagctctgtgtccagaggcactgctcactattggcatttccagggccaactgaaatcacatctcaagttccctggagcctgtaccgaggggcccccgtgaaaaggcatttgtcccaggggctaagcatcaaatggataaccattttgttccatttcacactctaatttttcttgagtggacctgtattttgctattttctttccatatctcacctccttttactctttcccatttccacggctggttaccactcttaccaatttatacatttcattaatatattagttctatcctcttctcagtcattaataaagatgttaaataatcctgaaccgaatactcactcctgtagggccctacaggactctttcctttaattagttgtgctacctttcatctatctaatgtccttcggtttcagatttccagctggttttgaatccatgtgactttttatctagtcctgtttgaactaatttcatgagtgaaaatccgagagatgttttactgagtgttgattcaggtccaggcctacagagagtttgctatattcagatttttttttaacagattaatagagtacaatttggccttaataaactgagccctcctaatgcacctctttccaatattcttttcaatcatagcagtattttctccattaatgtcatggtaatttgaattgtgttgacgtcagacttcacaaaaggtactcttactgtcagaagtaatcctcttagaccttttgaaagataactatttcttagtggttgtgctatttccaatatcctataatgacttagttaaaaataaaaaataaaaaggatcgggtattctataaatctcctaattaaccagcttctaatgtgctttcttatacaaaacagggactgaaagccagagctcatagtagtttattaaataagttcaaattgtgcagccatttaaaaataaccctgaagtctttaaaacgtaacctacaggaagcacactattctgaggttaattgctggacaacatagggctgtgacggttatagtcaacggtattttgatttgaatacatagaaatccttggacatagagtgagggaggaatcccacgatagggctctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttaaaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacactacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactctagcagataatttcccccataaaatgcagtcaagtataacagaataattaaagtgaccctttcaggcccttagtgattctattaatacagggctaacgtccttcacaaagtgattaaaataaattctgctaccaaaatcaattctgtgtcatgttacatcattgctgtgatgacattaacaatgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagcagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagtaaggtggcattcacctatatggtatgaagctaggtagcaagggactccaagggacatgttcttgaccttaggcctgataaagtctattgaaactgggtagcaagaaggaggttgtggtatctacaaaccttggttggccacagtggtttagacatccaactacttgatagtaggtgactgaacaggttgatttcttgaggtttttccccctgcagtatcctcctggattcaaatagcctcactgtaacaaaaatatgactgctttcttgggaactgaatttatctggaatgacatttatttcaacttaacgatgagtctgtcattggcctacggtcaatggactctctttcttttccttgattttgcttacattgtgagcctccagaggctgtaaggcagtaaacattttcaaaactctagtgatacctcactcttcagacagaatatcagacttttcaactgtattttcaactgtcttgtgagacaaagactaattggtttgacctcatgctgtcacatgttgagagacatgaatctgcagccctcttccttgaattcattgatttcattaaacactgtctgcttgtgttcgcaaaatgttgtaatttcccagtgatttcttcgaactgcagcgtataaacagatttttttggagcgatgccatttcttagctttgatctcctgttttaatcttttctttccaataggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgaggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccctcatagcagtaaatttggaatatctgtgatcttgatgagaaaagctgctcattggtggcttgcctgtgttctgctatttgccagaattatcaagcacacattagaggctgtatctatgcaacataggtttttttgtgctgtttatcctggctaaataccttattgcaaaaatctttcattttatgtagcgaaatctgtgaagttagacacctgtgtattcactgaaaggcaatcaacttcatggaaaataagtagtttttcggagcattaccctgtttctgactctttatgttctcattttaattccgaatgtgtcttgagatactgcagttattaaattaaatgactaggagacctttctgcatgtcgcatttcagtaaccacatctgtgtggtgaagccaagttcacaagcagtcaacataatactcagttaatcctatacctgagcccaggctgtaatcccaagctcttttaatatggtacttttaaaatgggtaattattttaaagagaaaaatactagtagtggaatgacctacattttcacctctcttcttctgaaatttataaacaagtttgaattttaatgttcaaccactttatgataaatttcctagagctttgctctgaatataaacctgaaaatgtgcgtctgaggtggcgtaagtacaaactgactcagatgtttttgaatttgccttatcctaaagggttagtgatagcattaaagttaatcatcatgcacatggcctttaagtagtaataacagattctcatgtagcacggttatactgagcattattcagacacaacccaggcttaatgatttgtgctttagaggatcattgtagacacacagaggaagctgcaggtgacagcgggaatgtcggagaaagcttcgctctgactctgaaagggcgccaagcatcagctgttggacatcaggagcaccctggacagccccagctaagtcccagcctggatactccttagggagcatgttggccccaatgctgattgattctgagatgcctgggctcttggtttaggccccctttgaacagcagaatttccatctctgtctggtgctgtgttttaccctctcagtgcttgactagggctttttttcttaagctttttattatggaaactcaaacataatacaagagagatgagtgtaatgaacctctctgtagccattcccggtttcaaagcctatcaacattttgccaatcttgcttcatctatcttatctgggatttttgggggggcatgataagaaccaaacaccatatccttcactgctaaatacttcagtacctctctaacagataagccatagtgccattatgatactcaacagaattatccacaattcttaacataatgtaacccccagttcatgttctgctttctattagtacttcttcagggcaatggttacacctccttcctttcccacttctaagggcaatgcaaataagaaagataaaaatgtactaaagaaagaggaacccaacccctaataataccaacttgggtcactggcccctcatgagtcagtagttgcctgcagctgttctgctccttcatgaagtgttgtagttcaagtgaaattcatttgctgtcaccttgggtaatcaactgtgctaagtgtctgtgtcatgtgagagttctttttctactcttttctaggatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcaggtactttctagattcataatctttttctcattgtggttaaaggtcatatgcccaaagatcattgattttattcaagtaaattcagaaacagtggtcattccaaattcctctcaccgagttctccttaggatttactcctagaaaaatgcatacctgacaagacatttgcttcccatgctcatcgtgaatgctatgagcacacctttttcccttcaccatggctgctgagaaactcacagctgaaatgtttgcctaggtttttgatatagatatatgacactctttactatgtgtccctcctgcttgtgataaaaggcttctttcttacctctttcattttatagactttagatactttaagctgttttgaattctttgggggaaatattgggagctatcaaaatgaaaagcagaatcaaccttttcaagatgttccctaagggggagatggaaaccccaaaataaactctcccagataaatccaatatgttaagaaaaacatttatctccctagttgaatttttaaatttattactattatgtattttttgcattttcatgggtacataatacttgtacatgtttatgggacacgtgatgttttttctatgatcatacagtgaatatgtaatcatcaaatcagggtaattggagtatccatcacctcaagcacttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctttctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagtacgaagctaattttcaaagtactctctaggtaaacctacagacaaaaagctttgttaaaaaaaaaaaagaagaagaagaagaagaaaaggaggggaagagaaagaggaaaaaaagtagagaagaaaaaaatcacttttaatattcttatttaagatcaagtgagaggtggctatattagtttgctagggtggacataaagtgccacagcgtttgtggcttaaacaacagaaatttctttctccccggttctggaggctgaaatcatggtgttggtaagattggtttctcctgaggcccttacaccttggcttgtagatggtcatcttctctctatgtcttcacgtggtcttccctctgtatctctgtcctaatctccccaattttttttttttttttttttttttttgtgacagtctcactctgtcacccaggctggagtgcagtggcgcaatcttggctcactgcaacctccgcctcccagattcaagtgattctcctgcctcagcctctctagtagctgggataatctcccctttttataaggacatcggtcatgttggattagggcccaccccaatgacttcgtttaaccttccttacctctttaaccacccacgtctctaaatacagtcccattctgaggcactgggagttagggcttcaacatacattttatggggacacattttatggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctgagccacagcagtatcctgctttgctataaagtaagaggctccctactgttctgtcacctgcgacattctgagcctgtgtgtcttggctgctccttggtcactgtgccttgagcaagaatgtggctctaaatgctggccatcgggagatcacgcttggctcggttttctggtaatggctacagactggcatgaggccaactcagcccttccccattgtggctggaggattcagagatcagtgtcttctctctgccctacacaaattgggttgctcaggcccacctcctggtcttgtcatcaggggctcagctggctgttggacctgacgtacccaggctcttgtcccctagaatgagtgtctggtgacctacgtgaacaggggtgcaagggcagacagagctgtggacagctgtttctttcacacccagtgaccgctttgcttatatgcactgagaaacgtgaagttatttggcctggttttagagagatggaatgcagctgttatttatacggcgtaccaaataggaatttacactttgcatgtcatctgtaattctaccttgcccaaagtgtttcctgtctctctaaataacataccattggtaggttaggagtttgattttgaaaattcttagattgaagtctctttatatagattaaacagtaatcaaacaaaattctgtttagtgaaaccttttcaaggtacagctcctgatctgattatatgtggcgatatgacacaaacaaaattcaaattccatcaaagaatctgggcattttcctagaattaaaataggatctgacctgaatttttatatttatgcatcttgaaacccatgaatttgtggctggtatcctgaaaagattcccaaaattgtcctgtatttgaaattaaaattcattaatttgctctcaaacataattgggtttaatattaaacatgaataaattgatagctttgttcataaatgcaaaatgcctgtgtgttagctatgaaacccttattgttgcttttattccttgcagtggtggtcaaaatataaccatgatgggcagaaattttgatgtaattgacaacttaatcatttcacatgaattaaaaggaaacataaatgtaagtctccagctgctttgtaataatagttgttttcaaggatggttctattttcatcacactatgctatgttgggggtattttttgtttctgtgactttggtgttataaacttttacctatgctatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggaccctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttgtggtgcacacattcacctgctgacacagttcagagccacttccaagcctcacactgtatctgactccaggcctcatctccatggtgtgaacacctccagttgaatggctcgtatagtttgaccctctgagcagaggcattacctgagtttgtcacggacttgctctccctcctacttgctgttcccaaatcaagttgaattttttgagcacctactgcaggcaaaacattttgctgggtgcagggacaaaagataagtgagatagtcatattgccttcatggaggcaggcagcaaatctacattgggattgaaagttgaggctgggtgtggtggctcacgattataatcccagcactttgggaggccaaggcgggaagactgcttgaggccaggagttcgagaccagcctaggcaacatagtgagacccccatctctataaaataaaaattaaaaaagttgacagcacagagtatcatcaggttctaggtcctctggttccctaactgttcagaaaccctgtgagtccaagaagacaccatttcttttcacattaaagagaaattaaacatgcatgggattaagtacgcctgcagtatggagtggggtgggtggaagcagggaggtgagttcaggtacagaggacagagtcctcgcaggcccgtgctgggaacatcactcaatcctgcttagtgggaacctagagggtgggtctggaatgaccaagagcgatagctgtaaaactgagctggggccacaaaaagcagcgtcagactgaaaactttgcccttaattctgtaggcagcagggagccactgaagatctctgagcaggaagtgacataggtctaggtacactggactcacactggaccgagacaattagtgacaatgaaagcagtcagaaggttaccaatgggaaaagagactatgcagaaagcagtagactagggaaaggggaggattctgacccaaaaggcttcggtgtcctgtcttgagtcctgggaaaccacgagaaaagaagagagtgtccaacccccagcaggggccagctcctgaagtgcttgttgccgctgaatcactctttgttggggaacctcctgcagggcggttattattttggcaatggtgcacagctgagtttggagaggcaggaactgaagaaaggctgggagcccagtgaggatgctcatgccagtgcaggtgtgtctgagacgtccacagtctctctgggctgacagtagctccctttgggctgtggttagcagagcaggtctcaagtgctggggcatggtgaagctagagatgaccagcttgtctttatagcagtatcgttgaagggagagtgggggtgacatcatgggagtgagagcacagaggaggaagaaaagagcacctaggactggtggcaaagcttcattttaaggaatgacagacagtaggatgggccgtgaaggtggccgagaaggtgctcagaaaccagtgaaaaagagtaaatcgcatggcgcgagtttgtcacgagtatggaactgtagagtcttgaggataatagggttgggtgatcctctcacctgcaatccttctagaaggcatcttcagtaaaaagccagcctgctaggagttaaggctgctgaggcagtagagacagtggttttcatcctgaggacagaaatgtgagcaggagattcagggctatagtttggaaagatgtgaagggaaaggaaggttgtgcttgtccaaatctcagctctttacatcatattttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactatgttacccaggctgatctccaactcccaggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcacgatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaagtatgtttcttttctttctgggtgggatgtcaccccgaccccttgactggaaaggtgtgtttatgctcgtgagtttctacatgtgctctgatttctccatcttcattttgttctttacagaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtaagtgacctggcagtcccacctgctgtctttacctgatttttgtgataattccttggctaaaccagaggccagaatggaatctttcatggatcttcagatcctcactttaaatagaagataaacaaagctggtactgcgagcccaagcaaaatagctccaaaatagctggctgaatccatccctgtgcctgttcgaacgtcaaagcgttggacacaccattgtctataatcctaatgagtcttgatagcttttgttctagccacacatttatacagtaggatcggcaagcaaaatctctagacccattgacaaatgagctgtcactcttttctcaaatgcggaggtgacatgtcttagcagaaacccaaaacaaacaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgcaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctccgcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagcaggaggatcacttgagcctctagaagtctgggcaacacagtaagaccctgtctcaaaaaaaaataaggaacaacaactcaactcaccagtgttcccacctttcctgttagttgagaagagcaaatgctaacattcttcatcattcatgacatagctcctgagagcctacgctgtgatggggacagacagagaataaaacagacaaaaacatctgcctttatggaggttccctaaagagacacagcgtgaagaatataaataaaaattgtgttacttggtggcagttgctatggagaaaaaaagcaccagtgtgggggggtgggggggtgggaacaggagcaggtaggggggccatgctgcaggttttgcaacggtgggcagaagaggcctgcttgtgaaagtgacatctgtataaggaggagtgggaacaagccatgggctatctggggtagaacgttctaggcagagggagcagagggagcagaggtcctgaggcaggaggctgcctggcatgtttgaagagcagcaaggaggccagtgtgactggagtggagggagcagagcagaggcttctgaggttagagagttcatggagacaacaggagatgattagaaccttgtggaccatggcaagggcttggcttgtgggctgcagaaggcatgggagagttttgaggagggcgccatgagctgacttattcagatgacgtcatgaatttagtcaggacagcctaccaagaggcactcccaacatcccatttcagagatgaggaaaaagaggactggatgtgcatacctaattcagggttccatagctgagaaacagagcaggtggcagagctggtatggagagcttcagctatccgggtccaaatccatcctccagctactgtgctcagatgcctccacgggggcagcatgagtccaaggatggaaacacgccttaatacttgtatgtacatcagtgaaataattaagcttcatgtagagtttttcccttgacaagtttcacaaaatataacccaaaaaaatgctaaaactggaaaaatccctcagggatgatctgatcagcactgccaatctggtttttgccacagaatgttttattcaaaataggatgccaggtacagtggctcacacctgtaatcccagcagtttgagaggctgaggtgggaggatcgcttgagttcaggagttcgagaccagactgggcaacatagtgagaccccgtctctacaaaaaatttaaaaattagccaggtgtggtggtgtgtaccgtagccccagctacttgggaggctgaggtgggaggatcacttgagcccatgatgagttcaaggctacagtgggctatgatcacaccactgcactccaacctgggcaacagagcaagactttgtctctaaaacaaaaacaaaataagcctgcctgtaaaaatgataaaaattgagtttcttccttagaataaagggcaggcaggggcttcttgcctacaggttactactgcctctttattgccctcactcctgcaacttaaaacccccagagcaaagagggccaaaattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacatggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagccgggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaattccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgattttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctagagagagggaatgtgctccctaggttttgaccacagtcgccaccactccatattgtctccacctaggccatttaactcatctatgtacctgatatctgtagccatttcgtttgtgactctggttctgagctgcttgtcatttgaagtctattttctctcatccttctttgaaaaaggaactcttatccaccaacaaatagcactttggctgggcccggtggctcatgcctgtaatcccagcactttgggaggctgaggcgggtggatcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacagctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaagactgttgactttatgaagtagtccagtgaagagccatatttgtttcctccagcattattggtagcagagcccgtctattatgtaatttcttttttttttttgagaaagggtctcacttttttgcccaggctgagtgcagtggcacgatcacggctcactgcagccttgacctcctgggctcaagtggtcctcccacctcggcctcccaagtagctgggactccaggcatgcaccatcgcacccatctaattttctatttttttgtagagacagaaaaatatctttctctgttgcccaggctgatctcaaacccctagcctcaaggcatgctcccacctcagcctctcaaagagctggaattacagacgtaagcccccgcacctggctgtaatttctataaggaggagaagcttcctagaataacagtggttgattgttgaatacctatacttttttaaacaatacattcttaatgctttttgtgagttacttcttataatcctcccagcatcacagtgagataggcactcttacagagaaggcagccaggcacagagatgctgaggaacttaacccaggtcacatagctagtaaatggcagagcaaggacatgaacccaagcaccaaactgggttggtttatggcctctgcagcacagttagaagcaatatggaggtatgggagttccttgtggctcgctcatcatgtcaccccattagctctatgcaggtttggcccatgtagccaactgtggatctgcggttcctttctacgtttgcagcacaactttatttctccagggatgcttacaaacattcaaaaacaatggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagccaaccaagtcattatctattgtttcttctttaatgaaaaccaaggtcatactctgtgttagacaaaacagcagaagatcctatccattgtttgttgagttaaaatattgctcttgggattctgttttgcaggctttgctgagctgcagatggataaattggatgtggttgatagttttggaactgttcccttccttgactacaaacattttgctctgagaactttcttccctgaggtaaaagagcattgatcatattccgaaggtcgagtcttgaataataatgaaggtgcttgttgctgttgtcaaaacgagtgtttgcttccaaggcagctataatgtgcttggtacaaaaataatggcttaagtttgagcagagcagggaggagggtaattattaattgcattgattagggtataaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctctttggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaactgggaaagtcataaaaattgaagtcagaagttgtttaaaggagagaacccaggaaaaaacatgcataaatttgtcagaaccctttcaagaagacctaagtcaaaactgattttataataattaagaaaagatagaacagggaaacagatcgtaagaagacaatgccacttaaatgcattccaggctgcagataagtcctggtattaattaggctctttatggattgatcagaagccgaatcctctaggcctggaggttgggggctgtgggggtaggatttgggtgttcagcacctacaaaaaagcaacaggcaaaatccagaggagattgtaggttctcaaaggaggccagggttctttgctctgcctgtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccagggatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaagaattgcttgaacctgggaggcggaggttgcagtgagccgagatcacgccactgcactccagcctgggcgacagagggagattccgtctcaaaaaaaaataaagaattgcttgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatcaaaaaagaagaaaaacttgaatgttttgagtttagagtctcattctgtggacttaaagtattgcttaacatacttttaaagtttaaccattgatttttaataagattgatgatacactataaaccctttttatattccagagctacctagcatttagaaaccagtggggtgatagcattgtggtctagtttgctataaattaggaataaaaccagtaatgataactgacacagggcacttactctgcacccattttattttcacactaaacctctgaggtgggaaccattactgtccccatttcagagatgaggcaagtcagacacagagaggttaggtaacacatcccacgtcatgtgaccagtatgtgattaaaaccaggactggaacccaagtagtttggtccagattctatgcttttaactaccccctgtctttcaatatcattgtgtattgaaacagtagatgctacttaggtaagacttgtaaaacttaacaacgtaatttagtctttatctttagaaggtaaattgcttgaagaggggtctgatatttgcataatcttcatcaatgaccccttctttaactcttaaatcacttcttctaaaacgtgggatgataccttcatctaccaaacctggaactaatgccatgataattattattcttagaggctttcggaattcagtggcgtttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctctattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtattagtccattctttgatgttttaaaagcctttaagaaaaaatcaggccgggcatggtggctcatggctgtaatcccagcattttgggaggccaaggcaggcaatcacttgaggccaggagttcaagaccagcctgaccaacacagcaaaaccttgtctctacaaaaaaaaaaaaaaagagagagaaatcaaacctgagtcccatattttatttccaaaccactatctgaacttggtatcttgagaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaactcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaactcccatgggtgtccagctaggcctgcagccaatggttcacccagctctctttttcaacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggtaagtgtcacatccctcagcaatgtcagaggtaagacaataggcagttatttttagcggactctgatgcctttgccaggataaatcctgaatgctcgatggtgtcagcacttaaccatgtttcgtcttggtcctgacccagaacagagagagggaaagtaaacattgtttttgctgcaactggcctatgcaaatgtaattcatttagaatttcgtcaggtgagacttttcaggtgagtttaccttctcacgtcaattcacacccagagcccagtcagcccatttaagaaaatgtactgagaaaagggaatatttcaaacaccagagaacaaactgtttcaggccctctgaagcattgtagaaatacccgttgcctaccaatatgctgtaagctaattgcagtcaattcctaccagtcattccgcattaaagcagctctccaaagagctgcctccccctggagtttgctttgttggagttactgtgtgcatgtggttgtcactaattgaactttaaaatcttttcaaatgcaaactttctatagattccagtggagaagagggtgggccctaaagtctgctacttgatctgaatctagacttcaccacttacttggttttataaactagagaattggaagaagattttaggactattttgaagtacagatgagaaaacataggcaattgcttagccctaaggaagcctccataaatgttggccgttacgattataaaatattaatgtgaaaataagggtgtcctgttgaactcgatcttcacccagccctctgaggcccctggtacagaagattcttatcctttaattttaccagccatccagatttcagcaaaactgcataattgtgtatttgtagctagttccgaaatctaattaaactttgaataagatacactgctatgccacaggttttaacagtgctacttaagtttagatccaacagcagtgctttaaatagactgtgcttagtttaatgtttaatgcaatcttacaagtagatgcacaacaattttttttttaatttctcaccaacccctccctctccctaaggcaatacccatttattaagattaatgaaatctgccttcttttctgtttacttggtataaatcatcggaggctttggggagatgttgagccagttatttctgggacgaatatttttttgtttcccactgtctttgctttagccacaacagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggcgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgttaacccgggaggcggagcttgcagtgagccgagatcccgccactgcactccagcctgggcgacagagcgagactccgtctcaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagagaggtgaggagagggctcgggtgtgaggcttcacatgttggttccttctagacactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctggatcctcacatggtggaaagggcagggcagctctctgaggcctcttttataagggcactaatcccatttatgaggactctgccctcatgatctaatcccctccaaaggccccacctccaagtaccatcaccttgggggttgggatttcaatacctggagttagggggacatcaatattcagatcatagcagcattaaagacaagatacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggctcagaggtcacccagctggcttgcggtggactgggatgaaagccaggagtctactggcttctactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcgtcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctacgcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccactgaactccagcctgggtgacagagcaagactccatctcaaaaaaaaaaaagtgacctctggcatggtcaatatggggacctcgtaaccttccctgtcacctagaactgcacttctgggactctgtggtcctattaataaaaaagataatcaccaatctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctcccccagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacacagatgcccaaaggggcagaaaatacataaggggtgtcagccgcctgggactacagaaagcagtggagcttgacttaatgggaaaggactcgccatccaaggagacagtgccatttgcttcagtggttgccatgtggactacagattgtattactagactgttcgattttctttttttaaagaaatcagatatccagttttttatatgcaacttaaaaacttttaaaaaaaattttatagagacagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacctaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaagggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagatgggagttttattattactcaaatcagtctccctgagcgttcagggatcagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgtgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattgggatattttaaaatcccccatctttttttttttttttttttactcttttggtgatggttgctttttttttttttttttccccctaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttcatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtggactgtcttttttttttttcaattttctagttataatagtttttttattctaagtggctccgtggaaattatttttcagagataaggtgtcactgtatatgctgtgaataagcagctatattatgtagtaagtaaacctagtttgctaaatggtgctaaggactgctcaattacagtcctggccttcttcactatcaactgggacttttgactatgaacaccttgggataatgaacattccacttaatttgggagacttgagctttagcctcgttaacatgaaattattccagcagaattcctctaaaagatgtcacattaaaaaggcttccaatgggtgtagaccaaaaaaaatgagagcatacttagggacacaaaacacataattatttggttagatccacagtaatgggaagtaaagttaaataccaacaatgtttataaaaggacctgagttcaagttttataatcaatggcccccttgttaatacagccataggatttaattatttgcacttattctctattctaacaaagccaaaatcagtagactgtcatattgctaaatatatgctatatggttgatgtaaaattaaacacacgattaaaaaaaaattaagctctttaattatgtgcacacagattttagaaaaggtagccttttgtatatagatacctttacattctttaggctgacttttaaattgtcatcttttttcaactacagtttttgtatatagtaaaccagaagatgtgtatggaccctgttatggccaagcatctcaaagatgaagagagaattaatgatagttatatttcactcaaaatgccaaaaaaaaaaattcaacaaagtaaaaattttaaaacttgactctaactagttcctttttgttttacattctcaaaccattgtcaaatattctaaatatctctgagaatttctcttttaatgcttcacttgtataatcttaaaatcctgacagtcatacaatacagcatgtagtaggtaccttttcttgaggcacattcaagtgttttggcaaacagtaaaaagtatctaaatgccacaggttaaaatgtcaagttttactgagtcaccaacttcacctcttttgatctgcctgttctccaagaacatcattctccggaagatccaagttcctctagttgttttctttgtgttgtttccagttcttctagtcttttgcgaagtagagagagttccctttgatgttgttcctccttaaaatgatgtagagaaagcatagcaaaagaaactattagaaaaactgttaggtagcaaccttggactgcctcttttatatatgcctataacatctggcaaggaaatgctgaccactgtagcagtctaaaaacagtagcatgggctaaactaccatctagttttgcttctctcctgcctcaggctctagccttaagcaaaacccgtagtctgttcttctctaggtataaaattcaccagggagtgaattagaaaatactaatgcagggcccaggtatacttacatggtaactttccaacaacactggtgtttaacagcagtttattataaacaaagcacttggcctgagattcaattcagtgattaaaatcttctgtgcttatgttataaaacataattacttattaatactcccatcttctgaaaaagaatcaatctgattccttcaatacctcaggggcttgatacaatagaaagagcccgggttttggattcaacaggtttaggtttgaaactttgtcacttattagctatgaccttatgcaagtcacttcactctgaatcagtttccttatctatgaattaggaatagtaatatctgccctcaaagcatttttcgttagtattagacattgcacggaacatgcacagttcactgcgttagtaaattctcagtagtaattactattaacattatgaataagctacaaactctaggttactcaatgactcaatcaagtttcctcttttctatcgtccagtaagagatttcactctcagcaccaacactaaaggatcatgattcaaactgaattcagcaaatttctatgctaaatgaaagggaagaagttaaaagtagttttaaatgtttatgccatttttgtggtgaattttgagcactgaccaaagttataatttgagttttatcaccatatttaaacataaaaacctacaaaaatgtacgactttttttttccccctaaaataaatgctcatacctgcatatgaggaggaaatggtagttccatgcttggaaccatggctgatgactgaaagctaacaggattgatagatgctgttggaggcatgttaggaaccaaaattagacttcgaaattcattatgtcttctctgtatatcttttagtcttttttgaagccttgtatagtcttcaaaaggaacattttgtcttaaaaagaaaaagaaatgtttctttaacatggttataccctattgaagcacagtatgattcacagaatataattttaaactggaatttctaaattatgagatctatatataatatatagataaaaaatctgtttacctagaaagataaacagaaacatgacataacatcttaatcattagcaatcattagcattgcagactatcaactcattataaagttttatttgctaattaaagatctaaaatcttttgatactttggtactcactcctaccctcctactcacccccattcatgaatcctgaaactaaagggagactctaaaccaaaagagtgccttatcttacagaaagaatcaaataaaaatacagttcatccctcagtatacacatgggattagttccaggacatccctcatatatcaaagcctgtgcatacaagtcctgcagtcagccctgcagaaccctcataatggaaaagttggttctctgaactggtgggtttcacatcctgtgaatactatattttctatccatgtttgcccgaataaaaatctgtatataagtagacccatgcagttcaagcccatgttgtcaagggtcaagtgtaaagaaaatgctggattgaagcttacaaaattgccatttttaaataggtgaaatatggtcaaatatagagattttcatagttcaatctaattttcaaaatgtcagtgtaatattttagtaagaaatatatatttggtctttgcccttggttcctggcacacagctcctaaaactctgggaaactctgaagtgataagagtatcttttgtatattaataagataactggtggctgggggcccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctgactgctcatctatatattttgtaatatcctttctagtaagctggttaacataagtttccctgagttctgtaagctgctctagcaaattaactgaacatgatgagcaggtcatgggaaccccaatttatggccatttttagccagtcagaagcacgggttacaacttggggcttatggctgcattctgaagtggggggcagtcttgtgggactgagccctctacctgtgggatctgatgctaaatccaggtagacaggatcagacctgaattacaggacacctagctcgtgtccactggaaaactgattactccatgtataggaaaaaaccccaaacatctggtgtcagaaatgttgtgttgactgtgtgagaataggaaaaacactggtttttcctattataaaaggtaatcacaaaggtgaagctacacaactttaggaaaaaatgacatggagaaaaaggctaactttccaggccttcacagatcatcatctttttggacacgacatccagtaatcaaatataatttcaaaatcactcaaaattctagatgatctgcaccacaactggccaatcttgaattgctaacatttcaatattaatgtttatggaagaggaagtaagttgaattctgttttagaaggactgagccaggaatggtggctcatgcttgtaatcccagtgctttgggaggctgaggcaggagaatagattaagcctaggggttcgaggctacagttagctatgatcgtgccactgcactccaccctgaaccatagacgaagaccccatgtttaaaaaaaaaaagaattgaaacaaaattcaaaattacaagcatgtttgtaatttacaaattactaccaaattaataaactaaaggcggcctcctactttggaatagagtattgtaaggctggcactaattctacagtctagaaacttctagaatgttctttaaaaaacaattgttcacctgttggtaataattgcacccaagaacaccagtgcacatcataaaacgtcactgcatgatattataggcagtttccattacagaaaaatctatacttgaatagccaaggcgctgaaggctaccactaattcactaaattaaaaagatttttcttaacttgaatcaaatgtgtcatataatgccactaccaacaacttaatatgacaaatctctgctttaaaaatgctgatgatcctgattatcagatgtgcttgaatgtgactgcaaaacccgaaactacagctcaataaaatctccacaccaggaaaccaaaactgacctttgattcaaagttgtaggcacaattttcagaactatgcaatagctacaactgtcttgtacagcagcaacaactaacaccactccttgctaccaaagccagtgacattttctgttagtcccaatcataaggcaaacacctggtatgtgacagagaccttttggtttaaagaaacattcagttagggggtaaaaaaaggatagtacattaggagttatcaagctgttttagaaatctttaaaatgtatattttaaaagaaaagaaggtacgttatacttagagacaaagttctatgacatcaaaataaccacatggggaagatacacatacaaacacattacctatttaagacctgattttctgtttccaattcttctttctttgcctccaagacttctactttctcttgtagtcttttcaatttgttttcatgaagagattttctctaaaaagagaaatatgaacaagtatgttaatacataatctcttatttgaacaaaactatatagaaaatattttactcaccaaaaactgtgtttagatatgaatgttttcagtgaatactagaaacaaaggttagtagacatggctcttactgaaaattgcaaagataataaaccacaaatctatctaatattctcaatgtgacaattaattatgaatgccaaacaaaaaaactgttatcaataattgctgcaaaaaaaaaatctacaaagggaaggagtcaaattttactactgagtctgcctgtacatctggtaagaaataatgagctctccattgttccagaagatagcatgtgtttaagagaactgagccaggtacagtggctcatgcctgtaatcccagtgctttgggaggctgaggcaggaggatggattaagcctaggagttcaaggctacagttagctatgactgtgccactccaccctggacaacagatcaagaacccattaaaaaaaaaaaaaaaaaaaaagggtggggagccaggcacagtggctcacgcctataatcccagcactttgggaggccgaggcggacagatcacaaggtcaagagattgagaccatcctgaccaacatggtaaaaccccatctctactaaaaatataaaaattagctgggcgtggtggcgggtgcctgtagttccagctactcaggaggctgaggcaggagaatcacttgaacctgggaggcggaggttgcagtgagccgagattgcaccactgcactccagcctggcaaaaaagcaagactctgtctcaaaaaaggaaaagaaaagaactgaagtaaaattcaaaattacaagcacgtttgtaagttataaagtactaccaaattaataaaactgaaggatcagaaagctaagataaatatggatgcatctgtttaaaagttgcctttctaaatcttaaaaggaaaaaatttaaactttacaatatacaaagggagaaattcctaagtaaatcttgtatggtttcattaaacaatacggaaaagtccaggtaaaatgcaaaaggagtgtatggaaaaaagtagtattttttttcagtttttatacacaggccttttgttttttaatagaaaaacacctaaaatgttaaaactcatttagtcgctacaaaccttttaggtattttctaactcttttttaactgaagtataatcttacagcaaaatgcatagaatagaaacgtaaagctcaaagaaaaaccacaaaacaaatgctggcatgatttccttgtaggtcaagagcactgccatgccagaagggcccctacctttcccccttccaatcactagccctgtcatcctctgaaagggtaaccaactaatttacttccaaaactatagtttacttttgcctatttttgaacctcatatacatacaatcatagtatgtagtcttttattaatgactttatttcactcaacattgttagtgagatttatgttacttacagatatacttcattcattcccacatattatattccacttacgattattgcataacctagtatattcactcagtacaccgttaagggttatctgcattatttccagttgggactattacaaataactctgctacgagcattcattctcatgctttgattgtcccacatcctccaacatctcagaaggcttccttatgctcctgtctaccctggcaaaggaaccactcttctggtttttatcaccataagtatttatttatgaatttataggcagttaaggagtccatctgtctatccatccacccattcatatgaaagaaatcataaatttatgctcttttgtatctggacttttttctcaacattttatctatatgactaagccatggttatgtattgtcacagtacttctttttcattgcaatgttgtcattcattgtacaaatataccacattttatacattttcctgttaatgaaaatttaaattctttccagtctggggatatcataaatattttacgaacattcctaaacatgtttttcgcagattaagtacctcattctcttcagtatatacctatgaatgggtcatagtgtatacatgttttagctttagtagatactgccagttttctaaagcagttttaccaattacatttccaccagcaatatgtgagagttctagctgttctacatttttgccagtacttggtatggtcggtcttttagcttttgcatcctgttttggtgaaatacagtatctcactgtagttttaatttacattttcctgatagctaaaggtattgagcatctttttttatgcatgttagtcatctggatatcccttctttgtgacgtgtccatcctagtcttttgtccattaaaacttttgagtaacctgattcctactgatttgtagttctttatatattcaagatatgaatcgtatgtcagatatatatgtattgcagattgaccttctccagcctgtggtgtcattttcttttgcttaagagtatcccttaataaaaagattttaatttaaataaaatcaattacatcaatcatgtattttatagtaggaactttttgcatcctgcttatctttattatcccaagatcctaaaattttctcccaagttttcatctagaagctttattttttttttttacctatcacacttaggtgtatggttcatttttatctatgttgtgaggttaggctgagtttaatctattgactcactactatttgaaggaacatcctttatcgaaatgcagtggtacctttagtgtaaacctatttctggactctatactgttccatttgcctgtttatccttatgccaataccacactgaattactgtagcttatatttagtgttgatacctggtagttttaagtcctctagttttattgttcttcaagattgctttgggtattctagtcctttgtactttcagatgaattttagaatctactttctaatttctacaaagaaacctgctgagattttgattagaactgcattcaacttatggataaatttgggaagaactgacaccttaatattgaatcttccaagtcatgaacatggtacagttttccctttaggcatttttccatttttcttagcagtatttgtatttcagtgtagaagtcataaacatctttcactagatttgttcctaggtattttaggtatttttatgctattgtaaatggcatttaaatattttct

SEQ ID NO: 1439 - DNA, 5554 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtttccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcattaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttcatcgaattgctgttcacactggag

SEQ ID NO: 1440 - protein, 1568 aa, Homo sapiens
MEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 1441 - DNA, 23377 bp, Mus musculus
  misc_feature (1)...(23377): n = A,T,C or G
ccttcctgagcaaaggtctcaggaagagccagaggccagtatgtggggtttggattggggagttgggaatggaaggcgaggcgattacttctaggcaggatctcacagactctgtatggtttggatctttttccttccatnnnnnnnnnnnnnnnnnnnnnntgtatggtttggatctttttccttccatctttgggggtaagcacttgaatatatctaagtcagaaagagttcaaagaaaatattaaaactaagtatggtgacaagtgcctttaatcttactgctgatggaataggggtaggaggatcgcaagggaagtggtagctagcctagactacagaattctgtctcacaaaaggaaggatgaagggagttcatgaaataaatgtagtatactatgattgacagatttacctagtgtttttaacttaacaggtttcaggggtgcagatagggcttagtggttaagagtccttactgaagcagggctttggcttccaacacctacacagtggctcaaacccatccataattccaattccaggagatccaacattctcttctagcctcatgaggggaccagtcatgaacatggtacagagacatggattcactcaaacactcatacacataaaaaaatagtattttctttaaaagaggtcataaaggagctggagagatggctcagtaattaaaagcacctgctgctcttccagaagaccctggttccattctaagcacccatgtggtggctcacaacgatctgtaactccagttccagggtattcattggacatcgggcaaaacacacacatgtagaagcaagcagatctctgcgtattcaggcccagcctaggaagtaagttccaggatggacaggcctacacagagaaactctgtctcaaataaaacaacaacaacaacaacaaaaagaaatacaggtagacagcaagcaagaaggaaagaaagataaagaaaggaaggaaggaagggagggagggaggggggagaaagagagagagagagagagagagagagagagagagagagagagaatcgagagaagttaaaaaggaaaggaatataaaaatctttacttggccagcaaggtgtggaaagtttatactcttagcacttgggagttggaggcaggatcaggcctttaaggccagtctgcaaacacaaaacaataccccaccccatgtataaatctccccatacaagccctttgtttgtttgtttgttcggttagttggttggttggctggctgggttttcaccgtttgtctgtgtagccctggctatcctggaacttcctctgcagagctggctgtcctggaactcagagatcttctgcctctaagtgctgaaattaaaggtgcgcaccatcaccactcaaatgcatttggattcttacatttgtttttattcaataatacagacgggaaaagagtaaaaaagaaaaagaagttggctggagagatggctcacagggcccccaatggaggagctagagaaagtactcaaggagctaaagggatctgcaaccctataggtggaacaacattatgaactaaccagtaccccggagctcttaactctagctgcatatgtatcaaaagatggcctaatcggcggccatcactgcaaagagaggcccattggacttgcaaactttatatgccccagtacaggggaacgccagggccaaaaagggggagtgggtgggtaggggattgggggggggtatgggggacctttgggatagcattgaaaatgtaaacgaggaaaatacctaataataataaaaaaaatattatgatgccaaaaaaatacccattctaagtttctaaaatattttgggttttactcctttaaaaaaaaaaaaaagaaaagaaaagaaaaagaagttaaaccctacaacttcccgtcctaattgttagggcaagctccattatgtcttctttattttcaaccctctaattttatttttgtctgtatgtgtgatctcttggcttttgttaattttccgaaataatgtatgtagtagtcagtgtcaaacttgggatcctcctgcctcagcctccccagagtgggtctgtagatgtctatgccccgtgggaacttcagcgtgtttgcttcatgctgtattctggctcactgttcactcagtttcagaaagggacaaagaaaacaaaagatcactgacctgcttcaggacccattccttcagagagtaaccagcctgcagctaatggagccacttagtcctatgtctgaattctgccttttttccaccctcgtaactattagatttccaaaggttgttgggaactatctctatacagccccagttaccctggaactcattctgtagacccggaagactagcaaattcctgtcttgagactccctgcctctgccttccaggtgctagggtcaaaggtgttggctaccacgccgtgcttggaaactactacagttttctgtgattcatgcttatttggcctgccacagttcactatggtaaaggtagcttgtagcacaagccagcaaacctaagttcaattcccagagcctgtggtgaaggagagactctactcaagaaaagtcctcatctagcctggcagtggtggtgtgcaacttcttgagcccagcactcaggaggcagaggcagggggatctctgagtttgaggccaacctggtctacagagtgagtcccaggacagtcaggactatacagagaaaccttgtctttgaaaaacaaaaaaattagagacagagagaagctgtcatctagcctccacatacaggctgccgcacatacacacaataataataaataaaaataaatttaaaataaacaaaatgtatatatccatttgcattagagaaacacacacgtgtgtgcctctcattctacctcttcattttcattattatttaattaaaaaaaatttttttaaattatttatttattttatgtatgtgagttacactgtgagttacactgtagctgtcttcagacacaccagaagagggcatcggatccctttaaagatggttgtgagccaccatgtggttgctgggaatcaaactcaggacctctggtagagcagtcagtgctcttaaccactgagctatctctccagccctattatttaatttttaattttatgtgtatggatgttttgccagcatgcacgtctgtgtcctgcatgcatgccttggacccccgaaggccagaggaagatgttggatcccctggaactggagttagaggtggtcatgagctgggtatgtggatgctggaagtggagccccagtcctctgaaagagcagccaggggtcttaaccattgagctaactcttcagcccctgtctcttctccatctatctatctatctatctatctatctatctatccatctatctatttttgaaagagaaagtgggtctcaatgtgtagctttggctggcctcaaatgcacagagaccagcctaactctgcttcctgagtgctaagattgaagatatgtacctccacacccattttttttttttacattacatgaatgtaacttaaattacatgtaaattaaattacatatattttaaattacatatatagcctgtataacaacatattttttatcctagttgcctgtcttctggttttaaaagatataaaacttagacccaaagaaggaaaagaaaaattaaaataatgcacagagctcattctgctactaattcattgttcaacttgagtacctgctacatgccaggtacatgtgggtgcctgggagctgaagggaaggtgagtcccagctggtaagggagacgtacagcttgggcggcgcataaaacattacagttgggagttcagtaattcatgaacagagtattatgggattgcaaaggaggaaaggcacttcatctgtccttggaatatcaaggaaaggaataagatgcaggctcctgaagaatacctacaatcccatcctgaaggaggcagaggcaggaggatggaaagttttaggtcagctcgggcctcacagtgagaactaactggtctcgaacagacaacaggaaggcctataagtagtttggttaatacaagtgttcagataatgttgtcattgggaataaattgccaaaggactaagttaagtatttattaattggtggcttatatggaaggaaagggtggccatcaagatggggaggttaggcctaaatattctgctgtcaactgtattgtttgattgtgttcatttttaaacttgtgtgtgtgtgtgtgtgtgtgtggtagtagtacacacatgtgctggggtttgaactcaggggccttgggaaactctctgccactgacctatatctcacctcaaatacagaaaacaaaatccctgccagcagacctctgtaaatcctctccactatgggaatcttcaaacagttcagtccccagatgaagaaaggattagtgctatttgaggtgaaagaaaacaagacaagcagaaagcttaactagatttgcgaccttcataattaaaatatgaagaaaaactcaagattagttacacttgagactttccaaattatgggatgcaaggagtctgcatgatgtaattttaaacttaaaaaaaaaaagtctgcttgttgggtgacagtagtacatgctttcaaatagaggtaggtgaatctctgtgagttcgaggccagtctggtctaaagagcgagttccaggatagccaggaatacacagtgaaaccctatctccagaaaaaatccaaacaaacaaacaaacaaaaatcaaaataaaaaacaaaacaaaagttaagatctagcaccttgccgggcgtggtggcacacgcctttaatcccagcactcgggaggcagaggcaggcacagatttctgagttcgaggccagcctggtctacagagtgagttccaggacagccagggctacacagagaaaccctgtctcgaaaaaaaaaaaaaaaagatctagcaccttgcattcaggaggctcaggagttagaggacaacctgggctacagggaagaaaagaccctgtcccaaaagggtgggaatatgcaaattagggctggaggtaaaaggccccaggaccacacacacaaattgtattaaataagattaaaatttaaaaaccggccaggtgatggtgccacacgcctttaatcccagcacttgggaggccgaggcaggcagatctctctgagtttgaggccagcctggtctacagagcaagttccagaacaaccaaagctacacacacacacacacacacacacacacacacacacacgtctcagaaaagcaaaaaaaaacaacaacaaacaggagcacacatcacactataagaagacagcatgttaaaagccagcttgtgctacataggaagaccctgtatttgaaaaataaactgtaatcctcccgataagccttggctgtgagttttgaggatgagaaacccgatgcgagttccaggatagccaggactacacagtgaaaccctatctccagaaaaatccaaacaaacaagcaaacaaaagtcaaaaacaaaacaaaacaaaagttaagatctagcaccttgccgggcgtggtggcacacgcctttaatcccagcactcaggaggctgaggcaggcagatttctgagttctgatagatttcaacctatggctatttaaccccagtgcccattacttcctgccctgctcaatgcaaaccttgtgtggggccatttctctcttgcttctttgtgggccataagtaaccctagtctagaacactagcagagtgggcagctggaccagggccagggctggaaagtatggacagtgccacattcaaatggaagccacacttagtagtgaggatgctattgaaaacagcttaattattttgacttaagatatacttgtatgtacattttatgtctatgcacacatatatatatgcatgcaagctgccatgtggttgctggggattgaacccaggtcttctgcaagagcagccggtgctttgaaccacagaaccatctctccacccagctattgagaattttataaatatctaagaatatacaacagagctaaaattgtacacttgcatctaaagtacaagtgtggcaagacagtaagtatacgtaaaaataacaatttaaaagccaacatatattttaaaatattgaaagagggcaaggcatgtttatatagttcttaataatagagtaggtcttggttttgagaggggatgtctcattatgtagctctggataggcctggaatttagtgtgtagactaggctggtctagaactcacagagatcctcctgcctctgccttctgaatgtggggactaaagagttagggtttctatttctgtgataaaagcaccatggccagaaagcaagctggggaggaaagggcttaatttggtttacatttccagatcatagcccatcactgaaggaagtcagcacaggaactcaagcagcgctggaaccaggaggcgggagctgaggcagaggctatggagttaccggcttgcttcccctggcttcctcagcctgcgttcttttagaaccagcccagggatcacccacaatgggctgagctgtcccccattgatcactaactgacaagcacttagagctggatctcatggaggcctttcctcaactgaggctccttcctctctaatgactctaacttgtgtcaagttgacacacaaaaccagccagtacaccatcccacccaacaactactgtgtgtgtgcgtgtgtgtgtgcatgtgtgtttagtgtactgtccactcatgccaatgatattcacgagaccaaggatatattgttaaaaaaaatggcaatggacattaaagccactggccagaaaagataatctaaacctattccagtaaggataataaattcgagcaaatccattacataatagggcctcagaagtggtatagaaatgaaacccagaatctatgacttggatgttttgacttggatcaagtgcattttggaggaattctttgtttcttagttgagaagtgtataggagccaggattttaaaaaaaaaaaatgggggacatttgttttgaagtgaagagaggtgctgtgctcaccagaaagaaagagctgttagattcatcaaagattgatggaagcctgtggcctttagagccagcctggctatttttctctgcatacctaagaatgatcagccaacttgaagagcaggaaaaagcatggcctgtgggtttgggcccaagcactctccgactgcttctaatccctcaggtaacagtagccctaaatgtctggtaaccctagagcaggtacatgtatgcactaagtggtgtgatcggaggcaagatagcaatcacaaagattcatttgattctaacagtaatccacaccgagtcacagaaaacagcgtctgtgtgtgtgtgtgtgtgtgtgtgtgtgtgtgtatgtgtgtgtatggnnnnnnnnnnnnnnnnnnnntttaaaggtatttttaattacttgagccagcttttaaaattatgccacatttaaaatgaagggtatattttcctatactgtggtttgtccctttatgaatcagatacaagaggataaactttgcatattagtaccatttgtccaatacatttgctttttctttataaaacccaaactcattcattaatcaggtttaatctgcttagtttagggaacaatttggcaattttgtggattttttttttgagattatcgttctcttaaagtgccagtgttttaaatagcgttcttgtaatttcacgcgcttttgtgatggagtgctgttatataattttgacttgggttctttacatttgcgttgttaatgtaatttgaggaggaatactgaacatgagtcctggatgatactaataaactaataattacagaggttttaaatattagttaaatgactttcacttaagaatttaagcttttggtcacactttataatagtgccttatagtataaacaactgaaaggctctttcccattaacaacccttgatgctggggccagtgagtatgggggattaaaaggcagttggctgccaaccctgacaaccgatggcaaaaggagggaaccagcttccaaaatgctttgaccaaatgctccctccattcatgaacacagttttaaaatgttaaataggctagagggcagtaaaaacaggttttttatcgagcatccctaatctatacatatgaggagccataatctgaatgttaagtgaaaagcgaggttggtcttaaagattgcacgtgtgttcttaagcctgtagaggacctctgcaggccgtaatggtctcgattaccaacttaagaacaagtgactggcttggaaacttgtactgttgctttagaactaccattgtggacatctgttgttagtaagtgatccatttaaaagtgaactctgcctcaaggaaacgtctttgtaactttagtgggtgtgtcacgacagctacccttttaaagatgttaagaatgggaacagtttgccttgcttaaccagcttcagatcctgacttcaagaaatggaacaacaaaaaaaaacctttaaatttgagaaggagttctgttcagcatctaagctgtatcccttggaactatgtgtattgactcttagggctgaaatttacagattttagtattaggttttaatgtaggtcttgcctgggctcactatgtagcagaaggttggttcctgcctccacttcccaagtgctgtgatgattggtatgtgtcaccattcctggtaggatttctgtattttaaaagtgacacatgccaccatttnnnnnnnnnnnnnnnnnnnngcggcggcgcaggcggggaagacgcgcagcggccattccgtgcgcccggccctggcggccgcgggcggagccagcccccatttcgagcggcggggcttcttctctccttgcgccggggcccgacaaaatgggggcggcggcggcgcgagcctgcgtgcggccttccgggcgcacgtggcggcctcgggcccgcccggagccgcagcccccctcaacctcgggccaagttgggagggcggagaatcaatcctgcccgcgcgcgcgccagggcaccccaacttttcacgggcccggtttgggagacaaacaaaaaaaaagacaaaaaaaaaaaaaagaagagagcgtgcccgacacccccgtggtggcggaggaggcggcggcaggagtggcttttgtccctcatccttgtttactcggagaaacttcagaccggacgtgtttagtcagagcagaaacgcatctcggggccaaagcgataggaaactgcggcctctccgggccccggcccagcgccgcctccgcccgcctgcccgagcaaagtttgatgcgagcacggggtgctctaagagctgggtaaactttaggtgcacgaggggcacttattgtttttgcttttcgtcccctccccctgctctcctaggcctgtaattctcttaaggtctactggatcattccttgtaccctgcaaaattcactaatggacagggtggatttttctatctttttttttttttttaatgtttgttttgttggtttaaacaatttgaaaaaaagatttagacatggtttcaacgagcagttaggcatacagaacagacactgacagcgaatgcttgagtgtacctgtgcctactcttgagatcacactttgaagaccgttttttttcccccctcttccctgtgtcctatgccctcatctctgtggcttaaccgcttctaggaattggctatggtttgcagtgttctgcctagcttttatgggagattgtcgtcatcattgtgttaaataacacaaactttggtttgtcatgccaccctgagcagtttgaagcttgtctgtttcagttttcgttactaacgtctaatgcttttattttagaaaatcaactaaacatgggcaaaggagatcctaagaagccgagaggcaaaatgtcctcatatgcattctttgtgcaaacttgccgggaggagcacaagaagaagcacccggatgcttctgtcaacttctcagagttttccaagaagtgctcagagaggtggaaggtaagagggctttagagatgctgagtgcctctgagttgtaaattaggatgaacgggctgggtgttctccttactatatgactattaaagtgctttaggctggcatattgaacatctctatgtcaagtttacaaataattctttctagaccatgtctgctaaagaaaaggggaaatttgaagatatggcaaaggctgacaaggctcgttatgaaagagaaatgaaaacctacatcccccccaaaggggagaccaaaaagaagttcaaggaccccaatgcacccaagaggcctccgtgagtatgagcttatgagcttttattttgagttgtttagagtaggtaggaattgattgagccacgtcgagtgcctagtgtttggtttcttagctgagaatggcttgggtcgtgtatttgaggggtcaatgtaacttaagataggtggtattattagtgaaggcatttgaactgagaaactcactcctttgcacagtgtatcactacgatttttggttctttttgtatctttagaaattgctcaaaactaatttagaatgttttgcatctgtatatatgtctgaatgtttacaccctgcccatactatggtatgaattacttaaacactgcagagcagtacagagttgagtgtttagtttgttaaaatcctaaaagtacatttctggttttagttcggccttcttcttgttctgttctgagtaccgccccaaaatcaaaggcgagcatcctggcttatccattggtgatgttgcaaagaaactaggagagatgtggaacaacactgcagcagatgacaagcagccctatgagaagaaagctgccaagctgaaggagaagtatgagaaggtaaggaggatgacaggatacccagtgttaggggattatacttgataactcgtcttatttcctctttgtttgcaggcttcgttgttttcatacaggaacggccaatagtgtgttcagttttcctataatctgatttgagctaaggcctttaagctgtttgagttgtatttcttagtatgtatccaaatttgggggaaatttgtagctacttttggtgagaatggtttctaaatggttatgtgcatacactacaaaaatagattgggcaaagtaactgtactgcctatgtgcaaattattatatgttcactttggattaaaataaaattgcttaaactttaagcttgccaaggtaactgtcattagaatggaggaaaattgtaattcgtatacataaattaaaatacctaaaagctaatttttgttgaggtaattttttctgaaaatgtctatttttttagatacacacccccaacctccccccagttttcttctgtggattaaactctggctgtgaacctgtagaatgctgttttgtgttcagaaggtggcagtattactctttgatcagtctgccttctagtcctcataaactagaattaggatgtggtatataattgcacttcagtgaggcataacaacacaaatattagtctgacatttcatgagttgtagattgcaaattgttcatttttatgttgcctttttttcccttggtctaattatttgggaaggtacaatgggcctgtgtgttgtggagactttgtgaagttttattttttgtctttgttacattctcctctccttgttttggaaggatattgctgcctacagagctaaaggaaaacctgatgcagcgaaaaagggggtggtcaaggctgaaaagagcaagaaaaagaaggaagaggaagatgatgaggaggatgaagaggatgaggaagaggaggaagaagaggaagacgaagatgaagaagaagatgatgatgatgaataagttggttctagcgcagtttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtctgggggttgtaaattggcatggaaatttaaagcaggttcttgttggtgcacagcacaaattagttatatatggggacagtagtttggttttttgtttttttttttttttcttttggttttctttttgggttttatttttttcatcttcagttgtctctgatgcagcttatacgaagataattgttgttctgttaactgaataccactctgtaattgcaaaaaaaaaattgcggctgttttgttgacattctgaatgcttctaagtaaatacaattttttttattagtattgttgtccttttcataggtctgaaagttttcttctcaaggggaagctagtcttttgctttgcccattttgggtcacatggattattagtgtgttatctttcatctagttagctggaagagagcttttgtccacatgccctgccattgtggtagggtaacattttcatccatagttgaagaatctcctaaatcgtgatagttggataagagatattatataacctacttggcaaagcaaggagtgatcaatactgtcacaccgtgggactattaggatcaagcaatctgaacgtctgtccttgaaggactgatggaaaagtaccttctaatccttacacgaggactctcctttaaccgccattactgtgtaatggcagttatattttgcagtttcccctactaaagaagacctgagaatgtatccccaaaagtgtgagcttaaaatacaagactgctgtactatttgttgaccttagtcccagcgaaggctatcacaagaacgctggctgtaaagcctttgcccttctatctagatatggattgctcaggaaacttgactgtttaaaggtatttttaattacttgagccagcttttaaaattatgccacatttaaaatgaagggtatattttcctatactgtggtttgtccctttatgaatcagatacaagaggataaactttgcatattagtaccatttgtccaatacatttgctttttctttataaaacccaaactcattcattaatcaggtttaatctgcttagtttagggaacaatttggcaattttgtggatttttttttttgagattatcgttctcttaaagtgccagtgttttaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggactgctgagtcaaaagatagttggattcaacattttggcagatatcaataaattgccccccaaaagtgtgcttacactgcaacattttaacatggactttatgacagaattttatcagttctttggatccatgaaaaaaaaaactttttaagttttgtttggtttggttttagtgtttttgttttgtttatttttttcttttgttttgttttttgacaggcttgctttcctagctgtcctggaactcctcctaagtgctggtattaaaggcatgtgccatgatactggacaggagcctttatttcttaaaaaaacgaaatcttttatctagagttccctacagacataatcaggaacgcaggctgaatcagagctggaagacttgcaatggctctggctaacttgctacaagttttggccatcactaggtattaaatcattgtgtggcaccgaggagcttccgagttttaggtccttgatcttaaacagaagtgtctggtgtttctatggagagggaggctcagtcttaacaaaagctgcagcaaacaggtttggaaaggtggcggtgggcaagggttagggttagggttagggttagggtgtgtgtgtgtgtgtgtgtgtgtgtgtgtgtgtgtgtggtgtgtggtggagaggtaggggtaaagcagtggggtgggtgtacaatagaactgagactggattctaccctcagtggacggagggtgcttgtttgtgaaggtggaacagaccatacgtctggctttggtaggataaaggtcaccgtgcttcattttccttgctgagagtggtacttcagggtagtgaacaaccttccagagcatttacaaacacaaccctagttgcagcatttaattaggtaggcttagttgcttagatttttatagaatcactagttagtggctattttggttactagtttcaatgacaggtcatctttttaaaaattacatgtgtgtgcatactatggcacacagtcagaccagaggtcaacttgtgcgagtcaggtctctcctaccaccatgtggtcctgaggattgaatttgagtctccagactttgtagcaagcgcctttagtcactgaaccatctcaatagtccaaggtcctcttctcagcagttaagagcactgactgctcttccagaggtcctgagttcaattcccagcaaccacacggtggctcacaaccatctgtaatgggatcggatgcactctcctggtgcgtgtctgaagacagctacagtgtactcatataaataaaaataaaataaatcttttaaaaagtagtttaaacatcaagcaagaacattaaaaacaaaaacaagagacgtaagttactttctggatgtcagagtattaaggtaaggaaaagatactcgggtcctttaactgctgtgtagtatacccagagagcctgaaggacaagaccttggaggctccatagagcagacactgctattgttcacccagtgtgtgtttcccgactggctccaccatatgtcatgaggacttgtctgcgtggggctttggcacagggaacaggttaggcacatgatggctcaaatacagactagatagcctcttttgacaagaggaaaaaacgtcctttctttggaggccaaacactgccacccagtatcactgcaaatctgggcacggtcaacttcaaggcacagcacagcaccagtcccaggtcatggcatgttagatgcaaagaggccatagggcaactgcagtctagcctgggcctttttccacagtagtagacagtggcccatggagatttggaggacagctgcctgtagtatcagtatcctgaaaatatgcccccccccacccctccctgctccttcctcgacttcaccacctagactctctcttcctgctatgcttctttaatttgacatatggggacagctaacactgcggttacacctgcagcagaatcttccagaagatcatagaaaggacggcggctacgcacaccacagaaactgctgaaaaactttgccaggcatggtggtgcgtgcttttagttccagcactcaggagacagaggcaggaggatctctatgagttagttcaaggcatcctggtctgcacaatgagactcttgtcacaacaaacaaaaccagttgtcctcactttgataattagatttattcacacacacgtatatgcatgcatgtttacagatgaagtgacacacatcattcaatggatctctttatactttctctgttaagaactcaggacctttctcttaagtaagtgctctttcactgagctacacacaccctcaaccactgttttaaaaagatttactttttaaaaaaattctatctgagtgttttacttgcacataggtatgctcctttctttctttctttttttttttttaaagatttatttatttattataggtaagtacactttagctatcttcagacaccccagaagagggcatcagatctcactatggatggttgtgagccaccatgtggttgctgggatttgaactcaggaccttcagaagagcagtcagtgtttttacccactaagccatctctccagcccaggtgtgcacctttcaaacttgggaatatgtttacatgctatttgcaggctccatttcacttaccagtctgtcttattttaggtgttaggtacagcaaaccaagggcctcccactggctgggtaagcatccgatcactgtgcctggagccggtactcgttgtatattgttagtctgtagtacatcacatctaatgcgtttgcaacagtccatgaagaagtgaagaagtgaaaaaaaacaaaaacaaaaaacaaaacagcacagctgtcatctcagagaagatgacaaagagagctaacagacttaagccccccgccccccagttccatgttctcgtcaggtagcaatgtcactatgtttgtatagaaataaaacagagtgttgtaagtcaagacactttttattttaacagggtctcacagtgtatccctggctggcctgaaactcactattgtagcccagaccttgaactcagagacttgcctgtctctgcttgcagagtgctaagattaagggtgtgtgccaccatacccgactaaatcaagatatcttttttattttttcaagacaggatctcactgtgtttctatccctggttgtcctgcaattcactcagtagagaaggctggcctcgaattcacagcgatcctcctgcctctgccttctgagtgctgggtttaaaggtgtgcaataccactgccaggcaaagacactttaaaaatacattagtggaggtattttcaggtcacagcagagtggaggacacttggttttgggggttggtggaagctttgctaagttaatacatctcagaaggttttttccctaatagccacaggtggagagaatggctaataagggggttatgcatagccctcgataagttgtaattaggctcctgacctgcaacatcccaacctctccatcatcactgaagttctaatcaattaatcagcttcatagaaggtccagtttgtttgtttgtttatttgttttctaggaactttcattcacagatttgatcagtcctgtattgttaaacgtttagatagcttttgaccttttttttttttaaacaaagaggctacaatgcctatccactcctactgacacaactatctacgattgttttatttgacataaatatacttcaaacaacgaaatgtctgaatcagaggatgtgatgttggtacagtcgactttgaggagtgctggaaggatcacctaggagacacgcttgtgagtatcagtgaaggtgttcccagagacggtcagctaaggtagtaaggttcatcctgaatgtgggcggcgccatccggtgagctggggttgagaactgagtaaaatcctccagcacgcaggcatccatagccccctacttcctgactgcagattcactcgatgtgaccagctgcctgcagctcctgccaccacagctggagcctgtcgctctgagatcctgatccaccgtgctggactgaactttcaaaccaggacccgcaatgaccccttctttccgttaggtagcgtttgttgcgtagtttgccaaatcaacaagaagaatgactagaaccaaagatgagccatattggatgaatttcaccaaaactcccttcaaaaattcacccaaatggaacttttaaaaaggctattcagtcaatttttggatacaaggcatagaaaaggtcttactttttaaggattctgtagattcaaacccatagccaaggaaaacatgaagctgcgaccttcaaacccaaggacatgaagcatgaaaaccggagtggtcattcttctttatcttgattatctcactgccttccaggtggaagggttgattgttttataatttttataatcttcataatatctaaattttactaggaaataattatatcagaatccttttcttcaaaatatgtggagcgctcaggggttcagagcactggctgcccttgtagaggaccacggtttgattctcagcaccttcaggtcagctcaccactgcctgcaactccagtctcagcagaactgcagcctcgggctttcccaccagacctctctgttccctgagacagcgattctgagacgcaattatttcctgagtaaacacttatgccagacgcttggacttacttcctggactagctcataacataattccgcatttattctactataagtcctaccctgtggttgctcacctctcctcggtttcatgcggacctctccttcagcattctggtgctgctattttccagaatcctatctttctcctgcagatgatgcgccttctaatcctgctcctaacattggccacgggctttttattgacaggtgatgcagccacacagtttgtgaagagtctctctacagggaactaccaccctcttctggcctctgcaggtattgcacccacatgatgcacaggtatacatgcaaagtcatacacacacaaccccctttttaatgccaaaaacaaaacaaaacaacaacaaaaaaagtgctttcaataacagtaagtaaaattttcattgtgattttatgtgtatgggtgttttgccaacttctatgcatgtgcaccatgttcatgcctggtgccaagggagattagaaagtggtgtcacacttctacaggcagttgtgagcctccctgtgggtcctgggggttgcacttggatcctctgaaagagctaccagtgcttttaactgctgagctatctctccagcctcagcgaggaatctttttaaagaatcaactgatctgtaggtagacaacacaaatataaattcttttctcttctctccttttctctctctctctctctctctctctctctctctgtgtctatctgtctttacttctaaatgttcttgcttttatatcttcatttttatgacagatgtaatttttctagaagtagtactcaacaattattgataaaaatgcttaaagctgggccttggagtttaagaacacttgttgctcttatagaggacttggcttcaagtcccagcatccacatggtgtctcacaaccatctgtaacttcagttccagggaacccagtgcccttctctggcctctgtaggtacaaggcaagtaagttgtgcactgtatacaaaactggagagacagctcaacgtctaagaacactggatgctcttccagaggaccagcacccacatggtggctcacaaactgtctgcaactctagactaggcgatgcaacaatctcttctggcctcagacaccaggcacacttgtggtcagcacatataaatgccggcaaacacccattcacaaaaaaataaaataaatcgttaaaaaagtactaaacttggcactgggtatgatggcccatgccttcaattccagcaggtctcttggagttcaaaggcagcctggtttacataaggagttccaggcctgctacatttggaaaagcaaaaccaaacaaaacaacaagaacaaaaaacaataagcaaaaccaaaatgaaacaaaacagaaaactctcacttaaatcataaaatatttctattgtgccttattactaagtatcccactatgaaaagggatattaacaaactaatggcctaaactgaactttttgtttcgtttgttttgtttgagatagggtttctccgagtagctctggccttactgtgttagccctggctgtattagacagaacttacttattggccaggttggcctcgaactcacagagatctgcttgctctgccttaccagtgctgggattaaaggcgttcaccaccagcgcctggtgcaaacagaacttaaacctttattggcttccatgcctccacaatcaaagtatttgtggaaaggctattgaaaaaaaaaagaagaaaaagaaaaaggaaagaaagaaagaaagaaagaaagaaagaaagaaagaaagaaagaggaggggaggggaggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacacctcccccccccctaattgctgggagggatccgtgcaaaccacctttgaaagtcccatttagctgaaaggaaatcggaatctgtggggtttttgttttttgtttttgttttttttcgaggtttcgctgccacggggtagatttttctaaatttcagaaggccaaaggaatttctaaaagacggattcttccacgacggtgtctgggatgagaagggctccgcagagtgcattccctgcctgcctgtggagttccaggaaagcatttaagtgagtgactagaagggccagaaggctatcttctgagaaagaaactttttctgttttgaagcactctacccaagcccccattccttcctccatccctcccttctcctccccactcctcttccccctttccctccttcttc

SEQ ID NO: 1442 - DNA, 2021 bp, Mus musculus
gaaaatcaactaaacatgggcaaaggagatcctaagaagccgagaggcaaaatgtcctcatatgcattctttgtgcaaacttgccgggaggagcacaagaagaagcacccggatgcttctgtcaacttctcagagttttccaagaagtgctcagagaggtggaagaccatgtctgctaaagaaaaggggaaatttgaagatatggcaaaggctgacaaggctcgttatgaaagagaaatgaaaacctacatcccccccaaaggggagaccaaaaagaagttcaaggaccccaatgcacccaagaggcctccttcggccttcttcttgttctgttctgagtaccgccccaaaatcaaaggcgagcatcctggcttatccattggtgatgttgcaaagaaactaggagagatgtggaacaacactgcagcagatgacaagcagccctatgagaagaaagctgccaagctgaaggagaagtatgagaaggatattgctgcctacagagctaaaggaaaacctgatgcagcgaaaaagggggtggtcaaggctgaaaagagcaagaaaaagaaggaagaggaagatgatgaggaggatgaagaggatgaggaagaggaggaagaagaggaagacgaagatgaagaagaagatgatgatgatgaataagttggttctagcgcagtttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtctgggggttgtaaattggcatggaaatttaaagcaggttcttgttggtgcacagcacaaattagttatatatggggacagtagtttggttttttgtttttttttttttttcttttggttttctttttgggttttatttttttcatcttcagttgtctctgatgcagcttatacgaagataattgttgttctgttaactgaataccactctgtaattgcaaaaaaaaaattgcggctgttttgttgacattctgaatgcttctaagtaaatacaattttttttattagtattgttgtccttttcataggtctgaaagttttcttctcaaggggaagctagtcttttgctttgcccattttgggtcacatggattattagtgtgttatctttcatctagttagctggaagagagcttttgtccacatgccctgccattgtggtagggtaacattttcatccatagttgaagaatctcctaaatcgtgatagttggataagagatattatataacctacttggcaaagcaaggagtgatcaatactgtcacaccgtgggactattaggatcaagcaatctgaacgtctgtccttgaaggactgatggaaaagtaccttctaatccttacacgaggactctcctttaaccgccattactgtgtaatggcagttatattttgcagtttcccctactaaagaagacctgagaatgtatccccaaaagtgtgagcttaaaatacaagactgctgtactatttgttgaccttagtcccagcgaaggctatcacaagaacgctggctgtaaagcctttgcccttctatctagatatggattgctcaggaaacttgactgtttaaaggtatttttaattacttgagccagcttttaaaattatgccacatttaaaatgaagggtatattttcctatactgtggtttgtccctttatgaatcagatacaagaggataaactttgcatattagtaccatttgtccaatacatttgctttttctttataaaacccaaactcattcattaatcaggtttaatctgcttagtttagggaacaatttggcaattttgtggatttttttttttgagattatcgttctcttaaagtgccagtgttttaaatag

SEQ ID NO: 1443 - protein, 220 aa, Mus musculus
ENQLNMGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEDDEEDEEDEEEEEEEEDEDEEEDDDDE

SEQ ID NO: 1444 - DNA, 25668 bp, Homo sapiens
  misc_feature (1)...(25668): n = A,T,C or G
atcccagcactttgggaggctgaggtgggcagaacacttgaggtcaggagttcgagaccagtctggccaacatggtgaaaccccatctctactgaaaatacaaaaaattagctgagtgtggtggcttgcgcctgtaatcccactactcgggaggctgagcttgagcctgagaggctgaggtcgcaatgaggctgcactccagcctgggcaaaagagtaagactgtctcaaaataaaaaaactgagagagagtacatgctacctgtgtctcaaaaaaaaaaaaaaaaaaaaagtacatgccacctgcgatatcacaacagttctgtttctcagtttcccactctatggtttgtatgatgacaataagtgtttcctataaaaagaatctctgatcaagaaaatttcagaattacagtttacaatcatatgaaatgcttaggccccaactcaaatgtctgcaggggccagggaggtgatatgattgggtgaaaagtcaggctaaccacttagggaatggcggggactgtggtaaacttgagaaccctgacctctttgagggaggcagttactcttcattccaaccatcctccccatgtggaaatgtgaacccaaccttatcagatctctcacttttcaaaagaagccaaatatctggattttttattgtgaagatttctactgttttctgggttttgtttgtttgtttagagacagggtctctctctgttgcccaggctggatggagtgtgatggcaggatcatagctcactgcagcctcaaactcccgggctcaaacaatcctcctatctcagccttctgagtgagtaggtggaactacaggtgagcgccaccaccacacccagggaattttttttttttttttttagagatggtctcaaaccgggcacattggctcacacttgtaatcccagcactttgggaggctgagacaggcagatcacttgagcccaggagttcaagaccagcccaggcaacatggagagacccccatctctacaaaaaatacaaaaacataattaaccaggcatgatggtgtgcacctgtagtcccagctacttggggtggggtgaagggaggggagaggtgggaggagactgcagtgagccgaggtcacgccactgcactccagcctaggtgagaccctatctcaaaaaaaaaaaaaaagagagagagagagacagtgagctgaagtcgcatcactgcactccagcctaggcgagaccctgtctcaaaaaaaaaaaaaaaaaaaaagagagagagagagagagagacagtgagccaaggttgcaccactgcactccagcctaggcgacagagcgagactgtctcaaaaaaaaaaaaaaagagagagagagagagagagctgaggtcgcatcactgcactccagcctaagggagaccctgtctcaaaaaaaaaaaaaaaaaaaacaaaaaaagaaaagaaaaaaaaaagagaaagagagtgagccaaggttgcaccattgcactccagcctaggcgaaagagcaagaccctgtctcaaaaaaaaaaaaacaaaaaaagagagagagagagtgccaaggttgcaccattgcactccagcttaggcgatagagcgaaaccatctcaaaaaaaaaaaaaaaaaaaaaggagagagagaccatctcgctctgtcgcccaggctggagtgcagtggttcaatcactgcttactgcatccttgaactcctcttctgcctcggcctcccaaagtgctaagattacaagtgtgagccaccatacctgcccaatgtctacctttttaaaacaccgctttgaccgaatgaaacgtctgtgggtcagataaggccagagaggggccagtttacgctgtcagtcctaacccttcatggctgggcatactcattacggtcacccccggctctccagaaaagcctcccacggtatccctataaaagcgcttgtttaaaattactataatattttgcagcaaaaatatactttaagcacagaatatgtaactccaataatagatgaaaattctacctaatgaagaggaccatctttttcacaaggtgttaaacaccatgaacagcaggaaagaaataggcaaagttggcgagggagtgttccattgttcctgtctttagttaaccaaaaccactcgtaagacatttattgctttttaaaaaatagctttatcaaaatatgattcatacaccatgtaatttacccacttacagtgtacaattcaatggttttgggcatatttaccaggtcatgctgccattactataatctaatctgcaacatttttgtacccctaaaagaaactccatacccattagcaggcactctctttttccccaaaccctggaagccactaatctacttccctgtctataatatttcctgttctggatattttatataaatggaatcatacaatatgtggccttcttatgtctgggctctttcacttagcataatgtcaaatatatatgtatgtgtatggatataccacattcgatttatccactcatcagttgatgggcatttgggtgttttccactttttgactgttacaaatgctgctgctatgaagattcatgtacaagtgtgtgtggacatgtttttgtttcttttgggtatatacctaggagtggaattgctgggtcaactgctatctatctgtgtttaaccttttgaggaactgtcagcttgttttccaaaacacctgcccgtttacatttccacaagtgtgcataagggttccagtttctttctccacatgctcacccatgcttgctactgtctatctccttgattatagccatctgcgtgggtgtgtgataagcatttattctgaaggtgtaaggcagttttaatagagcagctgaatttgatgtttgatgtgattattgagatcaagacctaatatagggatcttttctgaacttagatcacctttctgtaagaacttttactattgcgttttccactcgtcatgtgtaccattctttgactaaccagaggacaggcctcttaaggaaaggtctgatattttccccttactaaccagtaaaatcatccaattctagagaacttattgatataaattagctttggtacaattttctgtgccatagcattgatggctatcatcaatgctgcccacggagaagctgctgatttccccccggaaaactcgggctgaggcaggaggtacttaagcagctggggaagaggttctccttctccatacatgaacacatatagcaccatctccctctctttcgcctctggtctttcttcttgcctctccatttagtcatgaaacatcctttcaagttagactaaggtagtgacagccctaaggaaatgttgaggaaactgagcatagacctcggtgactatgagaggtccgtgcatagtgaattgaggggattggatgtcagtatccttgcttctagtctggagttcacaaacctgtgctctcttcttttcctaaatgcctcattcctttattttcactgccctaaaaaaaaaaaaaaaagttttcagtatgtgtgatccttagtatggttgtatggttatatggttgacctcatcagacattttgggttagcgtttcctctccttttccgaaactggcctgttttgcaaagcagacaagagaattcatatagcttgactttaggactcattgcattgggagagatcaatattttcaaccaatgaaaaacttacagctcccagtctgcatttttgttgttgttgttgttttctgtattgttttgttttgttttgaaatggagtctttctctgtagcccaggctggagtgcagtggcaccatctcagctcactgcaacctctgtctcccaggttcaagcgattctcatgcctcagcctccggagtagctgggagtacaggtgtgcgccaccatgcctggctaagttttgtatttttagtagagatgcggtttcaacatgttggccaggctggtctcaaacccctgaccttaagttatccgcctgcctcggcctcccaaagtgctgggattaccagtgtgagccactgtgcctggccttgcatgtcgtattttttttacgtcagagttttttatttgtatctttgttttgagacagagtctcactctgtggcactctggtgtagtctccattcactgcaacttccgccccctgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaccaaccattggtttggttgaacatgggagacaaacattaaattaaagataaaataaaataggccaggcgcgctggctcacacctgtaattccagcactttgggaggccaaggcaggtggatcacgaggtcaggagttcaagaccggcctgtccaatataatgaaaccctgtctctactaaaaatacaaaaattagccatggcgcgtgcctgtagtcccagctactcaggagtctgaggcagaagaactgcttgaacctgggaggtggaggtcgcagtgagctgagaccacaccactgcactccaacctgggcaatagagcaagcctctgtctcaaaaaattaattaattaattaaatataaataaataaataaataaataagtctgggcatggtggctcacacctgtaatcccagcactttggaaggctgaggcgggtggatcacctaaggtcaggggttcaagaccagcctggccaacatggtgaaaccccgtctctactaaaaatacaaaaattagttgggcatggtggcacacgcctgtgatcctagctacttgggaggctgaggcaggagaatcacttgaacccaggaggcagaggttgcagtgagccaagatcgcgccaccgccctccaacctggacgactgagtgagactccatctcaaaaaaaaaataaaataaaacaataaaaagccaattggtaacaatctttgggcagacaatcttgcagttttctgtgataaagtctaatttggcttgccatagttcactgtatccaccaaggaataatcttggcctaattggaaactggtaaatgcttagactatatgtgtttctctacatttgagatcccctctcaccctccaactgtgcctctccctttttaagttacgtcaatgagatgtaattggcacctatcctcaatcttagtatcctaacattcgcttcttattctattttcctgccttttgatttagaaagacctaaatgcttttagatctaaagatagaagaggaaggttaaaacaataatttgcaatacgtactccttcagctattaattcatttatgcaacgggctttatttaatgcctgctgtatgccaagtactctgctaggtgcttgggattcaaagataggggctgggctcagtttctcatgcctgtaatcccaacattttgggaggccaaggagtttgagaccagcctgagcaacatggagagaccctgcctctacaaaaaaaaaaatagccagcaccaggcacggtggttcatgcctgtcatcccagcactttgggaggccaaggtaggaggatcacttgagcccatgagtttgagaccagcctgggcaacatggagagaccttgtctctacaaaaaataaaaataaaaataaattagctggggctgggcacagtggctcatgcctgtaatcccagcactttgggaggccaaggcgggcggatcacaaggtcaagagatggagaccatcctggccaacatggtgaaaccccgtctccactaaaaatacaaaaataagctgggcgtggtggcacgcgcctgtagtcacagctgttcgggaggctgaggcaggggaatcacttaaaccaaggacgcagaggttgcagtgatccaagattgtgccaaaaaatacagagttcttgcctttaaggtgtacagtgcagtgggacaagcagatacaactggagaaccacaattgtgattgcagtaattaatatacacaatattacaggattacagaaaagaggtacttcccctatcctagaggggatggaggaagggcataaagtacattaatgacgatctgtaattcagttgtttaaattgagcatgggagagggtgttcaggcctcttcgactggatgactttgtaatttgggataaaacacccaataacttggccgggtaccagggctcatgcctgtaatcttagcactttgggaggctgaggcgggcagatcacttgaggtcaggagttcaagaccagcctgaccaacatggtgaaaccgtctctatcaaaaattcaaaattacccaggcatggtggtgcatgcctgtagtcccagctactcgggaggctgaggcacgagaattgcttgaacccgggaggtggaggttgcagtgagctgagatcgtgccattccactccagcctgggcaacagagcaagaccctgtctcataaaaacaaaaacaacaacaacaaaaacccaataactgtaaagtaaaatatgtcaacttgtgactaaggattcatgtggaagaagaaaagcgtctaatatcataaaggaacatcaagattgtggggttagagctagaagatgttggttttattttaaaatttctgtcttttttatgttcttccctgcctatatcacagaaaatcaaatataagaaatgaattgcctgcaagtggtggtttttaaactcttctctctgatatagtctctgttaaacttgggaataaataaaggtactatcaccagactaggggaagattagcattgtttgaggttaggatttaaaaaaaacaaaacaaggccgggtgcagtggctcatgcctgtaatcccagcactttgggaggccaaggtgggcggatcacctgaggtcaagagttcaagaccagcctgaccaacatggtgaaaccccgtctctactaaaaataaaaaattagccgggcatggtggcgcatgcctgtattcccagctactcgggaggctgaggtagaagaatcgattgaaccaggaggtgtaggttgcagtgagccgagattgcaccgctgcactccagcctgggcagtaagagcaaaactctgtctcaaacaacaacaataacaacaacaacaaaaaattcactagatttgcaatcactgccttcatataagattaaaatatgaagaaaaactcaaggttaactgcacttgaggttttctaaattatgggattgaaggggtctatataattttaaacattaaaaaaagtttaatctttacaaccctgtggtcccctccattttatagctgagagaattgaagcatggaggtttaaaaacatgcccaagatcatacagctagtaagtagcagagctgggatttgcacccaagtctattcaattccagtgcctattactcaccatatcatcctgtcaaaatagaaaccttgtgtgggcccattgctctcaagatgtcctgtggccataaatgcaccctggcaggagcaagctggtatagacaaccagtaaagtgtatggccgtgccagtacaaagccaacactgctcctggaaaatattgatagtgccatattcaactaatcgtcaaattttaatatcatcgatgccactgaaagtatcttaatcattctcatgaatattttgtaatatgagacattgagaagataagacagtattgaaataaatatctagatttaaaaaatataaaatttgaatgattagtagagggaagcagaggatagtaaatatgtgtgaaaataataacataaaagttaactttagatatattatctttaaacactgcatgtgcagtataccaatttatatcctctttaatattatagtctttttcatgtgcatgtgtgatatattgtccattcaccaagactataatccctgagtccaatagtgtattttcttttaaaaagaaatcaacattaaaacaggaaagattatctaagcttactctcaagtagtttaatacatttgaggaaataaattaggttatggatgcttataagcgatataaaaaatcaaattaacacgatgtaggtgatttattccaaatttgatctgttacatttggaggaattggttgttggatttagaagtgtacaaaataccattagagagtgaaaaaaaagggaagtctgttataactgaataggggcgtggtctgctcaggctaaaaggaatagatagtagtttcataaaggactgatataactgtagagtcttcagaactggccactacagccagcacattttctctacagacgtaagtatgtctattaataccagccagcttggtgagttagagaaaccacagcctgtggatttgggcacatgcactctctgcctgcatctaatccttcgggtaaccatatacctacaactcctgtaatcctagagcagttacatggatgcactaagtggtgtgatgggagggaaagatagcatcacaaggattcgtttgattgtaacagtaatccacaccaagtcaaataaaatagccaaacagtttagaatgtggtctctaatgaatttgctaattctaccagggcctcacaaacatttcctgctagagtaccccatatcaaaccaagtggctgttctttaattacatggaataattatttgatttccaggaagttaagacagtgctttgtatttaaataaaaagttctagacatgctgtgaaactcgatcaaaccaagaaaaagggtgaaactgaatgcctgctcactgactcaagatttcagctgctcagcgagcctgacgtgacggcttatgagcccagaaaaggggtattttaaacccggctggctggatcatgtcactttcttatagaagccctgcctttccagagacctaaagtgtaacgcaatcagagacctttgaggggctcgaggctcggcggcttccgcccctcagcaccagcagagaccccagttttcaggggacatgatcccatagtgtcgccctcacttttgaagggccattaaaagcctggggcctcttatctcaacggctttgggcgtgaatgtggggcaagaaggggggggggagacctgtgggtgtctcttttgcctgaggagttggagacacttgtggaaaagtcaggcccttttcgctccggcggccgctccggtgtggggctggcttgggttagacacatgcacacatacaccatagagctctgctttcccgtagcagctgctgcctctgcctctgcctctcccgcctcagcctctttgcccggcatacacacacattcagatttgcgcgctgtttcaatccttgatgacgtgtccccggagacagccaatagcaaacgggctctggtcaggacaatgggaggtatcgggccaatgagcgagccccgtgagttggcggtagccaataggagccgcgctggctggagagtaatgttacagagcggagagagtgaggaggctgcgtctggctcccgctctcacagccattgcagtacattgagctccatagagacagcgccggggcaagtgagagccggacgggcactgggcgactctgtgcctcgctgagggtgagtctggggcagcgccgcggcggggagagcgcctccggcagctccccagcccgcgcggcggccggatccccgcggccgggagccggcgggtcaggatccacacaaaggcaaatgaggggggaccgtggggggaactgcgcacggagcgagcctctgcccgggcgccgggaacgctgccccgcgccggtgccccggccctcaggcagcctgaggcgccgggagccccgcgccccgcgagtttccacccccggcggcgtccgcgctgactggcgcaaaaaaaaaaattttttttttaattaaaaaaattttgaacgtgttttgggccctcgggccgggcgttcgggcgggcggcgtgcgcggagcgcggccggggcggcggggccggcgcggctcggcggcggcggcgggagggcagcggcggcgcttccccgggctgcattggccgccgacgtatcgagccggtcgctgatggtaagcgcggatcaaatctatcttattaaagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgccgggcgcacgtggcggcctcgggcctgggagccgggccgcgtcctctctcctcggccgcgcggccaccggcgaagttctaggggcggggggctcgccccgcgcaggagtcaccccaactttcacggctccaaaaaatacttcccgagttgggggagggggccaccgagccacgagcaggagtggcttttgtccctcatccttgtttactcggagaaacttcagaccggacgtgtttagtcagaacagaaatacatctcagggccaaaccgataggaaacgaggcttcctcgcggtggcaccgccaccccccaaccgggttccgagcaccggagctggctgctgctccctctttggagcaaagttttatgcaaagagggtgttttttgaaactttcggtgcacggtgattttttttttttaaggtcccataattaggaagagtcgactcgcttaggcccttgtttattccctatctagtgcaaagccacgaattggcagcatgttttctgacctttggtttggttggtttaaaatggtgttctagattttaaaatcgtttaagtgaccagttagatactcattcagagcagactcgggcggatagatagggaatactgtatgggtatatctttgtgtctagactttttgagatcgccctgaaggactgtttttgttttgttttgtttgcttggcatagccccttcaaggaatttaatctctcggccatattcttgtctgattttacggaggttgatgtcgctactgtgttaaataaccagtactttggttttcattcccttactaagtactttaaggtcttatatgtcataattttattgctaacatcaaatatttattttattttttagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaaggtaagagggcttaaaacatgctaacaaggtaattaaaagacagtttccaattgaggatgcaaaaaaaagcctagttggcattctcgtagtgggacgctattacatagcaaaagacattggttttgaggataatttacttaaatgttacaacttaaacttacaaataattattttgtagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccgtgagtatcttgcctgtttttacttcccagacacgttttacagtagaatctgagagaaatttagcaagctactttgtcagtttagagtgtaaatgtacaatcaaagtttcttagctaatacttgttcatattggttatatttaaatagtataaaattcctgttgggtgggagtgttcccagagcatttgaattagacatttggtctcctttgcccagtgtatctccttttgatctttttatttcttgaaaaatactatccctttgaaatagtgtaattgtagaatgttcatctagggttctagctagtataaattaaatagttgtaaattaagctttggttgtgaaggatatttagtatattatagtatttgcaccctgtccaatgcatcacagaaattcacaggcagctttaaatagcaatgcagtgtacacttgatagtatttgtttttgtgatctgttaacttaaaatcctaaaattaattttttttttagttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggtaagaagtgtgggtttgcttggtaaaatgatgacaagtacgccagatgtatgattgtacttagtttgaggtgtaataagtttttagggtaacagctacattaagtatggtgttgatataagtcctcatccttcaaagaatgcagaggaccaaataaattagggtttttttgactaaaatgtaatcagactcagacaaaggctgtgtacatttatgttggttttgttattccccagtatcttgaagttcatgaaaatgttggtagtcacttcaagtcaaaaatgagcattttcaaatggcttggcatacagtacaaaaacaggctagacaaagtaatataggctatatttttcttagtcatatcctgaaacatttatgttcttttcctttagatactcaaaaaaccacagcatcactaagttaaattacaagtctgctgctctgtccagtaaattaataagattaaggaaatctataactcttatagttcagtaaattgaaatattaaatacttaattttcagctttagtcattctgaaaagtgtttatttctagatgtttcttaacctaattgcatgtttattgacaaattaccttttttttttaagaccacatttcctactaaggattaaggtctgacagtgtaaacctgtagagtgcttttttgcattcagaaggtggcagtgtctaccctttaatcaaagtctctacattctggttttaatagagttaggatgtggtacataattgcacctcaatgaggcataactttgcaaatattagactatgccatttcatgagttatagattgttataatgatcttgtatttttatgttcatttattgaagttctagttatttctggagttgctgtggatctacagatacgtgatattttggtataactagaatcttgatttctttcataaagttctgccatgttctatttctttccttaatgtttttttcttccctactgttttatcctccctttgctttggaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagattaagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagataagaaaagcgcccatgtaacacaaactgccattcaacaggtatttcccttactacctaaggaattgtaaccattgctcagacattgtaggatttaactatgttgaaaactacaggagaggccgggcgcagtggctcacgcctgtaatcccagcactttgggaggccaaggcgggcagatcacgaggtcaggagattgagaccatcctggctaacgtggtgaaaccccgcctctactaaaaatacaaaaaattagccaagcgtggtgctgggcgcctgtagtcccagtaactcaggaggctgaggcaggagaatggcgtgaacccgggaggcggaggttgcagtgagccgagattgtgccactgcactccagcctgggtgacagagcaagactccatctcaaaaaaaaaaaaaaaaacacaggagagacaactggtttttgaatgaaatacatgggtactgccttgcttgacatcacatagtccttgatgaaagttcacatttaggtctgcttggtacaatacgcctcctaaaaaggtccttgatgaaagttcacatttaggtctgcttggtacaacacgcctcctgaaagggtctgatagctttcagtagcagtaagacacttgcatgtgatggtaaggtatctgcaaatttgcacacaccgtacacagcttaagtcttagaattaacttgctaaaatgtgagcctttggtaattaggctgttttattagggagtgtgataatatttgaatttcttttcatatttgtgctttgtgtcattttcaaatgacccttgaaatgtattttaaaactagataaaagccagaaagtgatttgattgtctatccagcaaaagatggaaggtggttcattttcttgtcctcttaataccaaggcagtgctaataacacttgccacaacttgggaaattccatgggtctatgccacattgctcccagagtaatgaggcaaaatagtgctctgttatagaattgcttgtttcacgatacatcatgacagataaccatacaacatggaatgacacaaacataatatgccacactccagaatatgtaatgctcgtcttccaggggggttcagtctaaggtaatctctaccaggaagaaatgctagatgactttagacatgtgcattggtttggaccttctaattagttgaatttttacttattttgacatgagagattacatagaatctctatgttgcccaggttggtctccaaatctgctcaaacaatcctcccgcctcagtttctcaagtagctgggattacagggacacaccactgtgcttagcttaaatagttgaatttattgggcatccactgaaaagaaggaagtaggaataaaatctgcaataatatgaataaacctgtaagtgagcatgagcagtggtgggcaagggtatgcagactctggaatccagaaatagaaagtcagtggaaagccaggcacagtggctcacacttataatcccagcactttgggaggccgaggtgggaggatcacttgaggccaggagtttgacactagcctgggcaacatagtgaggccttgtctactagaaataaataattttgcagatatactaaataccattttaaaaataagtggaaaagggattagagagatccttgtaaattatgtactcatattcattgttctctttagtcacataattcagtcatgtacgtgacattccacagtatggtgctccataatacatattttttcttttttcgatctcacttgtatatgatccataatatttttcatcattcccttactgatggacatttagattgtttcctattttttgctgtttaacagtactgcgctgaacatctgtacatttctctcaggcatgtgtgggtcttcagatacctcaaaagtagaactgctgagtcaaaagacatttgcatttaacattttggaagatgttgataaattgcaccccccccccccccccccgcccacaaaagctgttatttatgctgtgaaacattttaacaatgattttgcaattaatcaagatttttactggtttttctttggctgtataactctatttttaaaaacgagaaattaaaatactgaaatactgtcatttgtccagagctacctgaccagaataagaaacacagagagaatcaactgaaagactcttaggacaagccactgctttatttaaactgctaaactatttctcaaactcctggcctcaaactatcctccctccctcctcggccttgttgctgagattacaggcgtgagaaccacagttcctggcctaaactgctaaactatttctctaaagttactgcagtaactaaataagtaatccactgtgtgaaaatgaggaggttctttctcattttgatatactctgtcctaaatggaagtatgtggtagttttttggttggtttgttttattctggggagggtcttttctagcagagattctatgtcaatcttacagaagctgcagccaacagttttggaaatgcaagttgttcaataaggtgtagcaaaaggagaaatgtgtggcccagatactagcctttaggagacaagtgtttggaaaggcagaatggattctgaggatttgccttaaatggaataaagttcaccagttccttgctggagatgatactttatggcaaaggacatactccaaatgtgcttataaatgaaattgtatttatatgctcaaagtgaaattaagctggccgggcgcagtggctcacgcctgtaatcccagcactttgggaggctgaggcgggcggatcatgaggtcaggagattgagaccatcctagctaatacggtgaaaccccctctctactaaaaatacaaacaaattttccgggcgtggtggcgggcgcctgtagtcccagctacttgggaggctgaggcaggagaatggtgtgaacctggtaggcggagcttgcagtgagccgagatcgcgccactgcactccagcctgggtgacagcgagactccaactcaaaaaaaaaaaaaaaaaaagtgaaattaagcttagttccttagcgttacatagaatctctcattagaggctttaccgtattttgtttgttagcttttgctttttgggtttttttctccttttcacaggtgttgactgtaccctggttttgtttattgggtttcaattagagcttattttataaagtgatctgaacataaccaagtaagagaataaaaaaccctaaaataaaataaggatctgttgagtgtgagagagtgctcctaaagataaagaaaaacaagatgctcagttgccacagcctcaggtgccactgtaatccctggaagagatgaagagtaagaacttggaggctactcaaagcaaagatattgcagctcccccacccctacaccccaagccccatttccccaggccttgctctgccacctggaatcagcctggctggggcttgggcacagggaatggggctaggcacacttaggctcagaagcagagaggctgaccagagagcctgttttcagggagggacagaataaggcatagcactagtgtaaggtcctagcacattacaggcgaagggggtctaagggctaccgtagtctaatctgtgcatttttacagagtagtggacagaggcccatagggattcagaggcttgctcaaggacaaatggcagtatcaaaacactctagcagcaccaggctcacagtaggtgcaaaaaagatgtgagctctttccccttcccttaaggacagcaacaaaaaggctggaaaacttcctcattgcccctcacttccaggcctgggttcttctgctttggctacaatttttgctatgctaggatagccagtacattctgccatcactgaggttcttctctggctttctcctttgatttacttggacagaacatttctgaactgaaccaaaccaaaccaaacaaaaatactcccagtcatgtagaaagttataggctatctgattctaaagggctggtaatcactaatataatagatgctgcttaggactgtagcctgatcttctggaagtagaagcaagatgcaatatgctacacacgacaataacttttgaaaaatcggttgcccttattatgaatgaaacttacattattgaaacaaaataaataagaaaacaaaaacctgtaattctaccagtcagcaagactattaccatattatgtgcccttccagtttctatatataacatgtaatatatatagatatatagatatagattttaaaaattgaggtgagactcatataacataaaattaaccttttttttttttttttttttgagacggagtctcgctctgtcacccaggctggagtgcagtggcgcgatctcggctcactgcaagttccgccatccgggttcacgccattctcctgcctcagtctcccgagtagctgggactacaggtgcccgccactgcgcccagctaatttcttgtatttttagtagagacggggtttcactgtggtctcgatctcctgacctcgtgatccgcctgcctcggccttccaaagtgctgggattacaagcctgagccatcgctcccagcccattcattcgtttttaaggctgaataatattctattgtgtgtatataccataattccttattcattcatccagtgataaggtcttaggctgtttccaccttgtggctattgtgaataatgctgctatgaatgtgcgtgtacatgtatttgtttgagttcttgttttcaatactttgggtatatatctaggagtggaattgtcgggtcatatggtaattttatgtctagctttttaaggaactgccaaactgttctccacagcagctgcaccacttcacattcccaccaatgatgtatgagggtttcaatttctctacaaccttgccagcacttcctattttctattttttaaaattatagccatcctagtaggtgtgaagtggaatcgcattgtgatttgatttgtgtctccctaatgactgatgatactgagtgtcttttcatgtgtttattggccatttgtatgctttggagaactaattcaagttcttcacccatatttaaattgagttgtctttttgtagtgttgtgtgcatatagatatacatacatatatatgttttaaaaaatgttaataatttaaaaatactgcatttgtaagctgctttttctacttcacagtctatcttgaacaaaagtctatgtcagctgggcacagtggcacacacctataatcccagtactttgggaggccaaggcaggcgcatcacttcaggccaggagtttgagaccagcctggccaacatggtgaaagcttgtctttactataaatacaaaaattagccaggtatggtggcatgcgcctatagtgccagctactcaggtgactgaagcacaagaatcgcttgaacctgggaggcggaggttgcagtgaactgagatggtgccactacacttcagcgtgggcaacagagtgagatcctgtctttaaaaaaatttaaaaagtcggccggatgcggtggctcacacctgtaatcccagcactttgggaggctgaagcgggtggatcacctgaggtcaggagttcgagaccagcctggccaacatggtgaaaccccgtctctactaaaatacaaaaataaactgggcatggtggtgggtgcttgtaatcccagctacttgggagcctgaggcaggagaattgcttgaacccaggagtcggaggttgctgtgagccgaggtcgcaccattgcactctagtctgggcaacaagagtaaaactccatctcaaaataaataaataaataaataaataaatataaatattaaaaaagtctatgtcatcatatattcttattctgctgggcattattttaagtgcctgaatgtaaaataccataaattattcaatcaattccatattattagacatttagtttatgattttttactgttacatataaggttaacatgactatcctttctttatgctcacacctttgcccataattattttcttaggatataaatatattcctcaaagggaaatcactgaatcaaaagatgagccaaatttggtgaattttaccaagctacctttggaaagttttcacccaaatgtaacaactttttaaaaggctattcagacaattttacatagaagggatacaaaatagggtcatggtttctaagattttataaaggttcaagcctacaacagtggggggaatcgtgaaaggagtaaaccttcaaaagcaagcagataaaaagcctgaaaaacttggaaaaccattggattgaaatgtccattcctctttatacttctgttaccttactacttttcaggttggagattaacagaaagagcttttatattcaagtaattgcagaactgcaaaaagtgaatgcctagatcaattggaattggtagaaaaactgaaaattttgcacgagcattagagcttttttgctttttacttcattgtgtcactgtactttgtaaaaacctacataatctccaaaatttactaattagtaactgtatcagattttttttctttaaataaggttaaataacaacattttcacatactgttttaaaaccaagacgtagatcaacattctttcaggcatttaacagtggccaataggccaacatgaaactgaattaattatgtataatttatcctctagacaatcccataggaatctttttcatacattgatgagtaatggattttaccctacataggtcactgaaaagcagtgtaaatttcatggcttttttgtgtttgtttgttttttttctgagatggagtcttgctctgtcgcccaggctggagtgcagtggcacaatctcagctcaccgcaacctccgcctcctaggttcaagcgattctcctgtctcagcctcctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccatgcctggcctcatgtttcttttaagcacttaacttttagaaggcagcattgcaaactttcacgtctgaatttatatatattgagcttctatagataattacagtgtacctttagaaataatactgattttggccaggcgcagtggctcacacctgtaatcccagcacttggggaggccaaggcaggcggatcacgaggtcaggagatcgagaccatcctgcccaacatggtgaaatccccgtctctactaaaaatataaaaattagctcggcatggtggcatgcacctgtagtcccagctactcgggaggcttaggcaggagaatcgcttgaacccgggaggcagaggttgcagtgagccaagatcacaccactacattccagcctgggcgaaagagtgaaactctgtctcaaaaataaataaataaataaataaaaatataaaacttgggagtttttaaaaaaattgttaaggtcctaaaggtttttaaataactgtacttaagaatcaactgacccaggccagtctctactaaaaaatcaaaataatattgattttggcagggcgcggtggctcacgcctgtaatcccagcactttgggaggccgaggcaggcagatcacttgaggccaggtgtctgagaccagcctggccaatgtgatgaaaccctgtctctactaaaaatactaaaatttagcagtgcatggtggtgcatgcgtgtgatcccagctgcttgggaggctgaggcaggagaattgcttgaacccaggaggcagaggttgcagagagctgatatcatgccactgtacgctagcctgggcaaaagagcaagactccgtctgaaaaaaaaaacaaaaaacaaaaaacagagatgccatttttttctttattgttttttgctacatcttcattttcaggccaaatctaatttgttcttacctctaggtcttagtaggctattaataacaattcttaaaatctcactaagaaatcatcaaaatatttccattttattttattatgaatatctttttttctatgttatttattcatttttttttttatgagacagagtcttgctctgtcacccaggctggagtgcagtggcacaatcatggctcactacagtctaaa

SEQ ID NO: 1445 - DNA, 1416 bp, Homo sapiens
gcggagagagtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggg

SEQ ID NO: 1446 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 1447 - DNA, 26064 bp, Mus musculus
  misc_feature (1)...(26064): n = A,T,C or G
ctcccctacggaggacagtcgccggccggcaaccgaacccccaaaccaccccgagactgtcgcaggtcgcgcgagacctgactcgaagatccgcggggcatgctgggagttgtagtccgagatctgagcgtgcctccgtacccaccaccaccggaacacctccctgtaggttgaactctaaaagggaattccacggggttcccagaaaggaggtcacctgtttccagcacttcctctgcgctttttacttgattacagaattgtggcacttggaggctgaggcaggagcattgcctgaatcaaggagtgtggtgggggctgaggatgagaaggggggaaagaatgaagattgatggctggagatggttcagttaaaacagtaattactgcacttgcagatgacctgggtttgttcccagcacccaggtttggtatctcacaacctcttgtagtacagctcccagggtctgctgccctcttctggctcccaaggacaccgcagtcggtctcccattcccacatacttgaatttaaaggggggagacccatcccccactttgccagactctcattgctttatcaggaaagcaagctcaggcagcctgttagcaggtggtggcttcttgcaggaagctgcagatgtggcacacaatagactttacctagattggaagactccaccctaggtgggctagccaactgtggcagaaacaaagtctgattctgcctgctcaaggctggggggaagggcacagttcaatgaaccatgaagccaggtaggcgccttcgtgggtcgtgacccacaggttaagaaccactaccatacctcccacacacagagaggatctgatagttaatctttctccctttaattagcagtggagtcaggcgggctccacactagtacaggactaaatacaggagcatccgcctccccggaaatggataataactatgagaaaagtggacctggagaggtagccactcagaggtctcaaaaacacttccctgctctgctccatgagagaaagctgaaaacacccacactcaactctgctccaagtccaaggttcactgtccgctcaggaagaatcggagggtgttaaaagatgggaatacatttgactttgcttgcattctgttaggaccaagactgggccaggaattcatgtcttctgtaagctgtatacttcatttgtgaataacacacttgatttgcagtgtgacacttgaaaaagtattcccagtgtttttactttactgctcctgggaggaaagggtgcagatcaattctcacataaaaggttaaacatggggacggaagtgaaggctcctcaatggagaacactggctgccgttccaaaggacccagattcaatttccagcacccataggacagctcacagctgcttatcactcttcatccaaggggtccaatgcccttttacagcctcagcatgtgaatgacagacaggcacacatctatgcaagcaaaacaaacacagggctggagagatggctcagtggttaaaaggactgactactgttcctagaggtcctgagttcaattcccagcaaccacatggtggctcacaaccatctgtaatgggatctgatgccctcttctgttgtgtctgaagacagtgacagtgtattcacatacatgaaataaataaattctttaaaaaaaaaaaagacaaacaaacacacacacatttaaaaaacaaatcttttataaggttaaaatgtctttttttaaaaacaaatgaaatattttgaaaatatcttgttttaagatttatttatttattttatgtatgtgagtacatgtgattggctactattgcaactggtagatcctgagagagaaaccgaggcaggacaaccaggagcaagagacctcaggtggcagtgagcacattgagaacggactcttaggagagagcttcagtgaggcagctcatttaatggagggaataaacgctatttaaaccttcgaggggatggaggctttcagggtgagtgaacatcattggccagggccagggtgctagggatacctcattaccatgaggaaggattccaggtgctactgtgcggctggacatgaccttataatggctgtcttagtcagggtttctattcctgcacaaaacatcatgaccaagaagcaagttgggaggagagggtttattcagctgacacatccacattactgttcgtcaccaaaggaagtcaggacaggaactcacacagggcaggaatctggaggcaggaggtgatgcagaggccatggaggggtgcttgctggcttgcttcccctggcttgctcagtttgcttttttacagaacccagaactaccagcccagggatggcaccacccccaatgggctgggccctcccagccttgatcactaattgagaaaatgccttatagctggatctcatggaggcatttcctcaagggaagctcctttctctgtgataactccagcttgtgtcaagttgacatacaaagccagccagtacatagggtgaggaagtttagcctggcaactcaggctacataacctcctgggggtgggggacaaatgtgggagtgcagggctacttgtgctgggacacacaggcttgatcatacactcctgtccatgtcagaccccagattctggggtttggacatgccttgacctcactcttgttccgggcctgttctccttggtcccacaattccctggcttcacatttggacatgcatattttagaataagtattagttaatactgtggagaaaataatcagatcaatagtaataacttaaaattaacaaataaaaagacaatgaatcctttggtccaactttatgtctgtctacgtgtgtttatggagtgtctgcctgtgtttatgaggtgtctacatgcatgcttaggattgccatgtcctgtaaatgacaccaaattggtttataagtgagtgctcacttaaactgaaggtgcccaattaaccttcattcactttagttcacactatcaatggaatttcaaaacacaagtcttggctttcacaatctacacagcctctggtgtgaacacaatgattagacaatcctgagacagggaaatcctgctcagggtatcacgttcagggtctgagcaccagggtcgtctgtagggcaatgacaaaaactttagaggaggagcctcctctgaggggaggagcctggtctgggggtggagcctgctctgccccactgccaccgccagctatttgcttcagcaggcaggtctttctgctggaggggtgctgcttccaaaaagacagagtgcctgctctctgagtagggaggcttacgtctttggggctaatgccaaaagtcagtgggccgtagcccaggaactactcatgctttttgttcaaaccagagttcctgtggtccttcctgtggtccacatgggcagagctgtagtatgtgtcagctggttatgccccacattggccaccagattaggcctttgcttgagttttagcaagtggtgttgtctacgtgctgttttacagcctgactgatacgtctatcatggagtcatttgtgctaaggcctggaaacctcttacagtacgtattgcagcacatgagtgcctggtgtcctaagaggtcatagagggcattggattccctagaactggcatacaagcagtgccatgtgggtactgggaatggaacctgggtcctctggaagaggagatagtgtgcttaaatttttatttgcattattttgtatgtgttgatatttggcctgcatgtacgtctttgtatcataagtatctcctagtacccatggaggccaaaagaggacattggaattcctgaaattggagttacagacagcagtatgccaccttttgtgcagagacccaaactgggtcccctggaagagcattgcatgttcttaactggtaagccatctctctagtcctgcaaattaaatatattttttaaatgattaaaatagaggacaagaagcattcataactgggtaatcttggtcagaatgttagctagttggccattattttaagtgtgactccacaagaggaaccaaaggagcccctgttgcctgggagagagactgtttcccagtggtgcaaactggccaccaagcttactgctctgagggggaggagcctgctctgaaggggaggagcctgctctgcagcactttcttgactttgtgccccacaagcaggaggggtgctgcttctgtaaccctggaaagtagagtgggaagagaaagtctcaagaggtgactgttagttcttcctggaatctaggctgaatgcagatttaagaaaacgacttcaggggggctagagagttaagagctcagaaggtaagagcactgactgctcttccagaggtcctgagttcaaatcccagcaaccacatagtggctcacaaccatctgtaatgggatctgatgtcctcttctggtgtgtctgaagacagctacaatgtactcatcatttataaaataaataattatttaaaaaaaaaaagaaagaaagaaggaaagaaagaaagaaagaaaacttttcggccttattctgccagatactgaggcctagtgaagaagcctgagtttagagacctgtcttgttcagttcagtactggagtgactcagcacgacctacttcagcctgtatctgcctagctaccacagatgagtcaatttgttttgttttgttttgttttgttttgttttgttttgttttgttttgtttttcgagacagggtttctctgtatagccctggctgtcctggaactcactctgtagaccaggctggcctcgaactcagaaatccgcctgcctctacctcccaagtgctgggattaaaggccaccatgcccagcgaggagtcaattttttataggctccttgagatcacaccatcccatacatcatttcaccccataccctctgtcactcttccccacaccctacgcgtcatctcccctcaccaaaaaatccccacctccagactgagtgtggtggtgcatgcctttaatcctagcacttgggaggcagaggcaggcagatttctgagttcgaggccagcctgatctacaaagtgagttccaggacagccagggctatacagagaaaccctgtcttgaaaaacaaaaacaaacaaacaaaaaggcagttcgaggggactggaaagataggtcaggagaacactgactgttcctgcagaggacccaagtttggttcccaacacccacatagtctccataattccagttccagaggatccggtgtccttttctggcctctttgggcattgatcctgactttttcttttctttcttattttaaattttcatcctttcatttgaactgatctaaatttctaataatttacttttattttattacgttggtgttttttactgctcgcatgtctgtgttagggtattagaacccctagaactggagttatagacagttgtgagcttgccatgtgagtgctgggaatggaatccaggacctctggaaaagaatcagtgctcttaacgtctgagccatctctccagccctgaccttctctttggaggccttatgcctgtcttgtcagtgagacaaggtcaaagaaaatgagaggcagtgccactggtgaactcaagccaagtaagctcccataagtcttcagtctctgatccagtttgcattctcattctctaagccacagcctgtgaacagaagcataaggtggtcgttagctttgggagctttggggttccaaaggtatgtatgacattgacacacacatgtgtttgttgtcagattactgcgaacaacaacctattgtgttttagcttcttctttaggtcgttctggtcctggtagcaaagtaaagtcatgtttggcaaaatgcagtacaagtagtgctttcagtaaagctaataattgatcttttctaccttattctgcttcataatgaccccctggagtacatcttcatggtcctggaatgatgtttgtgtttgaataggagacaagcaggcaggcgtgatggtgcattttagtgtctgtccggtctttgtgagtttgcaggtagcctggtctataaagcaagttcctgtccaaccaaagctaaaaaaaagtaaagcgacccagtctttaaagaacaaagctgaaaaggcaaggaaggtagtctgacgaaccgtaggcccacccacctgtcaacagactgtcattttagctatagtacctgttgtgttagaaagtggctcagatccagacagatcacaccagacccacacagccccaccagaagagggttcactgggggaaagcaaggagggaagaaagagggaaaggggggcaaggggtcagggactccgtcttttatttgggtcttaacatagatgccaggtgatcatgctggtgaggagcacgtgggaagtataagctgggagtgtgtggtggttgccatgacaacagatgcaagagggtccttgttgcccagggatgacatcattcctggatttagaggctgaccttgaagcagcttctaatgccaacagtacctcctttgaggggagtctgaaaagtcacaaggttttggcacccatttcaatctttttccaaacatgagactcagaactagtggctgagagctgcctgcagtggttactgctggaagctgctgggactccaggatactggcctgtgaaggagtggttcatgagtcaagtgctttaatattgtctattagagagagaaagagaagggctggagaaatgtctcagagttgaaagcaccaacatggttgctgttctagagggtcagggttcgctatccaatccagaacccacattgctcatagccctctgtaactccagttcccacatccccttctggtgttgcagacaccagacatggatgtgatatacaaatatacctgccaagcaaacacacatacacataaaatttaaagataaatgtgatttttttttgaaagagaaactttcaaagtggaatgggttccaagagagggtatggttcagatttcaagaggtaggtgtttttaaagccgggcgtggtggcactcgcctttaatcccagcactcgggaggcaaagacaggtggatttctgagttcaaggccagcctggtctacaaagtgagttccaggacagccagggctacacagagaaaccctgtctcgaaaaccccaaaaaaaaaaaaaaaaaaaaaaaaaaaaaaaaaaaaaaagtaaagaggtaggtgttttaaaatggttacaaaacaaggcaacagtggataggaggtaaaaagataacttgaactttccttgtgtacaaaatgatggttttcccccagcaccagagctctctcatgaagaactagaattatcaaaggtcatcaagcaaaggggctttaatccatgcactactttcgatccgagtcagaccatgaacaaaagttagagtcaggtcttactgaggccgatctctaactgccttactttctctttctcctccttcagtttccggggagggatacatttcaatttctcagggtccattgtgccaatagtctgatagcaaaagtgaagggtgtatataaatgttcccagtgtgtgtgtgtgtgtgtgtgtgtgtgtgtgtgtgtgtgtgactggagaggtggctcagcaccttagaacacttatcacttttgcagaggactcagattcaattcccagagtccaatatgacagctcgaaatcatgcattaactccagttctaggggctgcgggatcctcttttgaccttgggaggcaccaggcactccagtggtatgcattagaggagaggagagggaaagggaaaggggaagggagaggaggagagggggtgggaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagggaaggggaaggggaaagggaagggaagaggaaagggaaggtaaagggaagggaaaaggaaagggaagggaaagggaagggaaagggaagggaaagggaaggggaaagggaagggaaggggaaggggaaggggaaaagggaagggaaagggaagggagatctctctcctgctctgcaaatagtaatttctgaatcaatggttctcaacccacaatcacaagcttttacattgcaattcacaacggtagcaaaattagagttaccaagtagcaagcaaagaaaatcttatggttggggtcaccacaacatgaggaactatattaaagagtcaccatgaggttgagtgccactgagagtaaaacctttcagagtgctctattctgctacctccagacttctatcaaataagcaaaatgaacctcccccaaagaggtgttgctattgagattttttttttatagaggtattttgcctgcttgtatatctgggcactgtgggcatgagtgtgcatggtgtttgcagaagccagataagatctgcagttacagaaggttgggagcagctgtgtgagttctcggagtagaactcatcaggtcctctgaaagagcaaccagtgctctgaaccagtgtcatctctacaactccgatagaggtattttttaaaactaagaaacaaagccgggcgtggtggcacacgtctttaatccccagcacttgggaggcagaggcaggcgaatttctgagttcaaggccagcctggtctacagagtgagttccaggacagccagggctacacaaagaaaccctgtctcgaaaaaccaaaaaccaaaccaaaacaaaaaaccctaagaaacaagaagtcaagacagaaggggaagcagcatagatatgtagccaaaagtaagggggcccaaaaagaacagaggttagggcacagagaaactggctaaggagtgtgtagtgtgcgtgctactttaaagaggcaggcatagctggacactgggacactctctcccattatcccgcagacgcagtgaaggccaaaggactgctgtagcttggggcaccattttttttcctgtttctcttctctctgatgcagtacttggaagccctgcagtctctgggagtggctgacaatgtgattgctctgaactttccttgccagacagacattcttcattgctgtgcacagtaagccaccaaaggtttggagaaacttcttccttctgccatcccactggcgtatgatcccatataattagtttcgagatttctcttttttgtggtcctgagaaatacccaggtgacatagattgggtttaaatgccaaactagactatggtgcgaccttgagcaacttaatacctgctaagtctcagtgtttccttctctgaagggactcaacaggtccgcacagcctcacttctaccacactggtcagggagtggaagatccatcctggaccgaacccctactcggaaagcccatcccaccctagtgccccttccccaccgcaatacaagcgcagccttcgctggcagcgagcagtgcattgtggggcttgtagtgtggcggggtccggcgggtgggcgcggccacagctccatcttccaccgcaggctggtcggtcttgctcccaggccaaatggcgccgcggccgctgggccccttggtgctggctctgggtggcgccgcagccgtgctgggctctgtgctctttatcctctggaaagcttacttcggccgcggccgggagcggcgctgggaccggggcgaggcctggtggggcgcggacactgcccgcctccctcagtgggacgagtgggaggtgagtgcgagccgccgaggtcagggaggcctacgcatgctgtgagcgcggagtgcaagcgcgagggcccgggcagggcatcgggctcggtagccccgtgggcgcggtaggagccagccaggcgacagtgcagtaagcgcagtggcgccgccccggggatccctggtagagccctcattcccggtgccggataatcgtgagatcttgggattgtcttgggtttactgttcgtggaagccaaggatttatgatgagaaagattgtgcgcgaaatcatgaggagtcaaaaagaaaagtgagacttttagtttaggactcaaaaagcagctcctgccctgcaatgtcagaccacaggtgcctgccccgggacgcgtggatggcgtgcaggggcaccgtggtgcacttcgttgtccctagggaagggagggtcaagaaggaggttggggattgcagccttcgtctctgtcccacagcccgaggacgaggaagatgagccggccttggaagagctggagcagcgggaagtgttggtgctgggcttggatggctcagggaaaagcacgttcttgcgcatgctggccgggaagccaccggtggaaggccacgtccctacctggggcttcaactctgttcggctgcctaccaagaatttcgaggtggacctgttagagagtgagcaagagacacactcccccttctccctgtcctcactgatgccccagggcctagattatttggagattatcatacaatgcatttctaatcaggacatttcccctttatgaaacccttcctgcttctcttcagggcacaagatacagaacattctaacacttaggatttttccttatcctgtgtatccaaatggtccacctacctttcaccacacatgccttacactggcagactaacagctaagggttcatatgccaggtatttgacaaacactgcttataaaataccccacacaactccacaaaactgccatcagttaacctgcctgttagatacatgtacaaacaggtttctgacaagctagatcacgaaaggtttcccccagtgttccagtgttctggctgcctgaagagggcatcggatccccctatagatggttgtgagccaccatgtggttgctggggtttgaactcaggacctctggaagagcagccagtgcccgtaatggcttagccatctctccagcccggtgttctcatgcagcaggtcctcctggccctcacgaaggggacttgtttcttacctgttctttgcatgcatctctctgcttggaacacttgacaaactactaccactcattctgagctatagtgtcttttcttccattagtcggggttttgtcatttgtttgagatggtttcatggcattgaggctggtcttgaacactcgaaccttccttctccaccatctgagtgctagggttacaggtacacacggccacaaccaagcctcaagtgtgatttgtgaatgacatcttttgaagcttacctttgaagtctggcctctgcctgactctggtcccctcctgctgcaggatttgtcactcaccctctgtccctgatgaggccaggaacactgtggtcacagagtgtatgatccatttctggcccaaaggctcagccctctaataggtacccgagggggcttattgagtgagtggtctgagaggcgactgaggagccctacctgtagatgtaggagtcttgggattttggacttctccacctgggtctagcctcagtctctgaggagttaggagggacttcgaggcacaggactaaaactgtgaagcctgggtgtgcttatttaagcactagggatagagttgagctttgagagccgaactcttagcctgagtgggtctcgttcttaagcatttgtggtctggtcatgcctggccataccttttctcccaggtcgtagcaaacattgatctttacttaggaccacccatcaagctttctctgtctcttcttgagccaaaggacaggaattcagtgagtgcctgacagaaggagcgttcactttcccacccaagtgaggtgttctcacaaacccatgttctgacggacatcaggattcagacccaaatggctgtcaggcctgttggttcacacctgtaatcccagccctccggaggcggtggcaggaaagctgtcaatcaagtcctagagcttttttcccccacaacagtcccttcacgtggtctcggcatcgtggcttggggatcagctgagaatgcacactgtggcagaactggcaagggagcacatttattactggcaacaccttccttagtgcaccacctaggaaatcgaatgtatcggttctgtccgcggtacacttgcatagcctggcctactccgagggctgctgtctgcttcaagcccctttcgtctctcccatttagaactacagttgctcccttgcagatcgtcccatggagtcagcgactggtatctttcagaaacatggtctggacccttttctcctctctctctctctctctctctctctctctctctctctctctctggaggccccttgcttgtcacgttttcccttccgcgcatgcgtggagcttgttctttgtgctgcccgagatgcttgcttttgcttcttcctgtggctagctcctcatcctcctctccgctcacacccagcctccttgaggagacatttccagatcgcccaacccaagaccagcagcacactccggccacttccccttgttttcccttggttttgattccgtgctttctagaatatgtcttatctggttgcctggtccattctggctagggagggagttcctagagagccgggactccagcctgatacccagcacccaggtgagtgcttggcacctggtaagcactcagtaagtatttgatgagtgcctactgtgtgccaagacattgtgctgaggcttttggggggatttagagtggagagagagagagaagcagaaccggattggggtgcagggtagccaagaggaactgagcagaggggcaaagaggaacagaaaggcagcccaggcgcgggcggacactgtggctaatgtcgtttggcacgactctgtacagtgttcccgagggagggagaggaagggatgacaagcctgagtgggactgagttgggggtagtggtacactggcaaggcatgggactctagcttttctaggcttagggatccctggtttcccatcagttatcattgaccagggagggagctaggaactgataagaggcaaggaagcccagcaactacggcccaatgcagccggtgcctttgggggtctgctgagacctctttgttcagtaagagactggtacactagggtagcgccctctcaggagatctgactggctctgggctgtggcagcttctttgtccctgactagtggacccttaggatccggaagtgggttggggctatgggcagagccatgctacagggagctctgctctgagctgacccttggcctctcttcagttggtggcagccagaacctgcgcttttactggaaggagtttgtcaacgaggtggacgtgctggtgttcatggtggactcgactgaccggctaaggctgccctgggctcggcaggagctgcagaaactgttggacagggatccggatctgcctgttgttatagtggccaacaagcaggtgagtgctatgggaggtgagccagttggtcttctcactgatgcctgggcataggattgcatggcataaccagccagtgcctgacatactgtccccgccctcccctttccacttcatccttccttccggtttcttttctcagtccccctatcttctgttaccctttacagatgtgatgccagccgcagtcttcagtactttattttcctggatttttttgagacatctgtcttgaatactttatgcaacccaggctggctggaactcataattctgtccctaagttctgggattgtaggtgtgtaccaccacacctcccttaaatgacattattggccttatgcaaggtatacaatactgtttccgctttattggtggggccaccacagctcagggtgacataatagaggatggtggtgctgggatgcctgcactgagctgagaagtggggtacattaagtaatgggagcacaatgttcaggcacagtgtgaacacctgacagccatcaccccgctttcgtcccgccacaccccatgataagctctgttgtttctttaaaaaaaaaaaaaaagatttattcacttactttatgcatatgagcacactgtcgctgtcttcagacacaccagaagaggccattggaacccattacagaggttgtgagccaccatgtggttgctgggaattgaactcaggacctctggaagagcagtcaatgctcttaaccactgagccaaatctccagccccaatggtgttttcttagagcctcagaagtacccagggcactgaactgttagaccattataattgatagctgatagtttatggcattttgaaccgacaggaggtgtctccgttacttacctgagttatcttagttacttgttgtaaagagacatcatgactgaggggacttacagagagtgtattgctggctcacagtttcagttttgaaaccttgaagatatacacttttccctacaaatccatacctcctaaccatcccaaacagttcactgaccttggatcaagcattcagaactgtgagcctgtgggggccattttcattcaaaccagtacaggaggcaactgaggggtcttaccatggaagaattgctccagggatcccgaaccaatgatgaactttaaagggatcagctacagtatctagtagccttttttccctttccccaaccccagattgtctgggagttaccccaccgtatgctcttacattgtagtcataagacagagtagggattccagaaggttcaaaggtgtggtcattaggcaggcggatttctgagttcgaggccagcctggtctacagagtgagttccaggacagccaggtctacacagagaaaccctgtctcggaaaaaaaaaaaaagtgtggtcattaatgtgaccttggaacctaaatctgctgtttatcatcgtgaggagctaaatgacatcactgaaccagcttcctcattagttatgtggatcctgagaaccaaggacttggtaggcaggtaccatcttggtgcctaacaagttagaaagggctatttcttgtgacaatgatggattactccatgaaaaaagggtgccacaaaatgatgaaggagggcaccgaatttcttccacaggatctagaggcacttcctgggatttggggtccagagtagtagctgaacatttatgtctgttatcatactgggatcggtctgacatccatgctgtgctggcttgtgttcactgcaggacctgagcggggccatgaatatggtggagctgcagcaggagctgggcctccttgctagttataaccagagggaggttttcctcttggcagccagcattgcccctgcaggatctggctttggggaacccggcactgtgcacatctggaaattgctcttgcagcttctctcctaagctggacccacctgcctgctgcccagccttgaataccacatttctgccttcttccgcattgttgttgctagcctaggccttgggcaggagcatcatagcaacgcttcctctcttcctcaagagcaaggccaaatccgtgcagaagtcttcccggtgaggtagacgtggggctgaggcagggaggacgccatagtgtagctccagcttgccttgccttgccttcctgcagtgtgatgctcagcaggctcagtgccccccaacccccctttgcaggtcccactgcttgcagagcagtgtggatatcacaggtacttctgagcctgcgtctcccgtctcatgtctcatggttcactcctggtaacatcatacatttaacatgtggaaaggttctgggtacagcacagcaagtcctcgctcctagtccttcattatcctccagcccctgctcgctctgtctgtggccttgtgttcctgcctttctagccccggggccattatttttaaagggagatgatttccatgtttttttttttcctaaatgccatccctggcagtgccaaacctgaaaaccttagcacagaatcttctcgacacctccccactgttactacagcctggccttgccagtctttactgaccacaaagtgcagttcactgaacagggtgaagggtggttttgcccaggtctggagacaacctgctgcttttgtactaactgtgccaacacccatgtttacacaagtctagagaaggaaggagccggagtcctggaacaagactggagctagggggttgggggggggggggtcagcctcagaatggcattttatttatttatttatgtatttatcaaaggaatgggccaaagttctaggttctgtttctaggtgctgtaatgaaaaccctaggagactgtcaaaaaagctgaagcttagaactgtttggaattatgattgagattaggtaacctatacctgtcaatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgagaccataactggaagcaagtacctcaaggagacctagtactcatggtccaggacttaggataggactagacgagccatcagaatgactcttcctgtgcccacggcgggcacatcaccaagccttctgggaccatttatttgccagccaaaaacagactgaaattctgtattctctgaagtgaacattccacgactgtgaccgatgcaaagctggaccccatgttgaccctggtgcaggcaaaagagcctcggtctgccagggacactgaatgacaacagcactgttgtttgagacagtgtcactctgtagctcaggctggccttgaattgatggcacttgtccttcctcagcctcccgtgctgggattataggaagcactgtgccatcacgcctggcgcattcagtctgctgtttgagaatcactgtgctgtttgccaattgtccaacatacagcccaggaagtggaaagcgtcgttaacgtgagcacaatcatcagaaggggggcgggctgtgcccttggactccagcccatgagaacagaattactacaggacaaagcactctcattacaagggattgtcctgcttttgtactaaatatttaaagaatgactaggattttaaagtagttgaaattttgttggacattgtatgtctgttctgaggattccgcctctccccagtgctaaagcttaccttacaaccagacttattgagagaatttctttttcctaactgaaagacctttgtctaatgcgttttatcatgtacaattgtcatattgtccaaggggtgggggagtgttaagaataaacaatttcactgtgtctcctgaagtgactttacttgaggctagacctggtggtttatgatcccagctgctctggagaacgcacagtcaatcaggctggatcagtaggtaaagcctgatgaccagagtttgacccatataaacatgggtagagaggactgacccctcaaggcaggcttcccagtgctagaaaacaaacactctctgggcactctgcacctacactagtttaggaggaactatcaacacaagccggctgcaggacgatgacatccaccccctgccacagggccagacctcagactttgattcgggtcttggcagatactttactccacaacctcagaggccaaagtcctttctggcaatcaactttctcctgcccttatacctggaagatgatgctctccagcccatgagctagcagcacggggccaacaaggacaacttgtaaagtggagtgtcaccagctctctacggtgaaagtaacaataaatgccagaatggcattattcagggcatcgtcctcatcgtgaggacggctgatacttacagttcctcagacagtgagctccagtcacttaccctctgacctttgggacagtgagttccagtcacttaccctctgacctttgggacagtgagttccagtcacttaccctctgacctttgggacagtgagctccagtcacttaccctctgacctttgggacagtgacttaatgccttttaaccctcagaaagggatctagctgatgtccccagaaaccaaaagttttctgccagctgggcaaaatggacaagtctttaatcaaaggactcaggcagatggaccccctgagttgagttagaggctagcctagtcgacatagagtttcagaacagccagagctacatagaccatctcaaaaaaaaaaaaaattcttccgcctccatgcttaggccttggaggcagcccaagtatatgccttgtgccaaacactatagtcccttgtccagaagctcagttgggcaaggacatcaggaaaaattaaaggcaccatggatgagagtgtagcttagcaagaaagcttgcacaggtgtttcatctccagcaactgcagaatagacagctctggctatgaagtttacgtgccctgggagcaaggaagatggcagtgatggcttctagaagctggcaaccaaattctgtaaacaagttgagggaacttctagccaatgacacaagctaggattgtgcagagggcagaagctacagaggcaaatgatgagtacacactagaccctaaggactgctccaggcacgggagattctagggcctcttgatactggaggaaggatgaactgctgtcttcagaacagatttgatgtcaccccacacccactctggacacctgacctgtttccctataacaaaaataaaagtgcatcttaccaaatgtcataggcaatgtataaaatatgcttttcaagagcgctgaagatacaatacacacaattgcaggtttttacatcattcatagttgaggttagttaggccttaaaatgcccagctcaaaccccttgcccgtgatcctgttacagagtaggtatcacattctcaggccactgcttgcaagagtcctgccaacagaagatggccatgccatggaaagcctagcagtggcacacggtagagtagtgcgagcaggctgccggtcccagatggcaagtttgggtccctgatgtttgatttaagccatggccaacaaaaagcaatccacagtgagcagagacctggctccttacccttctatgtcagcccaggcctcccggagagtgtctggaggaaaccgagactaggagcactgacgaggaagaaggcaaggcagcgcctacaaaagcccaggactgcagtacttgctgttgagctgataatccatctccgctcgctagtaagattagcttttcctgggacaactccagagcttagctgggcacagtaaacacaaaaatattacacaagtgtgcctttaatcccacctagggctacactgagaagcccagtcacaaacaaacaaacaaacaaaaacccacctagtcatgttacatgggtaaaatattcctttatcatgtacagaacaagctgaaacagagcatccctctgaaaagaaacagcaggccccggctttctgtaagctcccaacagaacacaaaccatggccttgaaagagttccttctccaggtggtggtggtgcacgcctttaatcccagcacttgagaggcagaggcaggtggatctctgtgagttcaagaccaacctggtctacagagagagttctaggacagctaaggctattagagagatgctctttctcaaaaaacaacaaaacaaaatgaagagttccttctccagaaggaagggggagggggcacgtaagacccgattccacaggacttagccagcatcactgatgctccacgccccttgccttacagcctggctttggtttcgttgttccagcagacctaggtctgggggtgtgccccactcagtctacctccatcttcttactctgcagagaatcgatgaaggcttgccactccgttgggtaaaagcgcttatagacattgatcttattccggatctgttttggggtgtcttggtagtaattcttctcatcccgggccatggcctataaaggaaggacagacatgtggagggatacacaggcagacgctcaaatccaaatcctagcgctgcctaaatagagtgtgccacttccaatctatccctggggtccggctctctcatctcagaagccattagagggctggaaagctggttcagcggctgctcttagagaggacccaaaacagttcatagccatctataactccagtcctgagggaatccaataccctcttctgacccacacaggtaccaggcacacatgtagtggacgtacacataggcaaaacacaaacataaagacatctttagactttttctcctcgtttctagtcagctgcagacaggccagtgagtttccccacaagcccgagtgttcttcctgtgggcagaactcaccttgtagtcctccccgtgattctctaccatgtaccgcacatagtcgatgaggtcccgagacaaggtatttcctttcttctctgggaggctggcttctgcctccaggtctgggggaagagaagccaggaaacggaatgaggatttcctgtttgtgttacatgcgctgcccaagtacctagccatccaatcccaggtcacaagacttgttggacagcagcactttcccaagtccaaaaccagaactcacgttctcaggccctagaatccccaagcctacctcctacccatcagcgtggcaactcctgaaaaccagttctcaagttgtgatttaaaacgaaaaccactacgcttaccaatcttactccgtgtcaggccccaggggcagcaagatgggaagttggattgtgtccagctccactaccaacacaaagtctcttcttggtgtattatgccagcatttgaaatgggaaggtcagaattgctcaacattagggctgcagggttagacccaggtacagcacttgtatgtgtgaaggtagaatcctgaccatggacccaatcattgttatacttttaaaacaggtaggagggggctggagagctggctcagctgttaagagcactgactgctcttccagaggtcctgagttcaattcccagcaatcacatggtggtggctcacagccatctataatgggtccaattccctcttctgctgtgtctgaagacagcaacagtgtactcacacacataaataaagtctttaaaaatatatttaagacaggtaggaagtaccagcacttagaagctgatctcaagtccatggttagcctcagctacattacaagacagtattttaacaaatgaaacccacaagtgtgtgtgtggggggggggggggcgagatggctcagcggttaaaagcaatgactgctcttccaaaggtcctaagttcaaatcccaaaaactacatggttgctcacagccatccgtaatgagttctgaagacagctacagtgtacttacatataataaataaatctttaaaaaaaaacaaaaaacaaatgaaactgacaaataaaagaaaaataaaagccagacagaattcgagtacagctcaggagcagagcacgctttcatgctaattcagtctccaggacggcaaggagaataaacgctaagcaaatgggcaaaacacagaaatgatgtggtcagaaccaatctaagcgtgaggaactaaaacttcttaaagtcaaaaccatctctgacctggtggttggacagtcccagctttgcaaaaacaatgtcagggctgtattatgtagcagtgtgaatatatgtaccaacacacttgtacttttttcttcaaggcagtgtttctcaatgtagtcctggctgttctggaacttgctctgtagaccaggctgtcctccaactcacagagatctacctgcctctgcctcccaagtgtttggattaaaggcgtgtgccaccactgccgggtcagaactatacattataaaagggccaagaaggtaaattttatgtaattctttcagctacaatttaaatcttagaaaaattcttacaggtgcctttaacaccagaatttaagagacggaggtaggttgttctttgtgagttcaaggatagccagggcaacatagactacatctagaagaaaaaacaaaaacaaacaaaaaaaaatcaaacacaattaccttaccaccttaagtatatgtggctgtgaatatttccagaagggtgtaggtcccctcgttgaactgtcgaaaattctaatgtgaaccagccaaatagaagactcaaaataatttcatgtcaagcatctgtctattcaaatcaggagatgtgaaaaaataaaatcacctgaatggaggtatggctataaggctgagtgtacacttagcattcaagaggcccagggttcaatttccaacacacaaataaaaaatgacaaggggctagagagatggctcagcagttaagagcactgactgctcttccagagggcctgagttcaattcccagcaatcaggtggtggctcacaaccctctgtaatgggatccgatgcccccttctggtgtgtctgaacacgctacagtgtactccatatgcatacaataaaaataaattaattaaaaaaaatacacacacacaataaacctacaacaggtagggaaaaggttaggcaaggattcaagaatattctcagcccggtgtggtggcgcaaacctttaatcccagcacttgggagacagaggcaggaggatttctgttcgaggacagcctggtctacagagtgagttccaggacagccagggctacacagagaaaccctgtcttgaaacaaacaaacaaacaaacaaacaaacaaagaatattctctttcctgcagggtgtgtgcctctctctacagcaggaacacatggggagtaaatgtatcactggacagactaaatgacaggccaagctctcgagtcatgagaaactgggcacaagcctgagaccttcttcttcgtcctttcagacacccagttctagcttgtatgagcgtctactaccttagttcatccattgaaatctcatcaatattagctggaaaacaactcagccagggcacagtactacttgtgaaccctggacttcttcgtttctctctctttgaatcttgggctctctggctgtagagtgaaaagtcagagtgccctttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaagtcactagaaccagatcaccccacacacggtatgttcatgctcacactcacatgtcataccacacacagtatgctcatgctcacactcacatgtcacaccacacatggtatgttaatgctcacactcacatgtcacaccacacatgatatgttcatacagttgcatatgacacccacagtaatatttttaacaagcaattcatctttctgcctatatctatgctttccttactctgctgtgtagtagcaccacaaaaaccatgtgcatgaagcagcgctttataagttacaggggagccatgtccgatagcttcttcatggggaggacttacctgccagtgcttagttataattttactaaaaaaaaaaaaaaaaaaaaaaaaactcttggggtaagccggggggtgttggtgcacgcctttaatcccagcacttgggaggcagaggcaggcagatttctgagttcgaggccagcctggtctacaaagtaagttccagcacagccagggctatacagaaaaaccctgtctcgaaaaacgaaaaaacaacaaaacaaaaaaaacccctcaagctctgggggacagaaaaagatacattctagaaaattccactgacctgagaagaaatggtaagcagaggagggggcgtgaataaaggaggtcgttaaaggtctttgaccagaattagtgcaagcaaaatgactttatcacaaatatgggaagtaagtgtgtgtgtgtgtgtgtgagagagagagagagagagagagagagagagaacaaattctgaaactctgctcagtgaaggaacgtcaggtgggaaggaaaataggaagcggctagtgtggagatggggaaagtgctttgcgttatcagtaccttcttcttacggaggggaaccgccttgttggggtccatggccaaccccatctccgccaggttctgccgcacggatttggtgtggtcccaggcatgtcgtatgtgggaactaacatcaaagagagagagagaaatcgagattctgtcacctcaccttagatcccagcccaggcccccgcctccaaactggcccctcaccactcaatccgtggcgctgccttccgacgagcattccggttcagacgctttcggttgacgttgtaaccgaacttctgcctccgagtctttcccttagccttgggcatctcgctaactgccccaacagcagctcaaacccttgaaacagcagctcaaactcaagaaccacgctctcagagccgcgtgttaatagtctccgtccacccgtgcgcgcaaggattcttgggaaatgtagttttagtagttagtgcctccacattcacttactacaactcccagaaagcaacgggcaatggcgcctgcgtgctacactcagcaagctatttccccgccccgtagtgacctcatcagaaggcggggtccggtgtccggatttgtgtcctacctatttctgtgctggtgggtatggcggctcccggtcctgtgagtccagaggcgccttttgatccgtccaagcccccagttatcgagggcttcagccccacggtctactccaacccagagggctttaaggaaaagtttattcgcaagacccgtgagaacccaatggtgcctataggtaagtgtgtgctgtaggaacggaagaccgagaggacagcggtttcgtagggaaaggaaataggggtggatcaagtaagcctggggtttgggaaggggagcggaccagaggtgtgacgaaatgacggtgcggggtggggggtgactgaaacgaatcggaatgcattgcggggcttgggactagatgaagcagactgtagaactgccctcctgttgtggctctgggaaagctgggacgggctacatccttaagggacctgcaggacccgacctgttgcctcccgcgtgtgttgtcctctccccaggctgtctggggacggcggctgccctcacctatggcctttactgcttccaccgcggccagagccaccgatcccaactcatgatgcgcacccggatcgctgcacagggtttcacggtcgtagccatcttgttggggttagcggcatctgctatgaagtctcaagcctgagtatagccgggtcttaaagcgccatggaaaccattacaaaacccaggaacaacagacatccctgtcagacttgctccctccgtttcagaccggaccttattgtcatttgggtgaggaagtggccgattttgtaactgatttgcgcttccaccgctgccccctcccgctcccaaaatcccaggttcatttcagttgg

SEQ ID NO: 1448 - DNA, 996 bp, Mus musculus
gcaggctggtcggtcttgctcccaggccaaatggcgccgcggccgctgggccccttggtgctggctctgggtggcgccgcagccgtgctgggctctgtgctctttatcctctggaaagcttacttcggccgcggccgggagcggcgctgggaccggggcgaggcctggtggggcgcggacactgcccgcctccctcagtgggacgagtgggagcccgaggacgaggaagatgagccggccttggaagagctggagcagcgggaagtgttggtgctgggcttggatggctcagggaaaagcacgttcttgcgcatgctggccgggaagccaccggtggaaggccacgtccctacctggggcttcaactctgttcggctgcctaccaagaatttcgaggtggacctgttagagattggtggcagccagaacctgcgcttttactggaaggagtttgtcaacgaggtggacgtgctggtgttcatggtggactcgactgaccggctaaggctgccctgggctcggcaggagctgcagaaactgttggacagggatccggatctgcctgttgttatagtggccaacaagcaggacctgagcggggccatgaatatggtggagctgcagcaggagctgggcctccttgctagttataaccagagggaggttttcctcttggcagccagcattgcccctgcaggatctggctttggggaacccggcactgtgcacatctggaaattgctcttgcagcttctctcctaagctggacccacctgcctgctgcccagccttgaataccacatttctgccttcttccgcattgttgttgctagcctaggccttgggcaggagcatcatagcaacgcttcctctcttcctcaagagcaaggccaaatccgtgcagaagtcttcccggtgaggtagacgtggggctgaggcagggaggacgccatagtgtagctccagcttgccttgccttgccttcctgcagtgtga

SEQ ID NO: 1449 - protein, 253 aa, Mus musculus
AGWSVLLPGQMAPRPLGPLVLALGGAAAVLGSVLFILWKAYFGRGRERRWDRGEAWWGADTARLPQWDEWEPEDEEDEPALEELEQREVLVLGLDGSGKSTFLRMLAGKPPVEGHVPTWGFNSVRLPTKNFEVDLLEIGGSQNLRFYWKEFVNEVDVLVFMVDSTDRLRLPWARQELQKLLDRDPDLPVVIVANKQDLSGAMNMVELQQELGLLASYNQREVFLLAASIAPAGSGFGEPGTVHIWKLLLQLLS

SEQ ID NO: 1450 - DNA, 26371 bp, Homo sapiens
cagataccttggcgaggtgctgatacttgcgctctggaatcactggcttccaagggacgctgcccatgtccgatggaggaggagtcatgggcgcagggtcctcgagggtatcatcatagctgactgcccggcggtatatcccgatgggcagggacatcttgcctagaggcgcactagcctcaagagctaagaacagagacacctgtcaagacaggttcagcaactggacatactagcagctttaaattaatctacaggaaggaaagctctgaaatactcttgttcttgaacagagcaaaatagcttgttttggagtagctaatcccatccaggaaaggcagtggtaccaatcccttcctctatgcctgacaccttgggtggtccacttaacccactcagccgtcctaatcctttttttttattatttgtttagagacacagtctatgttgcccaggctggagtgcagcggcacgatcacggctcactgcaggctcaacctcctgggctcaagtgcctcagcctagcgagtagttgggattctaggcatgtgccaccatgtccagctaattttcatggatcaggaaacctgaagttccatttaaaggtacttgaccacaacttcaaagtacagtttggaatccaatcccaaccaaacctatctgatttcaaagctgtgtcctttatcccacagaagccaccccctactgcaatactaaggctctcagttcgtgcaagactgaggatatgaaatgaccgaggatacgaagttctcattcccatttcatagatgaggaaactaaggcctaggggtaaagtgaccttcccaagttcattcagaaaatggctacctggggctcagccaaggtctgtgaatcctctaccttcctttcctcaccaaagaaaacaccagcactaacagaaatgtttgtggcatcactgttctgtatgatttatttaaacagtagagtcactttccatcacagaaattattgacaaccactctcacaaatcaccagctgatcctgccattcctgtccactggaactgacgcccagcatgtcgggttgtgatgcagccaccccattcaagggcactctcagctgtgccagaccagggagccaagttcattgtgtttcgtttgctaatccttgcatatcagaactaatgtccagaacctacctgaaaggtaacattttcctgtggctaaaatcatataataacactctctaagacatcaacctgcctggcaataagtccaaaaccacaaaaggtttcatttaaacggcaaggggaccaagcagctatcattattattactattgctattagtaataattaacaaaaccatagaaataaaaagaggattagaggttgccagggagtgggtggggggagtgaggatacgactgctaatggtacgaggttttcctttggaggttatgaaaacgtactgcagtttggacgggtgtggtggctcacacctgtaatcccagcactttgggaggctgatgtgggtggatcacctgaggtcaggcgttccggcctagccaacatggtgaaatcccatctctactcaaaatacaaaaattagccaggcgtggtggtacgtgcctgtagtcccagctacttgggagactgaggcaggagaattgcttgaacccaggaggcggaggttgcagagagccaagatcgtgccactgcattccaacctaggcaacagagcgagattccatctcaaaaaaaaaaagaaaagaaaagaaaatgtgctgcaattgatcgtagtgttgtttgcacaaccctgtgaatatactaaaaatcacgacattgttcactttcagtgggtgaattttatgatatgtgcattacatctcaaacacacacacaagcaaataataattactaagtcttcctccttgctagacaattacatccctcatcttatctaatcctcatgaagcagatattcttcccattttcaaattttccattttcacaatcaacttgcccaatatcacctagcttgaaagagtgcgctgggaactggaacacagacctgagccggtgcacacactctgcatgcaacacactacaaagcattcactgaatgggcacaatcctatggctcgcgacggctacacggagtttgtggtaatcacagcaacaatgaaagacaaactaaaacggagctgatgatgttaagactagagatggatctatattggggaatacgggagacttggggagcaatttcaaaaacatcttaaagactcccactgaacagccatcctaaaacaaataaagtcagctagtatttactggaaaatatgttcatataaagacagaccaaatgcactctgggcagtaaatacatatttatcactgatttttaactcctgtttttacatattttgtttaatcttcacaaccccgagagataggaaccatcatctttcttcatcatcatactttaccgagaatcagaaattaagcgattcagatgtaattaaaaatcactttcctttctcataaaacaattcaagtagtcatcaatggtgtcaataacccagaacttgactcattaagggttgctgtgagcattttcatgattaagttcaatctgccatttaagcaggctggtgcctttttaccaagacttccatcccacctccccatcacccccaaaaaggtgagtttaatcactttggtacatactacaagaactgcacaacttattctgaattattatttgataactaggaaagtaacaaacttgtcataatacccttaaatgaagtgactattctctttaagttaaagtttcatactatggctgagcggctaataaaatatttaaatgatgccaatctaaggctaggcgtggtggctcacacctgtaatcccagcactttgggaggccaaggtggaaggatcacctgaggtcaggagtttgagaccagcctggccaacatggagaaaccctgtctctattaaaaatacaaaaattagccgggcgtggtggcaggcagctgtaatcccagctactcgaggctgaggcaggagaatcacttgagcccaggaggcggaggttgcagtgagctgagatcacaccactgtattctagcctgggcagcagagtgagactcaaaaataaaataaaactggctgggcgtggtggctcacacctgtaatcccaacactttgggaggccgaggcaggcagatcacaaggtcaggagttccgccgggcacggtggctcacgcctgtaatcccattaccttgggaggccgaggcgggcggatcacaaggtcaagaaatcgagaccatcctggctaacacggtgaaacctcgtctctactaaaaatacaaaaaattagctgggcatggtggtgggcgcctgtagtcccagctactcgggaggctgaggcaggagaatggtgtgaacccgggaggcggagcttgcagtgagctgagatcgcgccactgcactccagcctgggcgacagagcaagactctgtctcaaaaaaaaaaaaaaaaaaaaggtcaggagttccagaccagcctggccaatatggtgaaaccccgtctctacaaaaaatacaaaaattagctgggtgtggtggcgggcacctgtaatcccagctactggggaggctgaggcaggagaatggcttgaacccaggaagcggaggtagcagtgagccgagattgtgccgctgcactccagcctgggcaacagagcaagactccatctcaaaaaaataaaataaaataaaataagccaatctagtaaatctaaatactcgcttggtagcagagattaaccattaatatatagttccgataaaatggtttctgtctagcttaaaacattaataagggcaaaacatgattttaccaaaaagaattaagtttaccaggcacttctggttgtcttgaagccattgaaagactgggatccaggtgctttttctatacagaattccgagctgagtccctgccacctaataaaataacaaagggcattttcttatggtgagcagcaccaatgctgttcttctggcaggcacacagaattgaacggcttgtttacaaggttgaaacacacatgcaagagccagtgggtgacaaacatgccaatgaaaaaagaaggataaagtcaaacgtctcaccacacctgtggctgatcttaacacctgtgagatgacagagctaagatgccatacatggtgaaaaagtcaccttaccacagtgaaatgatgtgatgactaagcggacagacagatgttaatgaggaacatggtccagctgctgcaaagtagcaaagcttcccaggaagagtccatccagaggttctaataacaacaaacagccagcattggaacagcccgtcagagtctgccaaacacttgtttattccccacaacaaccttgctcatttcattttcttaactcacagcaagcggctagatactacagtagggaaatttgttctttatagctaacactataaactatttacagcgtttatcttgtcttttaatccttgcagcaagatggcaaagcagatattatttatcccaatcccaatttttttttttttttttttttgagacggagtctcactctgtcgcccaggctggagtgcagtggcgcgatcttggctcactgcaagctccacctcccgggttcacgccattctcctgccttagcctcccaagtagctgggactacaggcgtctgccaccacgcctggctaatttttggtatttttagtagagatggggtttcaccgcactagccaggatggtcttgatctcctgaccttgcgatccgcccacctcggcctcccaaagtgctaggattacaagcgtgagccaccgcgcccgaccccagttttttttttaagctatctcttacagaaaggctatcccaaatttaaagagaaggaaactggccgggtgcggtggctcacgcctgtaatcccagcattttgcgagacccaggcgggcagatcacttgaggtcaggagttcgagactagcctggccaacatggtgaaaccccatctctactaaaaatacaaaaattagccgggcatggtggcgggcgcctgtaatcccagctactcgggaggctgaggcaggagaatagcttgaacccgggaggcggaggttgcagtgagccgagatcgagccactgtactccagcctgggcgacggagtgagactcggtctcaaaaataaaaattaaaaaaattaaaaaaatgttaaaaataataataaagagaaggaaactaaaaatcagaggagttaagtaaatttgtccacggtcacagataagtggtccgtgcgcaaggtaggtagtttcatgcccagtttacaggggagttaaaacgagggcctgagaaagttactcttgtttttcagcttgctataccgtccctctatcccgataggactcagacagagcaaacaagttattgatagttcttcactaacgagcatcgcaaaggccgaattcagccatcctcccagtccaggggagcattcccgccccagacacgtccccttcccctttccctttccctgtgcccccaccccccagctcaccgtccctctgcctctccttcacaatatacaagacggtgccgccaggatacgaaaggccggctgcttcacccacccctccaggctaagattagggccaggaccctagccgaaggcggggtgtggggagatgaggttgaggacaagccgcgggggctcgggctgggctggtcccacgaagcggaggggaagcccgtacgggagctgcagggcattcccggagagaagccccattacggagaccccagagagcggagccagggaggcaagaggcgacccagccgagctcgaagccgggatgaagggttaagaggtgcggggagaggggagtggcttggaggggccccgagatcgggcctcgccggaagcgcccctcctgatcgccagagaacgcagccccaagggagggcccaggcccgccatctgttcacctgtgatcctgctgccgcgggactgcctgcggcccggagtccggcactaaaaaggttccgagggcccacgtctcccgagaggctgtggcgcagtctggacccaagccattgtgagagcggcggcgatttcgaaggtccccaagacccactaggtagcagtaccacccagcgggcaggcagcactgcagataaagcctccggagaccgcgggatctcgcgcgagacttggcccagcggagcacagggcatgctgggagttgttgtccacgatcgcgagacccgccccctccccacgcccttcgccgcccagcgagttgtggagccgcagctccgagtgtggaatccgccagccccgagaggaaacgccacacttcaccaccacttcctcagcgcgtgtgctgtgcctgggtccgtgacaagctaagggaagacggaggtagcatagtaaaatgacacccacaaacccaagccctcaaggctcaaaaagggctgccaagtgcgagcacttgtcatcctgtttttcccacttcacggaggtgaagctgagactgggagagatgagaagtcacttcgattagcaagcggtgcagtgagcacggactgtctcccaaaacagcggggttaggcagggttcgtactagtagctgaaccaaaaaagggaaccgacctcacctgcctcccctagggaaggcgatcctaatatcatttctcttttacataaaggagagtgaggcttagaggcgccagctgaggtgtcagtcacatcctgaaggaagacttctcttatccctgaagggttcacaaagaaggcgaagcaacgaagttacagcagaatttgcaaaaatctatccacgtttctaccccagtccaaagctcgccatcaaaactcatctcaggagagctatgattggtggtgcagggtgaatgtcacatttagatttcagcatttgaggcttccagccgtactggcagaactgagaggccttgctcatgcgacttgaaacttaagcgctgtttccagaccagggtgcttgagtgcactaagaattaaagtctttgatgaattctataattagcttatcaacagcacaattacattgcagtataattgtgtgtatatgtgtgcgtgcgtgtgtgtgttaaaggtgttcctttgttaatttggagcttttaaaatatgccatattttttaacctctgtggaagcaaagctggcaccttgctctttatccaccacaggaagggatgtatatcacctctcagtcagaaaaggaagaaatagcactttgcacccttatgtagatcataaggtgggatcatctcatttatttcttagccacaaatacatgaaaacttaagactttcctggaagttactatttgattaaaacaactttttctggctgggcacggtggttcaggcctgtaatcccaacactttcagaggctgaggcgttcgagaccatcctggccaacacggcgaaaccccgtctctactaaaatacaaaaatcagccaggcgtagtgacaggtgcctgtaatcccagctattctggagactgaggcaggagaatctcttgaacctgggagacggaggctgcagtctgccttgtcctaggtacccccagtgactgccaaggcttccacgtgtgtagcacgaggaggaagaacaggagaaacgacctgagtacagcagtcgggttcttttggctctccagaggggtgacgccatgtacggctggctgtagggtacatgggtcgagagaccgcctgtggctctcagggcccagcagggctacctcttcccctttatattgtctcaactcttcacctccttttagttcgcgattcctctgtacccctggctctgggtcccagcccctattccttctgatttgtccccctttccctttgactacatatatatgctcctctcctcccagatagtgatgttttagctacatcttatttcttccggcattgattcttttgaaaaatttatttctggctgggtgtggtggctcatgcctgtaatcccagcactttgggaggcctgagatcacactactgcactccagcctgggctacagagtgagactccatctcaaaaaaaaaaaaaactttatcctgatatttgtggtaccaatgtctgaagctgtcatggtcttggtgcatagcacctatgtgagagcacctatttcttttccacaaataatagactgtaaacattttttttttttttttttttgagacaaggtctcgctctgttgcccaggctggaatgcagtggcgcaatctcggctcacagtaacctctgcctcccagtttcaagcgattctcctgcctcagtctaccaagtagctgggactacaggcgcctgccaccacgcccggctccacgcccggctaattttttggattttcagtagagatggggtttcaccgtgttagccaggatggtctcgatctcctgacctcgtgatccggccggctgcctcggcctcccaaagtgctgggatcacaggcgtgagccaccgcaccagccaaacttttaatcttagcaattttgtgggttttcccctctaagtgggtgtatttttgaggaggagctaatttttttttcttttttttttttttttgagacggattcttgctctgtcacccaggctggagggcagtggcgcaatctcagcacactgcaacctcctcctcctgggttcaagcgattctcctgccttagcctcctgagtaggtgggattacaggcacgtgccaccacgcccggctaatttttgtagagatggggtttcaccatgttaggcaggctattctcgaactcctgacctcaggtgatccgcctgcctcggcctcccaaagtgctgggattacaggcatgagccaccacacccggccagaaataaatttttcaaaagaatcaatgccggaagaaataagatgtagctaaaacatcactatctgggaggagaggagcatatatatgtagtcaaagggaaagggggacaaatcagaaggaataggggctgggacccagagccaggggtacagaggaatcgcaaactaaaaggaggtgaagagttgagacaatataaaggggaagaggtagccctgctgggccctgagagccacaggcggtctctcgacccatgtaccctacagccagccgtacatggcgtcacccctctggagagccaaaagaacccgactgctgtactcaggtcgtttctcctgttcttcctcctcgtgctacacacgtggaagccttggcagtcactgggggtacctaggacaaggcagtcagccctaaacattctgaagtcctgacactgcttaattcagcctgaccaggaccccagcaaaacccctgtggtccgggaggcagcgaaagaaggctagaggtggcggggagccacggacctgggttctattcctgcctctgccaccccactgccgtgtgatatcgggcgtcttgcttcaatttcctcccgaggtcttgagggatgaccgggagacagatcgcttgggtttgaacgcaggctacaccaaagcactacgatgcggcgttgggcgggttacttaactcctgggcctcggttttcccttctgcgtggtatcattgtaaggggtaacggagaaaagccgtgagctaacccctggtggatgctagcaagcaccgccgtctcccgtcctccccaggcacagcctctccttcctccaccctgcacctggcagggggaccggaggtccccgcgcgccggccagcgccccaccacccacgccgccgggtcccgggcggcctgccgtgacagcggcagtgcattgtggggcttgtagtgcgggactgggtctgggtgggtgggcgcggccgcagcagtcgcagcggggccatcttcggcgggcgagtgggctcggcctgtgcaacccgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtcgagggcttggcagccgcagcgcacaggccccgcgcgggtgggcggtcagagcccgggaaccgaggaacgggtgggtgtgcttgggtgcgtgcggcgccttggcgccacgccgtcgctccacgccatgaggctcgggtgttccagcgggggccggagtttggagggcgcggctcgggagcatcccggggcccagccgggtcggctcgcgcccctccggcgcctgcgcggtgcaccccgcccgggggtggggatgtcgggagaaaccccatcccctcccgcctgcggtcgggactccgagaccggtggaggaagcggggcgcgcgagcgtttaaggaattcgccaagggtttggaattcaggactgcaaaggcggcgttcgtcccactcatccagaccatgcctgcctgtcccaggacgggtggaaggcgggcctgggccctctggtgccttcggtcttccctcgggaaaggtccttcgggaggccgccagccgcaaccttacctccgcttccccgcagcccgaggacgaggaggacgaggagccggcgctggaggagctggaacagcgcgaggtgctggtgctggggctggatggcgcaggcaagagcacgttcctgcgcgtgttgtcggggaagccaccgctggaaggccacatccccacctggggcttcaactccgtgcgtctgcccaccaaggactttgaggtggacctgctagaaagtgagcggacaccctaccccatctccccgtctcctctactggaccagtcctggattctctgcagggaagggggcttccaaaatgcatgtctaagcagcacattcccctctacgaatccttcccaccgctctctggggcacaggattcagcccacgctctgtgctctgacatttagggcccttcgtgatcgggcctctccagctgcaccgcctgccccatcacccctaccaaagtcgataggcctaacacagagatactaacagctaagggttcatatgccaagcacttgacgggcattgcttaagaaaactcccctaaacaattacataaaactagaatcggtcactaccctcgttatctccagaggaaaatgagttccagcagtagtatcatgaatccaaggtcacccacctttctagtctttttttttttttttttttttttgagatggagtctcactgtgacacccaggctggagtgcaatggcgctgtctcggctcactgcaacctcctcctcccgggttcaagcgattctccagcttcagcctcctgagcagctgggattacaggcgcccgccaccacgcccggctaatttttgtatttttagtagagacgggggtttcaccacattggtcaggctagtcttgaactcctgacctcaagtgatctgcccgcttcgacctcccaaagtgctgggattacaggcgtaagccatcgcaccccaccattctagttttttttttttggagacagggtctctgtcgcccaggctggaatggcagtgggcagtggcacaccctcctccactattgcctgtctggcccaaactagtgtcatctttcctctcagcaccacagcctcctctttggtcttcctgcttccccttctgtccctagtgtcagctagagaaaacccatgtcaggtaatgtcactcttgcttaaagcccttggggggctccccaccccctcactgtggtctttggccccatgtggcccgccccagccagcctcacagccatctctttctccttcttgcagtgcctcagcaccccagccttctttctgtttcccagacacttccagcatgctctcccctctgtctggaatgctttcctctgcctcttcccatggctggctccttctcatcatcccactcagctcacatgccacttccttgatgagacctacccagaccacccaatccagggccaacccctgttccacctcagccactttcccttttttctgttttatttctttcctttttgaaatgtgttgatgtcattgccatgtccttcccagttagggagggagctccttggtgcagggcccctgcttgccttgctcacctctgtatctgcagcacccagatcagtgcttggcacctagcaagcactcagtaaatatttgttgagtgcctgctatgtgccaggcattgtgctgagggctttgtggggattcagaggtaagtgcctctgactctcacagcttagaatcctcaagtgtcagaaacatagccagaaacactagggtgcggggtgaccaatgggactgtgcagaggagcagagaggaaaagaaaggtgatccaggctgggggactgtgttggcaaccatgtgttcataggatgaaatatgacatttccaagggaaaagaaggggatgggggaaactgaatggagaatggctgtgtataggcagggcagggggtcctgagttttctagacaataggactcctggctcctgtcacagccatcactgacagttttgaacctgtaggagaaagctaggaattagcaagaggcaaagccagacaacccaggggagagaactgaagacttccatttactgagcacctgtgtgtcagtcccgtgaaaggtacatcgcacgtggtacctgtgggttttactgcaacaacccgttaggaaagttcagtgaggagactggtgcttaaagctagggacttgccccaagagacccgcctatcagagctagagctaaatccagtctgagtagctgcggaaactgcggtcttttccttgcccccggctggtggaagctcactaagctagaagcagggtagggtgggggctgtgggcagtgagcgggggcccggggtggggtgggggctgtgggcagtgagcgggggcccggggtggggtgggggctgtgggcagtgagcgggggcccgggaggctctgagctggcccctggcctctcctcagttgggggcagccagaacctgcgcttctactggaaggagtttgtgagcgaggtggatgtgctggtgtttgtggtggactcggctgaccgactgcggctgccctgggcccgacaggagctgcacaagctgctggacaaggaccctgacctgcctgtcgtcgtggtggccaacaagcaggtgagggctgtgagagggcagctcggtccaggtgacatccactcagagatgcttgggcaggggcaaggagcgctgcctgggcccatggcctggagagggtggctgagatgctgcccccacctcttctacctatgccctgtcctgatccctgcctctgtcttccttcctctttgcctccctatcatctcgtactctggagagatgagaaaaataattattaagtgcctcctatatgccaggcatggtgttttgtttttgttttttttttgagacagagtcttgttctgtcgcccaggctggaatgcagtggtgtgatctcggctcactgcaacctccacctcccgggttcaagcaattcttgtgcctcagccttccgagtagctgggattacaggtatgtgccaccacacccagccaatttttgtatttttagtagaggtggagttttgccatgttggccaggctggtcttgaactcctgacctcaagtgatccgcccgcctcagcttcccaaagtgctggaattataggcatgagtcactgtgtctggcccccaggtgtggttttgaataacatttcttcttatgcttctgttgaccctataaagtatgggatgctattcccattttatagatgggacaggctagtcttataatctttccaaggttgtacatcttgagagtaatagaattggtccaggcgtggtggctcaaacctctacctccaacactttgagaggccaaggaaggtggatcatttgattccaggagttcgagaccagcctgggcaacatggtgaaactccgtctctacaaaaaaaatgcaaaaaattaactgggtgtggtggtgcctgcctatagtgccagctactttagaggctgaggcagaaagatcacttgaacccaggaggtcgaggctgcagtgagctgtgatcacactactgcactccagcctgggtgacacagcgagaccctatctcaaaaaaaaaaaaaaaaaatagtggaattgggacgtgtaatgctaaagctgtaccttttccactctgctatgcccttgcaaattctggctctagatcagagagctgaagctggtaactgatgagaggtagaacaggttaaataacagctaacatttattgtgtgcttacggtgtgccatacatgtggtaagcacctgacaatcatgacctcacttccctctaaatacctcgtgataggccctgctgttacactaaatacctggagttgcagctggcatgtggcaaagcccaaacttgaactcagatattcttcaaagttcctcctcttaaccagtgtgctgtacctctcttgggtgccagagagtcgccttgggcccaggaaccctcagtatcacagaccttgggtcccattctcaatatcaggtgaaactgccagagtacagagtctgatcatatttcctgtggcctaaactcaggtgcctctgagagctgtgggacctgtttccaacttgacatggagagagactgtatgtcttcgacctcagattccccaacctattaggaaacatttgacaattatttataaatagggtgactgtatgtccttttctgtccaagacagtccccatttacgactcttgttctggcactattaatagtgcccgctctgagcctcagattgccccagtttggaccaggaatcacatcatgtcctatttataaactaatttatagcagttttgaacctgtaggagacaacatctaaggtcccagcagtctctgaattgctccaggaagaatcatttaaatcttgggccagggttgaaattacaacataccatcaccagtcatgctgtgtagtggtcccttgttttcttccagctagtttctagaggtcttgtctggaagtgatcctactgtatcatctctccatgactgagtttaggaaacttggttatcaaaccaacctgagttggcacctggctctaccacctatcactgttaccttagctcaatgatgtcacctccctgagctacttttctcatcaattaagtgtggactgtgaacattaaataagctgaagtatatacgggcctatctacaatgcttgacacataggaagtgctctatttctagccgggcgtggtggctcatgcctgtaatcccagcactttgggaggctgaggcaggtggatcacctgaggtcaggagttcgagaccagcctggccagcacggcgaaaccccgtctctactaaaaatacaaaaattagccaggcatggtggctcacacctgtagtcccagctactagggaggctgaagcaggagaatcgcttcaggattccaccacaggaggtggaggttgcagtgagccaagatcgtgccactgcactccagcctgggtgacagagcaaaactccgtctcaaaacagtggctaatgatgcaatgaaaagaggttggtacaaaggagagcccagggtgagggagagagcattgagtttaggccaaggggtccagaggctacttctgggaacttggggcctgatattcccggggatagcctaagaacagtgtgtttcctgatattcccggggatagcctaagaacagtgtgtttcctgatattcccggggatagcctaagaacagtgtgtttcctgatattcccggggatagcctaagaacagtgtgtttcctgatattcccggggatagcctaagaacagtgtgtttcatgaacgacaagggtgtcagtgtgttaggaaatgctgccagctgtgttcggacttctgtgtctcacccaggacctgagcgaggccatgagtatgggggagctgcagcgggagctgggtctacaggctatcgataaccagcgggaggttttcctcttggcagccagcattgcccctgcaggacccacctttgaagagcctggcaccgtgcacatctggaaactgctcttggagctcctctcctaggctggagctctcctgcttgccacctgcctgtcaagaccatagttgtcctgctgctgcttcattgccagactgggcctggggcaagagccacatggcagcatttcccttttcccctcctttgcctttcaagagcagggcctgggcaaggccaagaaccatgcagaagccttcctggtgaggtggccgtgaagccgaagcagggaggtgggtgagacagagggtggggaggatagtgtctggctcattccaggctggaatgtggatccagctttcccttctcttacctgtacagtgagatgctcagtgggctcaatcctccactacaggtcccggtacctgaggaaccagtgtaggtgtcagaaatactcctagagcctcaaggtctcccagtccagaaacagtctggtgacgtcatgcccttctcatgtgggcagcttctgagtggtgacacagcaagcctttgttcctgtcctgcattgtccagccccagctccacctaagtgacttgtggccttgtgcaatctctgcctctctgaccccagggccattatttttaaagggaggtggtttcctaattcggagatgcctttcccagccatgggagtgtgaagtgctaggatgaacctggccatcctagcaaggagctttctgaagacctccctgcctttccctgagcccaggcctggcctgccagcctctcttgactacagaataactgatattcacccaccaaacagaaaaagtgaaggctgggtttttcccctctaatctggagacaagctgctgctctcgtactaactgtgccagtgcccatgtttacagaagtcaggggaaggaaggagcctgtgtccctgggacgacagtcaactggagctaggtgttgacctcagaactgcattttatttattaatttataagcagaacaggccagagttctaggctctgtttctaggtgctgttttcaaaaccccagatgacagtcatagaaaatttggaacttaggaaaatagctggaatcatgaatgacaatgagataacatacagatgtcagtggagacaaagttgtgggttcctcctcccacctggctttgaggctgtcgtcgatatcatagtactttacatggattcacatgaactgaaacgccaccacttggcccaggatgttgaaagggtgcaaattccttctgggtagataagaaatgactctgggagaggatttcccttatgtgaatctaggtaaaaagatggaaaaaaattgtattatgtgatcctaaggacaggaatagcagaccagccaacgggatggccttgggtacatcactcagcctttctggacccaatttttccccagtgaaagccaagttggactgaatttctggagttctcatcagtgcacattccatagttctccagtgcttggcgatcagcccaattgaaggactggctctgtactgacacttattatcggtacaggcaaagaggagcctgttgtctgttagggaccactaaatcaacaaccacaaatggattttttttttaagaggagctgtgcacctcaatttgctgtctagttgagaatagagattgtgtgccttcatttcatttgacatttacccagcatgcctcagttccacaccgtgaccagtgtaagaagaggaactatgataaaaacagttcaacaagccgcaaggagggtgggaaattctgaagtccagaagcgagtgtgatctttggaatagtggctgctgtgcccttgggcgccatttgaagaatcactgttcttgaaagtgctggttcactttctgcagtaagaagtgatttatgggcttttatgtaaaattttaagaatgacttgggtttcagagtagcctttgaaactttgctggcagcttttcattttgtcattggaaggctaagagacttttctcctttgttctatgaactccttgttcttcagggcttgaaggcaaaaaaaccttagacaactttaacgaagtttaaaaagtatgttctgtttttgagcagaaaaaagattcgtgaactggttagtacttagcaccaaaagcagttcagaatgctcagccccacaatgtgtgtaggctacatttatagccagagaaacgaaaataacttaggttgcctgattggctgcagtctggcatttgccttacctgaacatgttttagcagccttcagccgacgattgactgaaggtttggctgctgtgattggctaaaattcggctacttgttagaagaacatacttttaggttaggttacgagttgtttacacgttaagttacaattcactgtgtacagaggcagctttaggccagacttaattcagcttcacagtgtccctcattttgctcagccccttaattttgagagattgaccaaaatcccacgcactgacactaccttctgtcactatttgacctcattatggaactcacagtttacaatgttaaatcagttagcggattctgtatgtcttcatgtttctgttactctaaccgtaatgagaccatttgaggtacaaaggatgactgcattggtgtacttaagactacaacacatcagtggggaccttaggatggctatcaggagtgtaataccaagaaactggaatgcatcccttaatatgagtctccacaaaccaaactgattggaatcaaacaactcaagttcagacgataaaaatagttcaacagcgtgcaagctctgctgctcatagcctgttcagggtataatggcaattaaggacatagttcactatgaagtaccttaattgtaaagtgtttgattttttagttagcttttggtaacacaagtcatggtgattgggatacccactaaaagaaacatgaagattagaaaaccttgaacagctaagcttgctgtctaccattcaggatgcctgcaaaccaaccactagctgctcctgcaaacacattatgtgttccttttccctgagaaatatccttgatgtgtttggtggcagtatctacagaagcggcagccaccaccgccttttgaagctctccatagtagtagaatcaggaaagataagcacagcattcagttttgttcagcaccatacacaagctcctagctgggcagaggaaatctaaagctgcatgaagttccattacgtgtttttgttgaacacaggtggcctcatccatccatccatccatccatccatccatccatccatccctccatccgtccacccgtccacccgtccacccatccacccatccatccatccatccatccatccacccacccatccatccatccatccatccatctgtggcttctacctgtgcgaatctctgtgctacaaaattcttttcaatttagcattaactttaatttccatacagttggcacctcactgccgccaaaagtgagtccgcaggaactccactggaatatttgctcaggggaaactaactaatcatctgtttcaaggttggtattcattttagtctttgacctctgattatggggactttcagggaaagctgtttgcaaggtgagcatgaatcaggtgaaacagcaagatctgaagtcaggacagagtaagcaaattatccacagacctaatatgtaccctctgaagctggaaagtgggggccacctggtagcatttgagcaggggtcacttatgttcccccataagtctgcacagctcctaaacaaggtccagtgggcaacttatttttatgtggtccctttatagcatgctgtaagggtgcataaccacagccagtgagaaggaaccctactggatttaacccagtgacattatataagcaatcgcttggagccacataggtagttcccaggtcctgaatatgtggtgcctgaaagcataggtgtaggcagtgttccttgcataggcattacctggacaggtttttttccatattggcacttattaattgaaaaggtcagggtaccacttccaatgagtgtagggaagcaagcagtagtggtgtttagaatatcaaggttagctgctggatgcggtggctcacgcctgtaatcccagcactctgggaggctgaggtggacggatcacgaggtcaggagatcgagacaatcctggctaacacagtgaaaccctgtctctactataaaatacaaaaaatcagctgggtgtgacggcatgcgcctgtagtcccacctactagggaggctgaggcatgagaatcacttaaacttgggaggcagaggttgcagtgagctgagatcacgtcactgcactctagcctgggagacagagcgagactccgtctcaaaaaaaaaaaaaaaaaaaaggttagcattccactcttcctttggggtttcagggtgacttattgggaaaatggagagatactggcattaatggaatcgtttcctgatttgagcgttaagtcacaaacccaacaggaactccagtttcttgctagagcattagcctttgctaaagccggccccagattatggtcccacggattttcccataaagaaagggaaaggatttgcggacagaaaataggaaagagagggagaaagataagatttttgcgattgcagtgaagtcttcatccacatctagggaaagctgttcatgtctaggacgtgatctgcttctggggaaaaacttccctggttagctttaccttaaagtctccaacaggtgtgtagttccaggagtctggagaggtccttttgagttgtgagatgtggacccaaggttcgaagccctgaagttttaccacagtgtgggtaatagaagaacttggtattgtctctttctgtgaggtttaagggcactttttctctgataccatctccagaagacctagtctcaggttacagattgtgaaggctttgatggtcctctgtgggtcacagaaagtttattttattttgtcaaaatacagtgtgacataatgcattatagctttgtagtatttagtggcatcagcatttaggagagtaggaactacgtgaagttctgttaggagcacaggctttctagtaactatttcataggggtcaatctgtgtctgtcgtaggaatggatctgatctgctgaccaaaggcaatggttggctttcttcttcagagatcagaaaaaaatgaaattcaaagccaatggtggtatctttggccaagataatccaatcgattcagttaattttgccaattttagttttaaaatatttgtccttttgacctttccagaagactgagggtgaaagggacaatggtagtaccactgtgtttctaacactttatttagctgcttcatagtttgtccaataaaatgagttcctctgtcactggagatttttccagagatgccccataaaggaaacacatgttcttataactccttagctactgccatagcatcagctctcctacacaggaaagcttctatccaaccagaaaacatgccaactattacaagaacatactgatacttaattgagggtggcagttgaatgaagtccatctgtaagcgttcaaatggtccatcaggtgttggtggaaatacaccacttggagtttttattatcttccctggattatgggtttgacaaaccagatattggttataacccatttcagcattttacagtggtcacactatcagtattttttataatctggatcatcttgctcatttgtgaggtgcagaggttgttttttgtttttttgttttgagacaggatctcactctgtcacccaggctggaatgcagtggtgcaatcatggctcactacaacctccacctccagagatcaagcagtcctcccacctcagtctcctgagtagctgggactaccagtgtgcgccaccatccccagctaattttttgtaatttttatagagagggttttatcctcttgcccaggctggtcttgaactcctgggctcaagctgtcagtccagctcagcttcccaaagtgctggggttatagggaagagccaccgtgcctggccaagtgcaaagcttttaacaatagaagtttcaagggctcaggaaggaccagggggccatctaggctctccatgagttcacgcttaacattatgtttacgtctgtcagataacaattttggttttccacatcaggtgcattgcactgttagatgggtcatcataaaggtcatcaatctagtggcattcattcaatttgcacatcctaactgtttcagcactatctgatttagcatgaaaatctgccagggcagtcccttgatattcaggttcagctttccatgtatgggcttcaatcttataagaatttgttatttatttttcacctttactcaagatagcttggaacttataccaatttgtgatggcaacaggatagtagcaagttcatccacttgagtctgtttttaataggggctccactagaagtgagaaaccctctttgtttccataacatgccaaaattgtggactgcaaaggcatgtatatatacatagcatgtctgctatgtatatagcattttctgatttccctttagctatatgataagctcaagtgagagcaaaagttctgcagtttgagctgactgaaactgggaagagtccactttttattaactcattttgggttttaatgacatattttgccaaagaataatttcaaatgggggccgggcgctgtggctcacgccgggcgtggtggcaggcacctgtagtcccagctacttgggaggctgaggcaggagaatggcgtgaacccaggaggcagagcttgcagtgagccgagatcgcgccactgcactccagcctgggcaacagagcgagactctgtctcaaaaaaaaaaaaaaaaaaaaaaatttcaaatgatgttggtctacttgctgaaaaatgctgggtttgactggaatttaatagactttccacagcacgtggaacttgcaaaaaaaaaagttcactccctaaaaccagatcagatgaaccctttaccaatctgggggttgctgccactgcctttaaacaattgggatatgccttagctatggggtctaattgcaggccatgatatgtgatgggcctgtgctttcccaactatgttcttttttatgtatgtatgtatttatttattttttgagatggagttttgctcttcttgcccaagctggagtgcagtggtgtaatctcagctcgctgcaatctccgcctcccaggttcaagtgattctcctgcataagcctcccgagtagctgggattacaggtgcccgccaccacgcccagcttattttttgtatttagtagagatggggtttcaccgtgttcgtcaggctggtctcgatctcctgacctcaggtgatccacccgcctcggcctcccaaagtgctgggtcaactatgttcttgagtaagaactcctgatgcctgattgttatgtttatgaacaaacaaggtgaagggttcagtataagttggaaatcctagagcaaccatatctgttactttccatcctggttatatttcttaattagactgcgaagttctgaatgaagtcctttttaaatagagcagttaatgccatttctgtctctgcaggtttcacaagtagtgtttctaaatgagctctataatctgaaaccggttcatctttcttttgcccacaagattatgtgattgaccaatcaattttttgtggaaaagccctagggattgaatttaaaagatcttcagcaattcttccagttcctttttgcctcctcttggggttttggagtggtctttagtatcctcaggctgtttccattctgctcctgctgtcaattttcaagcttcaccagtatcatgtgaataaattggtaaagattagagagtcctgaatcataagctcttatgaggattctcaattttccagtacgtttttgagtattttctcttggattagttaagtctttatgatggctctaagctcagctttagaccatggagtaaaagtggttacagcaggcaggctggttgactagagagtctcactttgtaaggcatttgtccaacttcccctttttcattagcctcaaggagaaaaggtaactgagcaaaagggttactgtactcaaagcatcgaggcaaagaagagacagagaaggagcaatccaggttcatgtgctgcatgagcctttcatttgcgttttgtaaagaatcttttaggcaattttagatttgtataatcctttagatgcctctgcataccgatttaaaatgcatcccgttgtttttgtggcgttttcgatcctttcttttctaatgtgtcccataaataaacagttttatttaaagtttcctcatcgtggccattttaattctaagttgttcctagtaaggttaacctgtttttctaaaaacaagttctgggtccataattttggtttttttttttttttttttttgagacagagtcttactctgtcaccacccaggctgtagcgcaatggcacgatctcagctcactgcaacctccgcctcccaggttcaagcaattctcctgcctcagcctctcagcctcccgagtagctgcgatcgatcacaggtgtgcaccaccgcccagctaatttttgtatttttagtagggaggggtttcgccacattggccaggcaggtgaggtgatttgcccgcctcggcctcccaaagtgttgggattacaggtgtgagccatcacacccggacttgttttgttttttgagatagagtgttgttttgtcgcccaggctggagtgcagtggcgtgatctcggcttactgcaacctctgcctccagggcacaagagattttgccacctcagcctcctgagtagctgggactacaggcatacaccaccacacgcccaactaacttctgtattttttgtagagatggggttttgccatgttgcccaggctggtctcaaacttgtgagctcaagagagcttcctgcctcagcctcccaaagtgctgggattacaggcatcagccaccacacccagccccataattcttacatataaaattagatggagtcccagactccttggattgaaacaaacccgttatcaaaaggataacctacccaatgcctctaactggatccatccagtttattatgggatgcagtccaatccaggacccagtccagtaaaaattgctcagataaacttggagagctcaaaacacaaatttatggagctcagaatcctaggaagaactcactatgacctccagttgctgtgaggggtcagtgggcacaatgggccctggcagataccttttttgcatggtcactcagtgctcctggaggttgctgaagttatactttggatcctacttctgacaccagtttgttaaaagaaaaattttatagacaagttaactttaacagagcagaaaagggttcatgaaccaggtagtgctcaggaccaaaagcgatggttcagaatgtgtgcaggctatatttataagcaaagaaacggaattggcatacagagatagcctgactggctgcagtctggcgtctgccttctttggacatgttttggcagccttcagcctatggttggctgagatctgactacttgttacaagagtagactcttacatcaggttgcagggtgtttacacattaagttaggttataattcactatgtacagaggcagctttaggccaaacttaacaaaggtcacctttggaaccagcactaattgttgagggggtccctggggtccctttttacctaatgaagatctgtctgagtctaatgaatatattgtacaatttttaaagtccccagttgtgggaggtgaacttgaagaataaagtttcattatgtttacttgagctgcttttatcaagaccactctcaaaacctcaggtcccagcagcacactgagggcactgaagatccagagtgtcaccgctctctgatactggtacagaatgtaggtgtcctagagcctgtgggttggtggtc

SEQ ID NO: 1451 - DNA, 783 bp, Homo sapiens
atggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtccttcgggaggccgccagccgcaaccttacctccgcttccccgcagcccgaggacgaggaggacgaggagccggcgctggaggagctggaacagcgcgaggtgctggtgctggggctggatggcgcaggcaagagcacgttcctgcgcgtgttgtcggggaagccaccgctggaaggccacatccccacctggggcttcaactccgtgcgtctgcccaccaaggactttgaggtggacctgctagaaattgggggcagccagaacctgcgcttctactggaaggagtttgtgagcgaggtggatgtgctggtgtttgtggtggactcggctgaccgactgcggctgccctgggcccgacaggagctgcacaagctgctggacaaggaccctgacctgcctgtcgtcgtggtggccaacaagcaggacctgagcgaggccatgagtatgggggagctgcagcgggagctgggtctacaggctatcgataaccagcgggaggttttcctcttggcagccagcattgcccctgcaggacccacctttgaagagcctggcaccgtgcacatctggaaactgctcttggagctcctctcctag

SEQ ID NO: 1452 - protein, 260 aa, Homo sapiens
MAPRPLGPLVLALGGAAAVLGSVLFILWKTYFGRGRERRWDRGEAWWGAEAARLPEWDEWDVLREAASRNLTSASPQPEDEEDEEPALEELEQREVLVLGLDGAGKSTFLRVLSGKPPLEGHIPTWGFNSVRLPTKDFEVDLLEIGGSQNLRFYWKEFVSEVDVLVFVVDSADRLRLPWARQELHKLLDKDPDLPVVVVANKQDLSEAMSMGELQRELGLQAIDNQREVFLLAASIAPAGPTFEEPGTVHIWKLLLELLS

SEQ ID NO: 1453 - DNA, 123920 bp, Mus musculus
  misc_feature (1)...(123920): n = A,T,C or G
cctgatgaagccctgtgatttttaaaaagtcaagcacgaaagcagaagggtgattcccattttgagaattgcccaacgttcctatccaatggctgattaaatagtttgaaatcatcacatgggtcattgcctacttgtggatcatgggaaacaatttaaggggtgggtgatcagctgattttgccctttaataaaatggagcagaataaggtagaagatttctgagaactatgtagaatggagaagtgtttctgcatggtgagtgcagatgggattgtgagcctgatggtctctatcaataaagattgacagctacagtctgtgtgcaccactgacactgttttgctgaaatgtttcatgttaggtagactacctctctcattgacaaatatggcacccttgtcctgccaagtgttcatagcatccagttttgttgtgacaaaagagatttcctttagcataccccttctccacttctgaatgttcccagagcactactgagcagatgtcaacctttgaacctatagggctgagggaaaaggaagcttgtcttagtcagggcttctattcctgcacaaacatcatgaccaagaagcagtttggggaggaaagggtttattcggcttacacttccacatttctgttcatcaccagggaagtcaggactggaactcaagcaggtcagggagcaggagctgatgcagaggccatggagggatgttctttactggcttgctcactctggcttgctcagcctgctctcttatagaaccaagactatcagcccagagatggtcccacccacaaggggcctttcccccttgatcattaattgagaaaatgccttacagctggatctcatggaggcatttcctcaaccgaagctcctttctctgtgataactccagctgtgtcaagttgacagaaaactagccagtacagaagctatagcctgctgccaatcccagggacctcttcccagtggtacccagaggattcaggttataatggccagagacaagagatagtgtcagacaaggtgtgggcagaagagatggcatgtcactgcccactctcaaaagcaaggtgaggctatgtcatttataaatacccatcactttggaccaatgtctgttcccctttctggcttagttcaaggacacatttgacaacacttatacttgacacaaaaatagtagtcccatctagcatattcatatttgccacatcttgtgcatagcattcaaagagtggcagccattgtctgtgtatcgatgggggagccaggtagaatggagggcaaggagcctgaagctatggagctctgtttgcatcatatcacacaggctgctgtccaatgacagcaaggagattcctcagtctcactagttctctattaagcagacctgcacagctaagcgtccatttgacttgcgaacaacgtacaaggtctcttttagtcctaggtagctttcttagatcctaaaagccttaatccaacaaaaatgcattttttcttgttcttcccaaggtgggtgggtgatgaagtttatctaggagcagtattagcagcatgtctaggctggaaacagtaaatagatcattgttgagacagtttttgaaacctaagtgtattcccatgtgagtgattctaggacagagttcaacagcaggtgctgcagtgtgactctagactctccgtgactgtgcacacgaggcctcaggagatgcttagctccaactcgaaagcccagcatgaagctcgggctctgactacacagagactggggagctggacttcttaaccttccttccacaaagtggttctgaggcaggcactgcacaggctagaaaacaaatcaaccatggctgtcgagtgctgtttgttagagcagaaccctctctggctgggtttaactgagcgcgtagaaccttgggacatcttaaaggcacaaagcgtgcattcccagatctgatgcgcagtgaccttgatgccgcgtgtgagaggactgggcagagagaggggcaaaggggagcagtcaggactttggattaactgtgacgctgggcaagtcattacccccaccccccaccccggaggccagtggagctggtcttgaaggtctctggatattctgctctagttgttattctatgactctgaacccaaccctattattagattggagagaccaaagtattcagtgatacggctgatacacaaaaatactcaccgaattactatgtgtctgaatcacttaattaggggctccaggcactttctattattatgactactttttccaattcatgagatttgaatagtagagagaactagtaactttcctaaggtcatacagcctataagggactatatttgaatttaaaagtttgtagtccaatttttggataccttacattgctcatacatcacagactgggtagagttccccactatcctcttggaaacaaacatcaccttcctctattttgtggcttttggaagaccaaagtcatcttcaatatttaagcaagttcccaggggccagtatttttgtgtttacattggatgctggcctctgtgactagtaagttatagacattctatagttcctaatagcatagtcttattgcttctgggtcctggttgtagctcatcagtgtgtgcttgttctgttattttggccaagatacagagcttctgtccccatcagtgccataagactccagtgtcctagcatgcctgtgtttggtagacctaccaaagtcacaaggttgtcggttccggaagaattcttgggaatggaggggcagaggaaagagaaaatgagcatctggtagaaactggcttgtcttccttgtgccttttaaagaagctgcttctcgggtctcatccgggagaggaaggggaaaatatttattcacccattgtttctgcttgccattgttcaaagttgtccacatattatttcctgtgcctttgcaaggggctcatgtgtgcacaacaaatgagccccacagcatcccacacttccggctccatgaagtcctgtggcaggaaggagaagtggttgagagttaaggcgctgtcaagttgtgagcatggcaaatggtggatactgcggtgacttcagtagccaaggctatacagtggccacagcaaatggccacctgggggcaggaaatgataaaagagggtgctcagggaagctggagaggccagagatgtgccctgggttgtacagtccacctgtgagctgcacaaagttgttcccagtcaagaacagatattggtcttaaacagaagtccccacctctgtggttgtaatttccatagtttcagatacctgcagttgactgtggccctaaaatatagatggataattccttggcttctatttcacactaccatgtgcacaccatctacctcacttcctgtcaaaacgagacattgcatcattccatgtcatcacaagagaaggatggagtatgtattaaggagagcgcagtggagagggagggggcagggcagagagagtgaggaggaggaggaggaggagggttacagcaaggtgagggagagagggaaggctacatccacaggcttttattggccatgttgatgtgactgctctcatttatctttatttcatgcttttgactcttttaccgtgcctaatccatatagtacattttatcaaagtcatatatatgttgtttttttttaaatggtgcgtgtggggttctgatccatctgcaattccaggcatccactgggggggggggtcttagaatgtaccccagagataagagagaatggttgtactgttgcataggacctttcattttatgggaacacaatgttcttcatatattttaagaaaagagatgaaagactggtagtcagagtcccttgtgagaccacggctaactgacatctctgcaaagccagagagtaaaggcaactccatccccagctgagcctcctgctgcctcctcctcctcctcacccactctagattccctttgttctcagcccactcttcagatgctctggccagtttgcctggagagacggtccagacttcttcatccttttgaagtttagtctcatgcttgctttgactgctcttggacctcctggccatcatcctgagttccagaagcaccagaaatcgtctaggttgttctctttatctatatgtgtcttctgcctgtacaaagtagcagctaggatggctcctggtgcccattgagcctagctgtcctccccctgctccccatcaacacacactctatttttttgcctgttagtccactgtcatgagaaactcaaaatggtctagtcaagccacagcttcaagattcatggaagcgctattccattggacaaacttttctgctggatgccaccaccctgacctgtgacagcccaggctttcaatgtttctctggacaaggaaaaaaaaagacttaatcccaacatgctcccttgattttcagacccaagtatatttggtcctcctatctgtgggctctgcatctggggattcaaccaaatgcaggttaaaaccagacattctgactgtactatgtgcatacttttcttgccaatatcccatgaacaagagagagagagagcaagcacatgcatgtacaggtcgcaataataactaaatttagaccatggatttgagagagaataaggagaggtcttgggaggagttggggggaggaaagggaacggaaggaaataaggtaaaaatttaaaactaactaaacgaagtatgtaggagggttgcatagatatgcaagtattatgacattgtatatgagaaactcaagcagttttgtatctggtgtcagaagttctctgtgaatactgagggacatctgaatcctagatccttaagacagggacggcaaatcagcgtcagctgttttggtcctggtgaggaagactccctccatctgtctgttaccagggtgatggctgggctttctgaggggtgtcatggagatctcagtgtgggcatctgtggccagtgggatagacaatcagcatcgtcagtgactagacatgcttcagaggggagggctccataccgctggacaagaaggaagactgactgacctcctcaggacactggttgcagagtcttctctgtagtaggtggtctgtagtgagcagtgtgagatgcataggcttcgggcatatggaggccagcccacattcctcttccctatgttttcttgtgtgtgtggtgggggtgggggctggtggtatctgaatggatgcttgcttgtgtggagaccagagatcaactttgagtgttccttatgttttgagacagaatcccccactgaacatagatctcaccatttgccattgcttgtagtcgggctctccaacaagcccccaggatccaccagtctctgtgctggggttataggtgctcacaccacactgggtgtttatgtggtttttaattccagtcctcggacttatatctcagataccggagctgctaacatcccctcggccctccctgggacctcctgtcctgaatcagccatccttgtctttcagactgctggccatcatccaagaccaacttctcaggcctctctctaaggccactcctccctccttcagggaggtaggccagcacacaacctaagggtgtaccaagagggagggttccttcacggtcactatggagggagatacagttgtatgtctacaccccatgaggacctgcacagcaccctcatttatctgcaacacagctcagttctccccttcccttgctcactggttacagtaaaccacccacgaagctggagatgggagttgaagaaggggccttggtataaagcaatagaggacacaggaggctgcctacctgctcccatggtttgtttacctgtgtttcctgtaccgttggggcctaacctcaagtacccctgtacactgagcttccggcagagcctttacatcagcaacttgacttctgcaggaaaagtcagctgggcgttcctgagacttctttctcactttgcaatagaaaagcagaagccatccagaccccagaaagtactgagggcagcagcagtagcagcaccaggacttaaaaggagaaggtgtgccaagttcctggaaaaatccaaatggaccgtggcatacgatagcaactcaccctgagctttgccagatggtagcatcaatggtagctgcaaggcagatgcagtgtatttcctggaactgatcagcacagcctttggcagtgagttgcaggatgatcctgcaagtggggtctcagggaaggatccaagtgtgctttcacatagtaaagatgggaatgtattatagtgttttatcctgcaggtacatggactcttcagtgtgcgctatcatgtaacccataggaatgcacctctgtagtgcttgtccctctcctatgttgatgacatcatactaaccggagcctgtgagcagtgagtgatagacacctcagatactgggtcaggcacatgaatgtgtgaaagtgtggaagagaaattcccttctctcatcctaggctccccagacaacagcatctggggcaagtcttaggtgccactgtacagtgagtatcatcttagagaacaggggtgaagtcctgtggtagggaaaaaggaagagcccattagaggcattagctgtgtgcattgtgagagaacatttcaaatgacttgagaaattccacaaaatgtggctggaggtgtagctcaaggggaagagtgctcacctgctgtgtgcccagcaccaggagtatttcctgtaagggggtggggggggggagaaggaagagaccaagagtgagaggaaggttaagaaattactgtttttgaaacacagcatctagaagaaaaaaagaagtattagccattttccattggctaaaaaattggaagggggaatttaatcctatcatgcttgtagacagaataggctccagggccagagaaagcattcaggtaaagagatgtaggtgcagccaaggaacaatggccactatgcacataaatgacaagagagaggaggtaggaacacatttgacagggcactgggtgtttgcttatgcaccctctctcctgttttctcttgcctgtctggcttgtcagactttcaaatccatcattatgtgacatgctgaacaacacgttttctaagcctcctctgcatagacactgctgaggtctcctcagagtacaagcccctcctgggcagcagacgtatgcagaacagttgtggttttctcctggtcatccaagaggcagccctcttctctggctactttaataagttcacttctagcaggctagtgaactctgccttttctgtccattaatcagatgcacaaggcaggctttgtgtatctcctgtgagataccaaagacacatcctacccacatactgaagaaagtccagttcagaatgccgtgcactgagtcttggtaaccttttctcggaccaggtctggggtgctccttccaggttccagtgcccttccagctgctggagacagtctgaagaatgcccttgcagacagagcctcctggaacatttggctggattataggaaaatggacagtctactcatttagtcaagttctggagaattcaggacattaaatccccagtctccacacgtcccagtcttgcagattggcctgaaccgtggtaaacaatttagactagctggggtatgacatgacgcttccttttggctatttctacaactccacattgaatggaaggaaatcacttaagccctcgcagcactgtctgacaggaggtggaatgcctcacttggcttcctgccccatcagtcccacacccacaggggaccctctcccgctccctctcagctcctaggcctgagatatctccggtcttaggccataactcccaccttcaggccaaatttcaacacaacaatcttgcttgccttttccaggtgaaggagaagtaaaccagtacgatcggccaggttctgtttccagtcaccacatgagagaagacccaaggggatctttgtctttagatttcaaggagctgggtctcgggtgcttacctagaaacaacaaatgtgtacacaggacttctctgagagggcggtaaaggaatctactgcagtatccagcactgatgagttgaaccacagtcaagccccatcagctgaatacaggatgtaccttcctcctggggcaggtcaggcttgtggcataaagtcatcttatatgtgtaaccaaactgtatctgtgtattaaacataagctcttccctatctcatttagacacggccgtctctccatagaccccttgtttgctcgtttggaacagggtggtaagctctcaatccagtttcactctgacttatgagcaaagacagacttcaagtgtggtattaagtaggactggtcctttgtcttgttgatgggtgaagcagaaaatggtggcaaccatggtaaactggaggatattgcccaactgatgaaattccaataaaatctgacatcaaaaatgcaggttccatgtcatcaggtctacctgaattctaatagtccacaaatttggtttttcaatttgtgtgcatatatttgtatgtacatgcatgtaggagtgcccacagaggccagaggagggtgttaggtcgcaggaactagagttgctggtgattgtagcctactctatgtgggtgcctggaccttgggttctcttcgagagcactacatgcttttaacccctgagccatccttccagccctacaaaatatggatcttaataaacagttcataattataaaatgttgttattattaactttttaatttggaagctatcactgaccaaacttatctgcggaccacatggagacccaggccacctgtttatagccactggctctaactgtcaaacagaacaaccttgggtgcgacaatttccttaggtaaatctatctaggaagtcagttacagatctggctggtgcattttacaagtaatagagaaatccagacccaagaaagccaattccccatggttaatcatttgtaacaagtgttatacccatcacagaaggcacaaaaggggaacgagagttcaaatccatagacagggtgaacagatgtcaaagccaccttaagtgggcagtatccttagaatgccccctaacttccttgttagttccttggagccctcctggcttccggtgcctcggtcccttaaaagccaatggctctgcctgtcttgacccttgtggtgtgtcctcacccccacgtttcctgcagtgcactagttagtaactgcaagagctcctaaggatagcgtttttcaagagctaagctcccaattcctgccttctgtgttgcttgttagttaaagggtgtcttgttcccagcgggcaggtaacacacctgactctatgtgcctaggtcaacattgagaccttactcttttcttcaatgttgattctcttgtgtggctcactggatggatgccttggtaaatcgtttggcttctctggacttcagttccccttggtcaaggttttgggattccaaaatattcagagcacaccccacgagtccttcaaagtcctcgctctgtgtatgacttccgtccccaccgtgttactctggggcatgcaagtgggatcttggctggcctgctgggtgtggcacagcaaccaggagcgacttcaaccgcgtagctttgggacactgccactcccctctgaatctcaatagcctagtctgtcatgtaaggaaaccccagcgatcccagccggccctgggttgtggagctctgcgtctgcatgcggggctttcctcgcgggttacataaggctctggggtggcgggaagaagggggcgtggggaggcgcagcggggaccggcggcgaggtggggcaccgcgcgtgggggagcgcagggcgcggcggagtcgggtttcagagcgcgggtgactcaggcgcgggcagcagcggggatcccgccgtcgccaccgagcgcagcctttgttccgcgggcgaagtacagctggggtccggcggctgcaccatgacacacaggtaggacccgcgccccgctccccctgcaccttcgcctcacctcctagccgccgcctcaccttctctgccaccgcttcttgcaggaggaccgcgcagggccggcgcccgaggtggctgctctccatcatctccgcgctgctctccgctgtcctgcagacccgcgctgcgacaggtaagccacagccgcttgggtttgcgcgcccgggtgctacggcgcctcattcctggacataaaagggagtacttgcttggcgcggcgcacagccgtcttgccctgggtcctcccgggccccccgggttcctaggcgctgagatgattgcctcagcgaaggcacacaagagtgtctgggctggacgtggctcaccagagcgggcagagaggggttttagctgtacagtgacaacacactgccaaactatcccaaagcgcgctgggctcccgcgctgaggtcgtgcgcactgggctgtagggtgagcaggtcccatgtacactcagtccatgggaaaacatggtcttcggcagggataccttgacatcctagtcgttcctgacataacagaacagagtcgctagcgtgtttggttcagcctgagtcactagaggtccccatccctgccggacagaggcgcagtggatgatggactaagcctgagaaactgatctttctttctcttctatgggcctcagtttcccctgagaggactcagaagctgttggattaaagtgggtctgacttaaagtcgaactgccggtgtgaattgcgcctctgttgggtgactgtgggcaacattttttcactctgcatgcctcagtttcctcatctgagaagatctggtaaactagaccctcattgttccagaagcgttgagaagtgtaacggacagatgggaaataatgtcctttccatgagaataagtgtcggaaagataccttgctcttctcaggagtgcctgtgttggaaagcattgttggggaggcttaggaagtggcaactatgaaagccagaactcaaacccagttgggcaggttcctgtccctgctcagcctttgcattatgtactcagcaaaaccaggcttttggaacaacagccctgacccgctttggacttagagaagtagcgcatagcccagttgaaaacagtgaaggcggagaagtgttgtatagtcccctaggaagctggtccaggattggtggtcttgtttgactccgtagttacttgaaaatgcctggtatcactccgcccgtgatctgcaagggagcaaggcgcagatgcaatgatagcttttcctgccagggcgcccagcctggtgtttcttgcagatcaaagggcagttggagcagagttctggcttctcccaaggatagccagtgtggaaaccttgcaatttcccatatgacatagggctttgccaagtcagcagcagagggcagctgatgacatccaatgcccctttgggatttgaagagggctcctggagccctgagctgtatagatcttgcatgaggtttacacggttaattcttactcagccttgcattgaatgaggtctgaatgagttcctgtctcagtcactatcccaggagctggagactaaggacttaagatatcctattctgagcacactgaatccaagtcctagctttctaagagtctagagtaggatttgatccaggtactcttactccagagactttgctgtcaaccatcaatcaaaagagtttcccagacagagatggccttaaggtcccccagttcccggtgaatgctctaaagggagtgtcctcctcatgagaggagtccggtccacctccaaagctcttatatcctgctgtgcttcccatctccttactaagagaagaggcccaggaggggctgcaattatcctaaagccactcagttgttccaaggtagttgtaccacagttgttctgtggtagactgcaagtctgtgggctctgagggacattccccctcagggccacggttcaactggctgttaggaaaagaagagggaaggaaggnnnnnnnnnnnnnnnnnnnnnnnnnnnnntcatttgtccatgagcacttggccttcattggtagaagtccagctggaagaatctatgctcttgaccactaaactaaatggttaagcttgtgtcatttccccagtagctaggcagcttcttaaatactaaatattgattacaccaccatctagtgactctactcctttaatgtctattcaagtgaaagacaaatcatatgcccactcaaaaacttttatgtagccgttcataatggcattatacataatggcaaagtatagaaagaagctgggtcattaactgctaaacaaatgaataaatcatggtatatccactagcgaaatattattcaacaataaaaagtgagggagcacagacccatgctacagtatggtaagtgaaggtggccaggtaaaaacctgcaagttacccgagtccactaacaaacttccttaaaggggaaaaagccacagagatggaaggtatccttaattgcttaggcctaggggagagagcaggggtgactaaaatgggcagctggggactttgtaaggcctgggctgaggtgctgtgctgccacaccgatgccttacctcacttcactgtcttcagcacgagcaacactgcagacctcagcaaacctgcttaggaaaacaaaaacgaatgcactttgcagacatccaatctcaggtgggtgaaacttcttgtctggttcccggacatagagcctgcacatgggtggccacttccagactgccagccccatcaagtactggctgccttgggaaggctgttctgagtcctggctgctcctctgggtttccagctctattgtctgtgctgtccctgaatgccaccataggcaaagctcctatggtggggatggaacacaggcatatggtaatcttcagatagtggatttattactaagtagatctttgctcctccatgacccagttttgaggattggaaaacccaggctttatcatggacccattctttcagtaagctgagatgactaaagtctccttctgagcctctattttaccatctctgagatgggatggcaagatttgctcagctctgtgtttcttctagttttgaacactggacaataaaacagtatttacgccatctggttcagcaaacagattgagcacacactcagccaggcctcctgcagactgggaataggaaggagccaggcccagatctcccctaggaggctctgagtttacaggtagaaagaaaaggtcacatctcattccatatttctctcatcctgagggctcctccgtcatggcctcttgtgtttctgaagggtcagggcaaggctgctggccaacattgcaagctctctcccagtgaaatagctggtttgaaatggctgctgttttggaggttggaatggctgctgaagcaggtattgttgtgcctgttaataaggtactggtgtgttcaaatcatctgcttcctttgctttctcctgagggaacaccttcacctaagagtgcgccttgaaagtccagcccagctgaaatagtaggaagcagaacacccgaggttttgacctgccctggttaggggtggggttccctacctctcaggggtgattgtcacctggacctttatagttgtcagatctgctcattgaaaaaagaagacaacctaaacgcacatccctaaatgcctgggctctatcttatttgactttgagccttttccacaagggatatatttttcagtttctagttttctctgaatattaaggttttgagattcctgtgtgaggcaaattgtttgctctgtggtataatagtgccctccgtgactgtacctgctgtgagttttccgttttattttcagcagcacatgggctgtcatgtacctgtggaatctgacagtggggtatgactgttgtcgtgtgcatctcaggacatgtgtgtaggaggcattttctttagtttcctatccagatggggtgcagggtcacaggggtgaatattttccacataagcaggtatggctggcatgcctttctctgttgtgggcatcaggaagtgagagtccccatcctcacatcccggccagcatctggcctcatcactgcatttaatgtcaacatttctaacaggcgccaggtagaatcctaatgaagcctgtatttgtattttcctagctcgtgcctatgtgtatgtgtttctcttctctctgtgtgtgagtgtgggtttatgtgtatgtgtgcacaccatcatcttgttcttttaagacaaggtctctcacctgtcagtgtagactgtctctcacctgtcagtgtagactgtctctcacctgtcagtgtagactgcctgtccagctagccctagggagctacctgcccagtactggtgttacagtgtacactagggtcagtttttaacatagatgttagggatgtgactcaggtgctcatgctggtggtagacacttcactcacggacacatctcgccaggcttagttgatcagtatttcgtatgtttatgaaccatttgtaaatcttgactgttaaaaaactgatgtgaagcagggcagaggtggcacatgactttaatcccagcacttgggaggcagaggcaggtagatatctgagttcaaggccagcctggtctacagagtgagttccaggacagccagggctatacagagaaccctgtcttgggaaaacaacaacaacaaaccaaaccaaccaaactgatgtaagactattttaaaatatggacacagggtttcttactgaacctggagctcagggattaggctagacttgctggccagccagcccaggaatcctcctgcctcagcttcccagcaccaagatcactgatatgcactgctgggcctggcttttatgtgggtctgaggcttcagactgtgaagggaagcccaggcagcacaaccagacactgtctcaaaggctgtggtttcgaggatctcccaaactattctccatgggggtttcatccttttaggttcccaccaacaacacgtgcggggtttgcacagatgggcaacacttcttcctctctattgtttttgtagccacctgagtgatgtggagcagaacctcaccgtggtgtgagtgagtgacatggtgtggcatctccctgtggagtgtctaagtgacatggagtggactcgcccacccgagaacagaatgaagcagagggctcattcttgtatatggagatggatctctcttaatcatgccactctctggtttacttgccctgacagtatctaagatgcacttttgcttcttgcttcagggacccacctcctcaacagacagagaacccattggcttaagctcatgatggacagctataggtttctgaaagagatgtttggtgccaacatctttctgcccagacaccccccttctaaacatgcttctgttccccttcatctggcaccccaccttcccttaggattctgctctgggagtcacccctttccacttaagccttttgagtgcctctcagtggcagggcactcagactgtatggtgaccactgacagctcctgcatcccctgctgcacaagaaaagtcacaagacaggcccgggccttatctaactctgagccccagaatctaacacagagactgccacacgtggatgcctagtagggctttttaatgaatcaaggcaggaaggaacgtgtctatctgacttttcctctagtatagtgtctcaccatatcctccatggtacataagccatgccaaacctcagccctgccaactgtagagtaactgggtaatcagagaattctaagggacttgcagtctccttccataactttataactgagctgtctgggtttgaactcatgtcagcccactccttgtcagttctgattgtataagctaggcgacccatttatttgctgactcatttatcctcttatttctaatggtcactgtactctagggcagaacaatcatctttcctcttatggataaatttctgagtttaactttgatggcgaccacgcagtccatttgaaatgggccaaagatgaaggtgtaagctgcagtcagttttattctacatgggggtgagaattcctaagtcacggagtgtgagttgttgcccaaattgtgttgtttccttatacatgtcttaaaattttaacaatataaatttaattctttaatttctatattactctttactttcattcaaaaacatttgtgtgctgcctgtgtgtgtgcatgtgtgtatatgtgcatgtatttatatgtgtgtgtgtatgtgtgtgtttaaacccacatagctttgatgattgttgtcttaaaaccagatcagggaagtcacctcggtttattcacttagacatggattctttttttttaagatcatgtatttatttagttatttacttattgtgtgtgatatgcacacatgccacagaggatttgtggaggtcagaagacagctttcttcttggttctcctttcccggggatggacctcaagccatcaggcatgggtgcaagcacctttaccccagagccatctcaatggtctaagccatgacttctttagtaggttggttgttagatcattgcctcaggaaatgattgggctcctggagtacactggtgtgggtaagtgagggtggacaaagctagtcagtctcacacaattcaatgcgagacaacaatagctgaggagaacgcataaacaaatgcagggctttgtagttggagcatgtgactgaggggtgggaactggtgctgtcagcagagcccaggaaaaccaagatggtgtcaggggtcttcttcagaggagtcatgtttgctagctgaccagattctgctcatcattaatgaaaggacaaacagtctaaggtaagagtagaacctacaagaaggtccaggcctattcctgagcagcatagaatgaggagatgatggaaccagtggacttcagtgagtgcagcccacgtgacttctccataagactttactcagttctactcaactaagcccaacccaaccccatccaacaaaactaatcagttctttagtccaactgaaccagcatggcataactgattccatctcaacccaactcaaaccaatccatccaaattcagctcaagtcttttcagttcaatttaatgtcatctcattcagtacaagacaacacaactgtattcaactcagtatgacccaactcagacaactcatcccaacccaactcatcagactcaacacgtcctgatcctcttcagtctgtttttgtatccatggtaacatggagacataaaagaaagagaactgttctgaaaggactactctaaagtgatcaggattccagctttaggacttagggagcacacttttggatttgggaagcttggctggagtctggcttgcaggtagtagttgtgggaactgacatctgttttgatgagggtctcaaagaaagaccagctgaaacgtctctcaattatattctctttaaactagcttcctccccaaaggatctcctgacaatgtcttcagatggcccgcccttctgtcatagctgcttgtggagattactgtcttctccccataattcctggctgtcctgttcttttagggacctctggagtggaggtggggtagttagagaggcagattcactgtccctcctgggagagacccactggaggcttgaatatggcaggtggcttgtatgctgaaggcttgttctgagtgtccccataggctgaaagaactcgcgtgcactactaaactagggacatccacttccactgaaaatgggtaagatagaggggtataaacagtgtgtgtgtgtgtgtgtgtgtgtgtgtgtgtgtacatatggagattaaaggacaaccttaggtgtcaaccccaggtgccatcattgtcttttgtatttgttttgtttgagttagacagggtatctcactggcccggaagtcaccaagtaggctacgctaactggccagggagtcccagggttccttctgtcccctctccagcactggaattggacatactacagtgttcaatagtcagcctttaggagagaagaatgttaccataaaaagtaattagagtgatacatagtcactacaaaagcctagagtcaaacaaaaacaaacaaacaaagctgaaaacaaaaacaaaataaaaggattttttttggttttgtttttggcttggtttggttttggtttttcaagacattttttctgtataacagccctagttgtccagaacaactttatggaccaagttggcctcaaactctcagaaatccccctgcctctgcatccaagtgctgggattaaaggcctgcattaccacaccctacagatttgtttgtttgttttgagacagggtttctctgtgtagtcctggctgtcctggaactcactcagaaatctgcctgcctctgcctcccaagtgctggaattaaaggcatgcaccaccactgcctggctgattttttttaaaataaagatcacataccatcttatgactgtgacccagcaataaagaaagcctacttacatgcgggagaatctctttcacaattgttaccctcatgtgaataggcccatctattagagagcagagtatgttgttgattgctcttgtcccataataatcatctagatacttcctaaacagtcgctgatcatctttgtgattgaactagcattgcacggtatagataccacaattaagctggttctcttgtaggcctttagccgctgctgctggctcattgcaaaccctactgtgatgaccgcaacatcatctctatttgatgactactgtggttattagtgaccgcaaattcctaaaacaaatcgttggagactttgttgtggtcttcggccaggccatggtaatttacaatcaggccacagccagggagaaagcctctgcctcctgcctttgacctggaccgctgcctcttcaagcctaaatgaaaaaatagcgacagccaaggggccagggtctgcacacttcccccatgcttctgccagggtctgcatacttcctcatgatcccgccgtagccaaatggattcacggcttctcttctccatctattcacccattttgcagtgccttgtggtaaatgctaaagtatttctcagaaaattggaacgtgaatgtgcacaaacttggtatctacaatccctagaaactctagagattcccaaagaaccactctccggttgttcttcatctaaactgagctccggccaccagtgagttttaagagcgtctggctcaaccaatgctaaggagcagcagtgttaataacaaccaatccaagcagggcatggtagctcccatctatgatccctgcacttacaaagctgaggcagaattaccaggagttcaagaccgccctaggctacatagtgatatcctgtctcaaaacagcaaacaacacatacacacacacacacacacacacacacacacacacacaccccaccggcacgtatacacgtacacacgcacacacaaattcatgtgtatacaaagtcaccctccagttcttttagaaggagatggtcttgagtcccagacagaatctatatttgaccacaacccagggggcagagctggcacccaggaagagatttaggatatgtggttcatgcctctggtctccagggttccgggttcaaatcttagctctactgtttccctttgactgctagatttgtctttctcatctttaagctgggacaggatgagaagtgagtcaggagcctgtcactgatggcaaagctcaatgcctcattaaccccttccgtctcagtgtggattcctttctaatacttacctgtttccccagcacaggccatggcacccaaaggccacattgaacccttgaattcattgaggaatgaatcttcaaagcctggggctgaggggatcccagagaaaacccagcatcataagtcctatgatatgaatatctgtgtgctggaggctacttagtccttccttctggttgttggaggtggtgaggagctgaaagcagggcttacaacatagacaaattaggaagagagtgtgtttgcaggctggaaatgttgcaaagtgttagagagcttgtgcagcgtgaacaaaaccattggttcaatccccagcacagcataaaccacatggtggttgtactccatagaagttcaaggtccgctacacaatgagtctgagaccagcctgggctaaacaagatatttcctgaagagcaatccctgtttggtttgtcatgctgggaaattataactgttctacccactggaatggagataccaagatccagctgatgagtcaccatttcatcagtactctgtgcttctccaccctcctctgcttctccaccctcaatcacacaggcttgcagctgcttgcctctggctttctgtccagcccagagaagtacagtgacaagctggaggttaaggtgcaaattgaaaacagagccacatctacagggccttctggcttctaggttagtgctctgggacttagctgggacctggatactgataagtgtatggtgctttctatgcatttttattaaaatttgtcacacgctatgttttaatcacggtcccaccaactcctttcagactctcaactccatgtccactccaactttgtgtttttctctctcagtctctctttctccaaagaaaccaaaacaaaggaaaaatcaaaagaaaaagaaagccaacaagacgaaacaaaacaatctacaatctggcaccttgtgatgtggtcagcgccctctgcttctctacctccagcagagtttgttttgcattgaccagtcgctctgggcacaaggcccgccttggtgtggttggtatatccagtgacactccactgtagaaaacgggcttcccctttcccagcaggtatggagtgtgtaacttcctgatcaggagtgacactctgtgcttgcttccccttctcagtgctgggagtttgtctggtttgaatctctacaggttgtgtgtgtgctgccacgggccctgtgagttcatatgtgcatcggtcctgttgtgtccgggagacaccgcttgctggcactcatcggccatctctggctcttacaatctttctgcctcttcttctgagcctggagaggagggggtttgatgaatttctatggtttaaatacatactttggttacagaaatgtacgtgtttaatatttaccaactataaatacatatgacatctgtgcagtttatatttatcaactatggatatatgtaattatatgttatatgtagaaattatatgcatagtaagtgtctatatgagtctatgtttcatatataaattgtatgtatatataagcttctaaatattaagtgtccatgtgtgtgtctggcatttagatatgccgagtgtacatataagtacactatgaattagcgagtgtgtgtgtgtgtgtgtgtgtgtgtgtgtatgtaacacacctaagtcccaatagtcctatggtgggcgagagttgagtctcagcgtaacaggagcacccaggtctgctccatctccagtgtctaccctggtattcttctttataatgcaaccttcacagtctctggcatctttctgttctgttgtggtctgtgaaccagcaccacctggggactccatagaaaggcagagtctccaccccattgggaacccagtaagtcagaatctgcattctaatgacctcatggcggagcttattaactattattgttgtttctgattatgttgtcccagactaaaatctttcccatgataatcactataataggcagagcaacggtcttccaaaggcatccatatccaaccccggtcctgtatcgggcaatgtggcaaagaagaattaaggttacaggtgaagggacagcaccctggatgacctggctggaccgagttcatccacaaggtccttgagtggaggagagaggtggaagtaaagggaggctggagtggtgtgaggatgacttgagcagctgagtcacaagccaaggaaagaatgtggtcagcctgaaggaactggacacagcaaggacacagatgttcccctggaagcttccagaaaaatccgtctttcctcccttattacagcaagacctattggttctctaatgtccagctaagtctttgctgacctgagccctgagttcatggcgactgataaaagtagaactaggcagtgactacaataattagtcctatactccctctgtggacctactaagtgccactctagcctggtctctcagaccttttgttctaaatccttggggagtcccacctgatgttctgaaggcatgagatcagggtgaaaagagcaaagcacttagcattgggctggcctgtgggctgaacttgggctacctgctcttgttgaaggagtccttcatgcaactttgccacaggttagtcccaaccagggaacccgtgtgcccctcaagctcaccatgggcaggaggcagctatggccaggaggaggattgtaacagagactagccagagcctgtgttggcattctcttgctctttgtctgcccaggtaagtttctatacattcctgggtctcactttcccaatctgggaaacgaagaggtcagatcaggtgaattctgcatcaccagcagcaggaacactttagcatgtctgtgttcattttggcccaactttgtgacaaatgagggcatcaatgtgactgagcagggcccagcccagctgtctggacccaagcacgtcctctctcactgacagtccattcatgagcaaggctcaaatctgccgaacaactgtgtatatttggtaccaaacagagacttcggctgctctggtcaccgagttaaaatgccaaattactcattctcctgcagaaagcacaaggaaaaaggaatcatttctccctgcacagtttttccatgtgacaaattttctaattttacttcaggttaagccgactctagctcatggctccactccagagtctcctgacccctttcgtgattcaagtttcctgattaaaaaacacaattgattttgccggtttaatatttgcaaatgtgagctgctatcaaattcgcaaccgaacttcttcatcttctctactctgtgatgtccagcaatggcttcttggtccagttgttggggtctaggcctggccaactcctgttcactctgtgtgcacagacacttgtatctgcagagggaggggaaagctggcttagatggagcccatgtggctggatggtaaggagtgattactgggtatgtttctaggggcggttggttctattgagactgttgggatgggagctcatacctgctgtcagctgtgggtctacttagaggcaactggagcacttttagcataggaaagagactggtagctatgtttgactgacatgaattctgcctgtgtggcatctactgcatgtcatcactgtcttccacccccttgccacccttggggtcatgtctctctgacagtcagacgttgcctttctctgacctctggtttacttctgtgcaagcaaagaggcttgtccaaagctcatgccctatcgtgtcccttcttcaaatccctctatgctttccattacagccacgatctctacactgcctgggctgcagccaaccctctcctttcccatctctcctggcttctggctccagccctgctgaactccttgctggtctctgagatcacaggcaggctctttctcatccttacaagccttatgtttttcatagacttgctccttgaactgtgttggtccctgagccagctgcatgggcattaccctgagatagttagggatgcagggtcctttccccagatcaacagcatcaggctttgtgctttagatgcctctaggcaatgcatttgatgccaaagtgtgatccacagggcactgtggcctggagtgtgcaaatctggaagagttgatttggtttcaggctccacaagttaacagttggtgaccttggatggcttcttaatctctccaaacctcagtttctccatctgcaacaggagggataagactaggatgtatctcaggctacttgtgatcactaaaagcagcactgaccgtcccagctcagcacagtgtatatggtaaacactcaataaagggcaataagccttatagagtgggtgagagagggacagagacaagctgggaagtgtggtgttatcgtgtgtcagaagtgagggtcccttcttataattctctgaggatggggaagttttgcagcataagcctggtggtttctgattcctaggcaggatcagagaaggtggtggggagcaagatgagtggctaccaatacccttttgatgtaaagccacttctcaggggagagattgtggcacctgtaagtctggcagctagggactcacagtgcccatcccagagccctgttttaagaagaaatactgctgaaggcattgtggcctgagcagccgctggatgctaacatgacatccttataggtcacgggaccgaggcctaagctcagtgtcaccagtaagccctcgtgtggcttcattccacgttggtttactctgttaggggacagaattcatctgcaagttcttttcaccaaggaccttgagtgggccaggtcaacaccactcacctttggaggttagggttgttgagccttctgggacagggaaagcaacaactgtaattacatgtgggagagatgagtctgctaagcaatgatgggtggacagaaatagttgtgaagttctatggtagaaaaggctcatctatctgtggaagcctagtaggtttttcaaattcatgcctctgttccttcactttcacttaaacacttactgtacgcaaggcaatgtatgatgtgctgggtataaaatgatggacaggcaggcctggttccactgggggatgctaagaccaatgatttatccaaaacaatcctttggtgatgataaatggcaaacagggttctgaaggataggagccaggcatggtagtacatgcttttagcttagcactcaggagaagggggaggcaggcgggttactagttccaagccagcctgggctacaaggcaatacctggtttcatgaaaaactaaagtatagggtcctaacacacacacacacacacacacacacacacacacacacacacacacacactggatactttcatctgtatgagggcatcagggaagtctcccaaaagtgtgacctgtaagatgtggtccaaaggatgaatgaatttactcagggaagggtgctgggttgatagagctgaacctggtgggtagagaaccatattcaattcccaacaccacaactgtctgtaactctagacccagggaatccagtgccacttctagtggccatcacagataccaggcacccatgtggtgcacaggcatacatgtaggccaaacacccatatacataaaataagatttaaaaaatatttaaaaggaacagcctgccttgcccagagtgcatgaagaaaaagggacagaaggggtctctgggaggaaggtggatgcaccatcagtacctagcctaggtacctggcctaggtaccatgacccccaggtcccatatgatgctcacagcccagggattggcataggatggaggccttgagtcctggaggagtgtagagtgagactctgggtttgaggacctttcttgtttctcttcctctgcttatagaagaacatactgattccagtgaaggatctaggcatacattttttgcaacctatttttaataaaggttcaatctctcccctagaccagtacccagcagaggtagtagaagagaaaagttattagcatatgggggaagtggacttgttcagcaatagttcgttgggggcaagcttggtcctctttggcagcagttcagtcctgtagcaaacatcagatataactcagcagctgcagaccagttctctaggcaggcagacaccaggtatgaactggctgctacagtccagtccttgcagcaagcagacaccaggcagctctagttcagtcctgaagaaactgccaggctggccaaccaacctaaggcaaggccacagaagtgacaagttgcctcatgagcagttcttaggcaagtttctctcaatgtcaaagttatcacaagttgagctcaacaatgctatgtaaagtgaattaatacattcctgttgctagcaaagaataacgaaacagagcaaaccaaaccaaggctcagtgctcatctcccactgtctgtggggtcagatttatactccttcatcaagcatcttttcacgtgcctgctatatccaaacatcctttcacctgtgtctacttcaggaaaacagtctttcatgtgtttgctttagcaagacatcccctcacctgtgtgccccagcaaaatatcatttggcataaccgactttccaaagaaactagaagtttccacttcacagtactagattccatcctgctctttccctctctgtggagggtgttgttgagaatgtacatccagtgtgagtgagccttgggttcttcttgctgagacagaggaggaagctaggtcctggagagtgtctgggcaggaagactaagggagcaattcctccggacctgtcatgcctgtcccccatccatccctttagtggctcctctgactgctgtgcagaggttcctggctgggtaaccaaggcctgcaaagagccgcactgtttattccctggagcatgcactttattcagcagttgggaagtcggggcaggagaccagtcacaactggggagaaatccagagcatcactaagacaaacaaacacccgtgtgctatgacatgagaactgaagggctttgaagcacgaggctctcctggagtttctaagctcctatggcttgtgggctaagttgggcctacaggtgtggggtcctctctctcatgatgagcaacttgggtagaggtgggattttatgtagaactgaggttcctaaattatgggagagacacaagttgttgtccaaggtgccagagtgttatttgggcaaaattttactccttcacagcccatgtggattaggacaatgtactggatgacggtatgtagaccattgtgatccagagtcttgcaagagaattctcggttccaaaaggacttgtgtctgtcactgttgcacctccagcatctagaatggtgcctgccacacagcaggtgctccataaataatgcttgctgcatgagggagtgtgtgtgtgtgtgtgtgtgtgtgtgtgtgtgtgtgtgtgttgacggcttccagaagcttgccttctcagcccatgtttacctttccaggaataagtgagtggggctgctctcacatgggaagcttgggtggaatgtgaaaaatcctcttcatgaatatgcatgcgggaatccagccagtgctgccccaagcttaagatttcgaagaatcaccctttggaggcagcctcctacgcagtgtggtttacacccacacattgggtccttgtgggcgaaggcacagtttatcattcatgtacctcacccggctagccctcccttctcatgggtcctgcccatttctagcatctgggtgttggtgattgtctatatgggctttgccaaactgcaggtgggaaaaggtagagaccagccattgtcagcaatacaaggtttcagaacctagtctagaagcgtttgctgctgtctgggtaagtgaagccccacccctttcttgaagtttccaagaacacttgagcacaggtaagttgtctgtctgtcccctatcatggcatggctagcagcgagttctgcaggcattagatgaacttcagatcccagctcggtcacttattagtgctgtgaccagggcaccttactcaagtgtgggcttcacatctggacagaggagcaggagatatcctgatgcccagactacatgagatagtcagtggggatgctgagtctgaggagagcatctgcccagcatgggcgctcctgagaccttggtcctcactcttctgggtagcagtaggcctggaagcttcctgaaataccaaggcctggggcatcaccccaactccccttggggctgaggccaggcacctgtgttctgaagctcacagtgcattggctcccagacatgtgaggagctcaaggtggacgcctgtgctatgggaacaggatcacgtctgacctgttctctctgaatgtccaggaccagcagtggtaggccctttctaatcatgacattcaccttacactgcaatcctgagagcgaggtattgcatcatctcagtgtctggatagagacttaagctcagagaagttgaagaataaacgcaaggtccccagctaggaggcgattggtcaggatcttgctggcagatcactccggcatccacttcccatctcttactctctgtagcacactgtgggacgctggttatcctctggtccctgcaatgtgcctgtctctttattccatttcctggagcctctagcaccttgcagattccctcacagcttcttagaggccacaagtccttcctccggcaaacatttggagactgtcaagttgtcctttcatctgggttaaacaagagtcagtctgtttcaaaatatgactctggggtcaccatctgtcctggctgttcccttaaactcaaatcccaatgcagagacaggctctactccagcagctttgtgagggcagggtctctgcaggactgggccagaggatttctacaaagactttgtagtgtctttggtaacaactctggagcacgtttcttttaaaaatgtgcattgtttattgtcccctcaccaacagggctcaaatcattaaagaggaccccaagcccctggacaggttcagtgcactcgtctctccagcatgcatcttcttgctgtctaccatgtaccttgcatggcattttgccttctctcctttctctggagccacaggtgggtgtggcctgggtcatttggaatcatgccatcagcccgggccttgttttgctcatcttagggacctggtgtcttccaagatccttcctaaatttcaaggtgtccctgcctttctttttcttttttgctttagagagtataagtgccatctcaccctgcctgctacagctgggagctcattctgctatagcagcttgtctgccctggctggatccacaccagcgcatctgtggggacgccccagagccgttcccagggcagcttgatttgcccagggcgtacatgccaagttctgagagaatgcaggcaagtctgccactgccaaactcccacatgcactctgcattccaagtcccccagtcccgccctctcctcagcaagggaatggatgtgggggctgagtgtcagggcaatcgctggaggagaaggagatattcctcctaaaatggtcaggggagcttttctcagaaggcctttgaggtgccctgctgcctgtcatgtaaagttaagtctcccagatctgattctcgagtgcctctgctccaaggagagaagatgaatgggcttcatttcctttgccctcagcctccttacctgaggtagggaagccagcaggtcaaatgtgctcatgtgtttagtctgaaattgacctgcgggtggcctgatagttctgaccccgtagctcctggcagttctttgccaatctcttttgcaccctccccgaatcactcaaatcttagctttcctcacatggccttccttctggatgcttttcaatgattccccctctttcaggccacttcttagaacttttaggaggtcctgcaggcccccttctgtccttgactcatagtctccagactcaggacttttaggtcagctctatgtgtattggcaactaggctgagaatcaggtggagaccaactctcttattttctcgttgccttcgatgcttgcctaggccaagtcctggcagggttgcatgagggctgcttgttgtgggcagacacgggcaggatcgggataaagtgaatggtgagagtgcagctcttggctcctcctcagggctcccatctttcttgtggctctgttccaaagggtctgaggcctctggatggccactcagaagatgtttgctgactacttagtagcaactatgctatacccagaggttcaagggacctaggacatgtttcacttacagatggttacactcaagaaagcttcaaaatctcaaaactttctcagactcaccccatctctccacgacacacccacccaatgcctgtctctttcatgagctcgggctttatccatgcaagaggaccagggatctcagagttctgctcctggcgcctgtagggctggacagtctcatctgatcttgcccagttgtccagtaccacgatgggccatgagcaccctccccaacagaggcacagagaaggggaagcatctgttattcacaagtcccacccagaacattgttccaaggagagggaaggtggaggcggctggaatttcatctgaagtctgagaagccagtgtgtctcaggggcactcccagcccagctggatgagagccctgggcagccatcttgcagaaggctacatttcccaagccttcctgcttaagggtcaagtgagagtgtgggactgcagacctttactgtattatgtctggacagcaggggtcagatgagggtggggttaaaaagtacatgttaactaaatgttggtattggtgaacaaagattggcttttataagagttctttttttaaattttgttgattgatttattgattgaggtttttaatggatattttgtttttagaatgtaatacatgtactcacgaaatgtgatcatatctactcccaatattctccctttctcatcctcatgcccactaatatacctcctctcatttttataactttttaaaataacacaccaggttcaattagtacttctcctacaggcatgggtgcaaaaccatccactatatttttggaaacctaccagtgatgtctctaaaatctcaccaaacaccttctgctaatggctccttaatttgagtttgggcctagagatcacattcctcatacaccagaattttggctggtttgatctatatgggtcttgtataggcaactaccaataatggaggttgatttccttatccatggccacaaagcaatatttcacaactcttgtctacatcctccaactcccatattcttctgcctcttccaaaatgatcccagtgcctatactagttctttctgatcaatgattaataaatatacagtgctaaggtgggcatacagttattcttgtccagaattcactaagttggttcacttatgcattatttgtttattcatttgttcattcattcattcattcattcattcatgtattcatccaccaactgtttgacctttgccaagtctcaggcaagactgtgtccagaagctgtagggggagtctggaggctttagagaaaagacaggagatttcagctatcccctgcagcacctgcaggtcagtgagggacaaggacaagtgaacagatggtgacagagtagtgaaaaactggggcttctgggagaccaggcagggggagagagctgctcctgagatatagcgtgatacatctgtggatgagcagaaggggttccaatagggagctgcaggcctacttcctgttgaagctggagtggcttcccctggatgtctgtccatctctaactatatgtgggacaagacagattgggatgaagctgtggaaccaggtgcttctagactgcacagtccttccatagagcaacacagactcctcgtggctggccacataacccttgcccaacagcgcctggatctgccaagctccttctctacccacctacttccagggacatccctacataagcttcgcgccagtcaccctccttctcatcagtggagagcatgtggcagcctccccctggccctgggacaaactgcttcctatctgtaaaatctggtgattcacacagtcgacctggctgggaagccactcagctgctatgttcctaagttacagggaaggttcagctttcccagaaagttctggggcacttcctctatagctctctcttaggagaagccgctggattcttacccctgtactctgactctgggtttccggccatgcataagactcctgcactgcctcctgtccaagactagatgtaggccaccatgctagcctcagccacagagcaagcttcaaatttgagtgtgagccatagacccttccaggattggtaaatgcatggcattcagggctccacccccaaatcggtggtgttttgtgtagatcctgagattcagtaagttcccagatgctaccagtccaggtgacacacttggagagcctcgagcgtcctaggaaagcagatgggctatggagtctgaatccaggccataaaggtccagactcttccttgggtggctggatccttccgtgcctccatctctgtgtctgaagagcagggttcactgtaatagctcttcgctaggttcttgtgagcgttgcctgtggaatggtgctggtgcgcatcaggacatctatgaggtacccagagagctgttagaacaaacaccacaaaagtaagcgaaaacatcaatcatttatcatcgtgcagttgtggaggccaggaatctgaaatggagaagtccagagcccttctcctctgagctattttccccctggagtccccaagctgagccctccagaggagcctgtggggtggaatggtgactcattacagctgatgtcatcttcaggagtcaaggccctgctcacactcaaagagcctttgttccccaagtggaaagcaaagtcctcgcactcagagaattgactgcaaacttttccctcgtgcccttggcatctctggtccacttgccacttgtcccacagcctctgggggtgacatcacacgcaggttccgaatcaggtgtgggaaggcaggtgaaaagagggatcaaagactcacactgcagagccctcggctcactcgatggggcacagatatcttgtggggaggctgctctctctctctctctctctctctctctctctctctctctctctctctgtgtgtgtgtgtgtgtgtgtgtgtgtgtgtgtgtgtacaaatgtacatgctaagtgaactgagtcccagaagaggaatttggccgtgttctgcaagcttgctttctgcagattatttctttctggctctattcatccaatcacattctttccttcctgtctcagagatgtaagatgcttgtgaggctaatctgggacatggtatgttgagttgggggggggcagaggtcaacaagaaatcaacttatctaggcctctgactataacccaagtgatccatgtatgccaggccccgtgtttatcctgatgttcactgagtgacggatctcatattctcagccagggtccatcatgtccacacaatacacactggaaggcctcagctcagagaggccaagtggctagcccttagccacccgagtggttagtggcagacacaggacccagtgtatatctagctgatgttgaaactggctcttgcctgtggctgttaccttcgacagggcatcacacccacccaggccaaagcctagagaattctacttccttgagaccaatcgggaggggaacaaccatcagcccttgtcaccctgccatttatatcctggttgccagatgtgaagcgagactgacagttctttccactaggtagagaatcaagcatgaggaggagctggactggcaaactgttgagttctgggcacagcacaagcccatagcaaaaggccatggatagtattgactcctgtcactcagttcattcccagatcacttttgttaaggctttgctggggactgagaggtaagctagagtggtccacctggaagcccacgaaaagatgcagcaagtgcataggaagagggtggctccacggaaggacagtgaggtgctggagcatagaaggtgcttccatgggaaacgccatgagaacagtggaggcagcgggatgcggcgggcgggcagagccctcttcctgtctcatgtctgatcctggactgagtgagctgttcccttgctctctaggaatctctcgtgagaagtgagagagtctgagagggacaggtggggggatgactgggaggctgaagaggttaccactgggcaggtctacttgccagtttaagaccagagaaataaactgtagccctaaaccccagatcctagacccttactaaccaacctctctagaatagaaagggggagggaagatggagggtctagagcagaggagagagggaaggagagaaaaggagagagacagagagagagagagagagagagagagagagagagagagagaaagacttgcttgagggagtgctcacacagtaacttcattgagaaggaaaattcttttgctatatatgaaaaccggaaaaaggaagaggcgttctcagtttacttggagaaaaatgctcttctgtaattcagaaaaatggggtctttgatcaccgcccggccaggtctcctttctaagtgggcccaggacttttccctggcaggaaaacattcttctaagaagtgctttgggaggtaggtttgtctaagaacctcttgcaccgtgctgtgttcatgtccctcacgtagggagtcaggtagtcccagggtctcttgaggctggagggtccttgcagtttccttccagggtggggctggctttctttacaggcagagtgtgatgacattatcgagggcgccgctgcttcccagttctagcgaggccaggaagtctgtgggagaactgttctcctggcccctgcaggagtcatttcttccaggcctgaaggaatcgctgcctagggtggttagaaaaactgggaggcagacgaggaggatgagggattggaggcactccgacctggcaggggccttgggaaaacatttaggccagactctagttcgcagatattgagccagagacttggaagaagcaaagagacttctgaagccatgtgtggagttggtgattggaggctgtcttaaaggctagtgccatttctagtacccttgtgacatctgagagaccaccgtatggaagttgacatttttgtctacccaggggccagagctctgccagctggcagggtggggcagccacagggaggataggcttagctcagcctgagcaaaacccttgaagacttattattttcttagggctgttgactaggagtgagctctccagcagtggaggtgagcaagaagaaagcaggtggcctttgatgggtgtggactgggggatattgtccacagaaagagagatttctttttcagaagtctgcagctggttaaactcctcatgccttttctttccagacagtgagagccagagaaacgacgggtgtggggtgtgccttagtccttggggccagttttctgcataaatgttcaaggaaaaaaaaatcttagatggacctgttaccagaggcctgtatgtggtttcagctatggggaggctgaggccagcttgggcaatttagtgaaaccatgtcttgagataaaaagtaaaaaaggctaagggtaggcccagcaatgcagattttccctagcatctgtgaagaatggagaatcaaaattcagaactgacaacaaactatattaataatcctaagaaggatgggcattgctgttcccagtaagataactgggaagtgacaagggtgatataggggtcctccttcagccttagagcgatagttgaggtaaacacagggaattctggactggaggagccatgatagggttctaaagacagtcactcccaccttaccctgaacggccccttgattgcttgctggctgtagcccaggctacaaccaccatggagcgtccttgaccagagggactacacacaccatagatgaagagcagctaagtgttctgtcagctttctaggcatgaatgggaagctctgccaaacagagaagaatatctttgcctccccaggcaatccacgttggaaaacaggatgagagctcttcctctgggttctaggctcagcgtggtcacagagtactgcataatgtcatgcctctgcttccggggcctctgcttccggggcctctgcttccggggccgctttcagatctctgtggttgggatctgggttcctcatggttcctccaagccaagagcactcagtattcctcggaccccggtctgtaagttctgagaagacgcgggtccccgcgtggccgctaggggccgctgccgagcccagtggtggagcgttcctggctgtgcagcaaggctcttgggacttctccatatcccagccttgacctggtgccagaggaaagcaactaagtctcttgaggcttcaaatgctgacaagcaagagccctgggctcaggtcccagatggtcatctgtgggatagagctttgcaaagccagatacggttccctagggacatcaggctccaaaggccagacaggagaccccacagatggaaaggctgatccaacccagtgcacagaaagggaaactgaggctggagtgcaaaaggagatataggtgtccaggggtctgtggcacagaggagggatcttgtttcttgcctcctccaaatgctgaacctaccagtccagtttgtttcttcactgttaggattctttcctggtttccatggaaactggcatccggacccttgggaagagagtggcaccctgtggggactgctcagattttcctctgcagtgttctctaaagccttctgatgatttctccctatgccctagggaggggccaccctgaaatcactgaggattctgcaccgaactttccaagggcaagaggcccaggctgtttctgtctgtcttcctttcctcaggccacgttgcagactaccagctctgccaaaccctgtgattgtacagggagggatgcctgtaggatgaaagtggaattccttgtgttggggtacaattgaccgagcctggaaatactggtgagaagatgcaaaagatagtattagggttctggagagatagatagctctgtgcttaagagcacccactctctggcagagcacctgggctcacctccctgcagccacacagtgccttgtagccatttcttgttccagttccaggggatcagacattctcttctgacctccgcagagattgcatgttcatggtgcagggacataaatgcaggcaaaacactcatgcatataaaaaactttaaaaaataatagtgacttagaaaacagcatgagaacagaagaaagaagagaagaaggagggaaggaaagaggggagggtaagaagatgataatttctgtgtccctcacactccactgaagatagatccagaaactcataaatgctaggctctacccctgaccccagatgtgcccagaatggaattttgactctgtgttgaaggaaccagggagctattgaaagcgttggttgaaaagcgttggttgaaagcgttggagctcgcaaatagcatgaacagataaccgctaaccgttcctagataatgagcttctggtctgggttcagctccctccacatcttcagcactatacgaggcacagcatggggacagattttatttgagcaatgcccaaccccccacatcccccatgaaactcctatgcattaaagaaataaaggagcaagactgaagttaaagtcaagcccatgaggtgtttgagggtcagcagctatacacagacagctcatcttgtttaatccggtgcaaattggggttctgagacagggaggggttagctcatgagcagcacagctgagaacttgagtgaacttgagccccacctcttctgcctgggggttcactgcttgccctgaggctgtgtggcttctgaagaggctccctgggatggaaggagcttgcacatctagttgatggatgagcacgcaggtggttgtagggtgaggctggaggctggaggctggccctacctatgctcattagaacttcagactcagagcctggatgttggtttagccagcaatcccatcttagccaaatcagagagccccaggccagggggaaacccagtctcagtggctcctgaggagtgaaaggttggcccctagcttctgcatatgcattcattcaaatgtacacacacacacacacacacacacacacacacacacacacacacacacacacgcacggacaaggatgggatccattcatgccagtttgacctccaatttaaggactacatggaaaaataacaaggtaattataataatgagagaagtgtatgctgaatgttctagacacacagttttgttcaaattgccctatgataaatgttaaaatctgtggagaagtgtgagccatttcaatgaccccaggccagagagtcccattagcagcccccaccagcagagttcccagccttccaggctttgtcgctccgagatggagagatttcttcccaccagctgtgacctccttctctcccttgcccccagcacaaagccatcccaggacaagtcatggaccaaattgccgagcctgtttctcttggctcccaggctcctccttcccgcccctcgtggctgcctgagcaggtggcctttccgctggaagccagggataaatgagccagcaggcacaggcccagccctgagtgtgggtcactccaggccaggggtcgttccccgccataccgcgcccgccgtgggaccatgcctgtggaggaaggcggggctgctgagagcaaggctgaggactaaggcttgtaacagactctgtggctctctttctgagtcgatggaaacggagcctgtggcccagcttctgcacacttgtcctctcttgctagtctgggatcttcggatgaaggtgggagcagagagggtgtgtggagagagtctgcagactacagcttttgctaagtttatgccttgcaagctgcacagcttgctgataacttggacaccatgtcgccatcccataggatctccgtaagggaagtgggcaggaaggccccatgtcaacctggtcatctactcaaaggctgcatgtttggtagagggtagaggctagaggggaacccagctctgaccaaagttaaaggagtcctccactgcagcctgcttcctcttcatctcccctttgccagccggcatactatgggccagtgtctagaaaggctgggtagccagggatcttgggggatttatgatttggggtctgggtaaccccagattctgctgctatgcctcatgaccatgtctcttcctcctctccatcagttccctggcccataaagcaaggaggttgattgataggattatggaaaaacactttaaacagatccctggaaataggaattcatgagatggccatgtgcaagcctaggtgagcccttatctgatccctgaactctatgcagaaatagagccctggatgtgagccagcccacttaccctaatggacccacaacttctgcagacgctgaagggtcccaccagagagcttcccctcctaccagtaaaagagaggggaggggatgaggggacaagacaaagaaggggtcacatacttggggcttggtgttttatctagagctgtgacagggagcggggaaacctgagtaggtctttcttccttcttcatttctttcttacaaagatggcttcaccccaatgaaaaagcatgttgttaaatttccttcctttctctctctttaagatagggtctctctacgtaatcctgactatcctggaacccattatgtagaccagactggcctcaagactcatagaaatccacctgcctctgtctcctgaatgctgagattaaagatacatgccctatgtctggcacaagcccttaaatttctaaaaacagattcaaggatttaagaatatataaatatctttatttttcacaccaggtgactggtataatgtaaaggtacccagtgaagaggcgagtcatctatcctccattctctacttcctatctggacatgatttctagccccagtttcttggaaatccttctggagagatcctaatatattctactatataaattgattatgcatgtgggaacttgacagatatacttgaattaagagctttgaagcctctagacagcaccatctcttgggctaccttacacatgtagctcattgaggctaagagccgtatgtagagcatgactatggccttcagcgtcctttgcatgcttatgtatttgctacatgctgcttcctgctgataattattcttttctttttactgactgtatcctggctactgctcagatcattacctaaggactcacagcattcgggaggctacatccaattcccttgagtgaatatattttatcattcacactgggtcaaagaatacatatgcattggtacttttggaaggtgtcagattgcatcccatggatgtgacacaatttaggatttcactagcagagcaggagatgggcccatgctgcctcagcctcttgccagcattttcgattagccaacattctgatcgctgccaatctgataaggaaaatggattggccttgcagctctgctcttctttcattgtgaggtcaaacattttccatatacttacatctgagccgccttcgttttttcctgctgtctatagaacttcctagtcttcacccatcgatctgctgacttatggcattgcccatctgctttgcctgttaaaggagtggcattgtgacgtctggtttctgctttttctgttggctcttggtttttaagctgacattgtgaggtttaatattattatgatttttaaaaaatgttttggtcctcagatctttatttctttgtaggcaaatttaaccagatttatgtctttaaattatgaaatcactattgtgagcctttgctttgtctagttacatttaaccagatttattgttcttttaacctatgccttgtggggcttgagcctcaaactaaaattacttcaaatggatgtcttgtcgtgctgttttaaagcaggctataaactggagaggatagtattcagttgagaattaagtctgggttcatgactgttggacactttccctctattaaccttggctttgtgctctgtaaaatgtggaggtcggaagtttccatcctcccttccatccatccatccagccagccagccttctgttgactccttactttgtccatttttacactcatcctcactggcctaggtcctgggaaccatgaacggtaaaatccttgtcctcattattcactgggagtagaaacaaacagtcaatggtgacatgaggaaggggctgtgatagaagaccccagtgtggatgcaggaggcttgcagtgcagctccaccaagaagagcttatgggcagtgaaggggaaatggttgcaggggaggagtcctggactgagtctcgaggaggaagaggaacagggggagaaggaggagttattctgaaaggtgattgggtggatggggtgagtgtcatagggaaagcattggggtagatgtaggtctgtaacaacagaggggcactcaggggccgttgtagattatcttaggagggcaggggagaatggctgggcacagacagaaaaggcctctcaagtccctgggtggctgcctgaccctggagaccacagatggccatagaagatttctaagcaaggactctatgtgacccaattttctctttaggtaaagagggtggtcgtcttcataaaagttgtgaagtgtctccagtgaagtgtgtcctaacgaatccttgtggtcaccgtgaccacattattaatcctgtcactggggagcagaggcaggcagatctctgaaaactttggggatagcctggtctagagtgaatcactgggccagccagggatacctagtgagaccctctttacaataacaataataatagcaacaacaatacagtgaatacttccttggaaccaatgttaaaaattaaacatagtgaagctggagagacggctcagaggttgagaaggccatatagtgctcttccagaagaccggaattagattctcagttcccacctcaggcagctcacatgacctgtaactccagctccagggtgctgtgacacctctggccttatgcatccacatccacacacataattagaataataatcaaaataaacatttcaaaaacttgaacataccgctgtaattaaaatggacctcttgcaagtgagtctctgcctcctctcagcctgggcatccgaggccacccgtgggtgtggtcagtggaacagaatctccaaagggcacttgagcagcagccaatgaaactgtaagtaaacagacccttgtcacccacaaatccctgtcatctgtacagtgggatggcctgtacccataagcagaggaggcgaggatgaaggaatctgtagcaaattggtctggaaagtcacataagcctccctttccatcaccagaaaagcgaccttgtccattgcagctcatgcacctgtggtaggaggggggcccagcttcaacaaggattaatcagaaaatgatgatgttggggggagagaggaaaaagaagcagggacggacgaaggcagcctgccagtgtttgtgtgagggttggagtcatctgtggtggccctgcactctgttaaagacaaggcttgcatagtaaatgcaaacagaggcacgggagggaatggtgacatggagtccccagggcctgggctgaggaagtggactggagagggtcagcaaagctgtcggtggctcttaagaggagtgcagggcacgtgctgtttctgcctgctatcctttagtttctaatttttcacactgggactagaatggagagcagatcttgagggccttgtgcctgttggacaagtgtggatccagggagttttaatcccttctcctttcttctctctctcttgcctctcctttggttttttgagacagggtgtctctgtgtagccctggctatcctggaactttctctgtagaccaggctagcctcaaactcagagatacatctgcctctgccttctgagttctggcactaaaggtgtgggtcaccaggcatagccacccaatcctttcttctgtttagttttgaaacctggccttattacccaggatgggtttgaactcacaacatatccacagcagacatcaaacttgccatcttccacctcagtctcctgtgtaactggaattataggcctgcatcaccagactcagctaaaaaaatttgaaatgaaataacatttaaccctcaaacttccaaattatcatttgaaatcataaccaatatgagaatcgttaattagctatgttacactgttttttccccccaaattgagtctttgatatccagtttgcctttagcacagcatgtttcaaagggaagacctgcgatccaagtgttcaatggctacttttagctagtggttcccatgccagaaaaggaggagttagcaacacagcttaggtggagcttgtatcctttccaaacctgaaagtccatgacagtgatgggaagggcagaggtgaagggtcaccaccacttactgctctccagccctgtgccagcatctcacactgtgtcgtttcatcacctcagctatcctgcgtgatgacatgtgtttttctttttaaaagttcacttgtgtatatgaacacatggacatatgcggtaagtgtctgtgtatgtgtgtgtgtgtgtgtgtgtgagagagagagagagagagagagagagagagacagacagagacagagacagagacagagacagagacagagacagagacagagacagaggggggaaaggggggaaaggggagagagagagagagagagacagagacagagagagagacagagagagagacagagagacagagacagagacagagaaagagacagagacagaggggggaaaggggggaaaggggagagagagagagacagagacagagagagagacagagagagacagagagacagagacagagacagagaaagagacagagacagaggggggaaaggggggaaaggggagagagagagagagagagagagactcagaggccagaagtcaaggttgagtggcttccttcttctctcactgaatctggagctcacagattcagtctgtctggaccggctggccagctggtggcaagctctaagcactctcttgcctctgcttgccttgcactgggagcaccattacagccatgtttttatgtggaggctgagatccaagttcaggtcctcagattttcatggtaaacactactgactgagccaactcctcagctcgtgtgtcccccactgtgattaaatatacatagcatttgtcattctgacctttggatgagtctccatattactctttatattcttctatataaccaaaatatgttatggcttaaccacacacacgcacacacacacagagacatacgcacacacatacgtagacatatacacacagatacaaatacacacagacacacacagaggcgcacatactgtcaggcacacatgtctagctgctgactatgtgactgtggcccttacctcggggtcctgttggtgttcgggatctgccttcagcttagtttcatccaggactcttgtggcaaccccccttctcatcaaactccgatatcaagtcaactggaagtcaggctagctgtggttcacagatctccccgtcactgactgtgtatcctcaggccaggatttcacgccctaagcctcagttcttcatccataaaatgggttaggagcagttgatttccagggctgatgcaaggacgaaggaatacaaaagatgaaaaaacagcagtgaccgctctgcacaaggagttcaaggatccagtccagggaagtcttgactattgtgtagatgtaacagaaaggattgttgtgtctactgtttttgactggaggctacatggatggtactctactttactctcctgttgtgacaaaaagcaacttgagggggacagggtttatttcaccttactcttccaaaacactatttagcactgacggaagttggaacagaaactcaaggcaggagcttgaagcagaaaccacagaggaacactgctaaatgctccctaacctccgctcagctagctttcttacatagtctaggaccccctgccttgagttgacaaaccccacagtgaattgctgccctctacacaaattggccatcaagaaactgttcccccagagtgcagttatagagaatgcttcaattgagactccctcagataattctgggctgtgtcaagttgacagttgacgctaactagggaagacagtcttgatcattcatgtgggttttcctttggcttcctcatgagatagagagagaatcctagccatggactaggggcctctgactgttagctatagtccagctggccactaggatatccgcccttctatctgtctgccactgctccattctgaggctcattgttctaggatctgactctggccctgaagccatgccctctggctcagtggcactgggtgtgtccactctacctgagtcctgcattcctctctcgctcagttctgtcacttccgaggcagctcagggaagtgtgtcggtcactggagcagcttgtagcttttgttcatggacagcagtggtctgtcaaccccgccaagcttgctcgtgaagagcacagactcgagtcaggggagatctcgttttgaattttgcatgttgaatcttgcttgcaaatttgctagcttctagcagccgtggttttctcaggagtaaacggaaataacagtacctaaccttgtggagctccagtgaggatgaagtaggtttaattacgtgagcagtgcctggtacagagagagagctgggatgcagatgctgctgctgctgctgctgctgctgtgcctgatgatgatggtgatgacgatgatgatgatgatgagtgtttaccactatgaagcaaagctcaattgtgctggactccagggaacacccccccccactttgtgcctgctttacccctatgctctgaggcacttaaacagaagacctcattgtttgtattgtttgtaaaacaaagcaatccagcccgattccacttggttaagtaatctccattaacttggagatttctggaaacatactctagaaacgatttgtgtttttccaaactgtagatcacctcgcattagtgggcagtacgatcaattaatgagccttcccagcatggttttaatttttagaagagaaaaacaacaattaaaggggaggagaaagcagtggaaggcccggtgagctttcacagtcaccacgcagtgctttctaaaatggtgtttctgagttacagccatgtgtttttgtgcccagtgtacaccacacaacagcactggggcttgcttcaaaagtttgagaaactgccattcagaaagtctcctttgagtggattcccatggcgcccacctccttgttccagcatagtggactcacagcctctctccctctctccctccctgcagggtcagcctctcaggttcacctggacctcacagtgctcattggtgtcccattaccctcgtctgtgtcctttaccaccggctatggcggtttcccggcttacagctttgggcctggtgccaacgttggccgcccagccaggaccctcatcccaccgaccttcttcagggatttcgccattggtgtggcggtgaagcccaatagcgcccaagggggcgtgctcttcgctattaccgatgctttccagaaagtcatctacctgggcctgcggctttcaagtgtggaggatgggcgccagcgggttatcctctactacacggaaccaggctcccacgtgtcccgtgaagctgcggttttctccgtgcccgtgatgaccaacaggtggaatcgttttgctgtgaccgtccagggcgaagaagttgctcttttcatggactgtgaggaacagagccaagtccgtttccagcgatcgtcctggcctttgacctttgagcccagtgccgggatctttgtgggcaatgctggagctatggggctggagagatttacggtgagtttcagtccactccccacagaccagggaagtttggacacgaactcccacacactaaggaggagcaatgatcattattattttactctcatgctctcaaaaggcacgcacaccatgtgggaaggactctaggcctggaagccagtgatcccagtactctgcaataaactagggctgcagtgttaggcagtagtgtatgcccgggtctgttgtgctggctgaatgtggacacaaaagcccctatccggaggctgcgctttttggcccatcctgtaatctcagcactcaggagagtgaagcaggaggatcacaaattcgaggctggcctgggctacctagtaaattataggcctgtctgggaaaatagtccgaactgctttattcactgaaagccatgactgaaagagtcaagcctgctagtctcaagtgacttaatttccacatgtggatggtagttgtgtttgtttctgtaatgctggacaaatctgaacaatcgcattgaggaatcacttctctgtcctcttttaaacagtatgtcctaaaactaacaaaccgaagactgacttgacttaccaaggtgcattctggagaaaatatccattatcagaggccctcgggtgactcagatatactagggaaggcaagaggcctggctcagacctgcaatttcagcactcacgtttctgagagtcatgagttctaagccagcctgagctacagggtgagtgccaggttagcctacagactgagagatcccacctcaaaatcttagcaatccagaatcaggcagatctccgtgagttcaaggccaatgtggtccacttagtgagtttcaggacagccagagctacaaaatgagaacatgtctccaaaaataaaattttttaaaaattaaaaaatagaattaaagaaagaaagaaagaaagaaagaaagaaaggaaaagaaagaaagaaagaaagaaagaaagaaagaaagaaagaaaggaagaaaggaaggaaggaagaaaaagaaactcaaccccgacaaccaaccaaccaaaaggaaatgaagaagtcaccactagagggcagaaattgaatctatttgtagctcagtggggacgctgaggctgtgtgtacatgctacacgtgtgtgcgctacacatgtgcgcatgctgccgtcggtgtcttttgaagagtgagctccagatctggggagtggggttgggaggccactggccgctcaccacatcacaacaaagtctagcaaggaagttttgatctttgggggcagagggagacatgtttcagggcctgctgctgaccctcagaggccctggagatgctaggaagctgttgtggctgtccatattctgagcatatgctaagggggtccatattctttgagagcaaacaaggagagtcccttgcctggagagctggaggggagggttgcagcagtcctggcacctccgtagacagcacagtcccaggctggttctttgcaatgtcctcgctcgccgggacactcctgtcctccgtgggcattaccatgtacacctgtaacccatgactctggtttctctcttcctcagggttccatacaacagcttaccatctattcagaccccaggacccctgaggagctgtgtgaagcacaagagtcctcggtgagtctctgcgttctccccccgccccacccccatctcacccagggctctgtgcctccatcccccagtcagccaggggaaggctggatgcccatgcaattcttctccctcagcgtcatgccgccgccgtctaaagcctctcatcatggccagcactgccccaagtcctattttgggcttttggctttctttcactttttaaagctcttcagccatctccttggagtgggggctgtgtgtcttataaggtgttcctcgggctgtggcagtcaatggcctggtttccagccttcctgccaagaagggtgtcaggattctaaaatcagagctaaaatgctaagatattctgggtgtaaagtcctataaaaatgaacctaaatttaggttcattttatgcttggcaagtgaatcgattcctaagctgggggtggggtgggggccagggaggaaagatgtctccttccttccttccttccctccaggatttactggtagtgacagccccttgtaggctggggataaagggctatacttcaggggccgtcccctcctccaacctatgacttagagacacaactcagtggagagagtcttagacctagctcagcaggtcagggaacagaggggcaggaggaggagctggaagccagggagggagaggccctgtctgagggttcttccaggcagacaggagcatcatgccaaagccagatgcaggccgggtggcgaatcctgtgactgttgctctttaagtgatgtcagcttctgaacacattagaagttggtttcactaatttagtgtttaaaaaaaaattctgcacaccagaggtagcatttatgcctgtttgaatttctagactcctgagccagtgccattcaagagagctgggagataggatgaggaagttgtcaaatatttgtctctgctctgcattcaagttgaagtataaataacccagaggtcccagaacagaggaacctctgcagacaaagcactggctcctgggcagacacaggggctggctgtgaaggttaggtgacagcaggaagacaccttggatgagtgctccctgaatgggttccagggagcatcttgcacaaaccaggagcaaagggagcctgcacatggtcagaaggtgaagtaacgaattgtagcaatagcagtgtggatggaaatagaaaaaccaacaacgcactctgcctttcccaccgtgtctctgatctcatgtttgcatacatgtatacacacagaaaggcacaaacaccacacatacatgtattcacatgtacattcgtgtatgcatgcataccacacaaacatgtatatatgtgtacacatgtcttcatacacatatatgtatgtggatgtatatgtgcacacacacatgcatgcataccacacacagatgcacctccacagatgcagtcaaacagatgcacatatatgcatgtaagtgcacatatacacatacatgcaaatgtacacacatgcacatacagctcctctgcaggagtctgcttgtcagtctctgaccttctcaagtaccataatccagtgtaacctgctctcatgcctcatgtgtgttgtgacttatctcctcacaggcgtctggagaagccagtgggtttcaggagatggatgaagtcgctgaaatcatggaagctgtcacctacacacaagccccggtgagcatgcatgctgcccccatgagtgagttgtgtgtctcaggctgttgtcagatcggtgaggttaagtacctctgggggagtcaggagggccctttgctacctcacacccacacccaagcaagctgccaatgtcccagggtcacctgcatgcatgactatgaaagacatgccaaggcaaatgagctttgtggccttggagaattgactcaaacccactgaacttcaattctcttctaccgagtgatgatagcgtatagggtcattggagaggtagacaaggcagtcaggagagagcctcagaaagtccccggcatgagggaaataaccctgaatgatactgagtgttgtgttgaacccatggcaaagcagcccccacctcatcccagcatccacatttctccctcctgggactgagttctgcagagaagagaaaggggtttccaaagccttgagtcagaccatggagttgcaaggatctcccatcttttgataatagcaaggagcgtctgagctgcaagcaaagacagctcccaggctgggcgcagcactcagtgaaagcttctgatagagagcagggaaacagaagtaaggcagggactgtacagtatagacctcaggcagcagggatgtgggtgtggcaggtaagaaccatagtctgctaacgctagaaagacttagacagatgtctataccagaaagggaacctgggcaaactgagagcacaggtctcctgatatctacccaaccaagggtggtctgggtgggattgtggcactgcacccccaagaccttggccaatcttggctgagatggggaagctgaggatccaggagtctgtgcactgcttgggggcagtattggagtcctgtgtgtccattaggcttagccacccatgggcacatcctggcacaggtcagtgggccacatgctcagggctcaaagcatgacgttgctttgtatagacaagttcataacctagagagaggctaactcagaatactaacaacctggcggttcctagagtgaccagaaagtgcagtagggtctgagaggtgagagggtcacaggggtgagaatggggcacggatttgggaggggaacgtggagacagccatcttaggacaagcatagagggcgaccaggagaggaagagagctcacggttctgtggatacgatgtcttccttgcaccctgcatggaaggtgatccaccatgacaccagtgcttcagatatagggactgatgtggggagcaggggacagcagcaacctggaaagggtgtgacattgatctctgaagacctggagaagtgatggaaagagaaatggctagtggcgtggtgcacttgggtctctgaggcagcccgttcttttctttctccagttcttagaaacttgggagaagggctgtactcagagacctacccacagtaggtcctagccctgttgttcctggctactggccttcagcaggagacctaatgtctctaagatagcttcccccattagtccagagcatgcctgctccgtggattggtctgagaggtggacaaaccacatggtccaaacactcaagtagacctcgatacacagcagtggtgggtaaaggcttgtggtggtcactgcaaactagctggtgaagatttcaagaagccaaggagctcagggccagactcaatgcagttggttccctgttcttttggaatcccctccacactggcttgctggtgtcttgttgtgcaaaccctctatggctgtcctctgcttaagagaactcccctagacccaccctgttggtcccaaagctgctggttcccaacacccacatggcagacaccatcctcaggattcttctgtccctctacattcgttcctccacctacacatgctcaccctccagagggcgctgctgagttcagattcatgtcagagagggcttctgtggtctgttctataggagagggcgtggaacagcagtgttgttgaggccacatggcctgaaggtgacagagccacatcttgggccacaccctcactctaccttaaagggcatcgtggctcttttttggcacagggaatttccctcttggtctcagacagcccttcctttctctgtctggcttctttcttggtcagaatctcacttctccatttcagcctttgtagcttgctaccctccgggacatggactctaactgacaaacagagccagagacagcctgtccagccctccctgctcgtcctgtttagggtcggcacctctgctgccccatgcctttctctcctgccgagccagctcctgttcatgtgcctttgcatatctgaaaaaaaaaaaagtaccttctgctgagttagaattaacttctgtttctcagctctggctgtacacatgaatcacctgtacccaaatgtgtgtggaaccgacagagatctttactaaagaagccccagggctgcttccctggggtgttcagcgtgtctgagcaaagcaagaatctacactggcagagagctctgagggtgattcccagacacagccaggacctcttccagccacacctaagggctctcggcttcccagacataccatctgggacttccaattccgacagctctgtgcagttctgcttgcctggaacccccactccacccgcccttccttccttccttctggcaaattcttatccacctcaggatccaggccaaatcctctcccatgaggccacttgcttccatgcccctgtttccagcttggctcttgcttctgctgtcctgtgtgctctgtgataacagcctgtgaggctgttctgtgccccagggctcagcccacagccgggcacatagtggatccacaggaacctacctgtgagtgagcacatccgattgtgactgtgagggtgggcaaaagcaaagcaaagccacacaaacacacctccacaataacttgaaaaggcacggaagtcttcagactagatctgcctacactgtcacagcccacacttggttcctcgcccgtattccttctgcagccaagagccgtgtgtttgagatgaggcacctcactttctccacagagtgggatgcctggaatctcacctttccccaaagcagggcccaggcggccatggctgcctgcctaagattcagttagactttggctgaaaggctagtcaatgactcttcctgagatctccttgagtaacaatagctcaccctgtttcaggcttgtctccctgctttcctcagccttgtctgctcctgaggcccatgtgtcttacaacgtatccttgcttccagccattggcatccgtggaggccagtcccggctgggttttactgcttttcctagggtgctcactctttcagcacccctgcctagctcctgctgtttgggttttttcagtgcctgactaaaggctcctgggctggtcttcagtatccctagtctacaccctttgagccgctccctccctcaccactgacctggttccttttatcggatttatttttattttatgtgtatgagtcttttgcctaccttcatgtttgtgcatcatatgtgtgcagtgcccacagaggccagaagagggcaccagctcccctggagtaagaaccagttgcacaataccaaacaggtgctgggaattgaacctgggtcctctggaagagcagccagtactcttaacctctgagccatctcttcatcttctgtggaatattttttattgtccccattgtacagaggagaaagcttaggcctggcgaggcagtatgatttgtccaaaaataggtcagtcaactaaatagaaagcagacatcccacccatgtctcacagtaaggactgaactatgaactctgaagtcacagggctcctcctaacagtcctccctgttatgatgggctgaacattcactatttacccagtggagtctgacatcaagagttgtgcctgatcttgttaggatgttcaaggagtgctgccgcagcaaatgagcctgaaaacttagtgtcttaacacagcagagatgggtttctttcccacacgctaagtacaacattaaacccttccactcaaccctccatccttcccggtgacctgctggagcttagaaaaatgaagagactgaaggctgacaaccctggctttcacaaactgctcccagcatctagggttgatgtccagacatttagtaccagcactgagtttcctgcctgaatttctgaattgctttatttccagccgttgggttttgttttcccctagttagtaagactggttaagacattacctggctttggagaagctatacagatgcaggtcttctgtagaggaagaacatggacacagccatcgctgtcagagccttgcctaccgttctgctctggggctgggtttatccggtgttacagtgcagcctgactcactgagataactgccacacactcctgaatccatcatctgctctgtgctagcctgagacccgggcatctcggaagtgtggtctctgagcttagaagccttactctgagatcagcaatgtctccctgggcagtgagtgggatggaatgacacccagcccatacctctttctaacctgggaggtacgatgctacccagagacacggccaatgtaggcattcgggattattcagaattccaaggataaattattttcccgattcaccgttaagtaaatccctttttacataaatttacttttttaaaagtaaatttcatttctctcttcagcctaaagaatcacacgttgatcccataagcgtgccccctacttcatcctctcctgccgaggactcggagctttctggtgagccggtaccagaaggaaccccagaaacgaacttgagcatcattggacacagcagccctgagcaaggcaagtcctgacacgcacatgtgagtggcggtctatcaccgagtgatcgacacgtattcaacacacagagttcacgtcatcatcccttctcccttcaagggaaactgagtcacagagaaatcaggtagcccctccaagactgtatggcccgttagcaacagagctggcacttgctctccaatgtctgagcttgaaaccctcttcagacttccctctgctttctctataggaaagcttaaaagaagcattgcagctaattgtgtacctactgtgtgccgagtgtgtacatacttctccagttccacggtgccatctagtcagtagagctagctgcaattttaccagtggaaaaagtcaacccctggaaaaggccagggagtgtgttcacaagctcacagccccatctccgaatctccacttgttctgatttctgctacctacgttctggatctcagaggatctggtcagctaactgatggctagaaacaggcatgggtcacccagtgggtaaatgacaaccgaaagcaagcctcagatcccttcctgctgctcctctgcttctgccccccccccccccccgccgccactgcagtgcacaagcaaaagcccagagaacatctgtgactccccctaagcagcagactgacatgcacccgtggcctgaggataccgtttcgtgtagccctagctgcagcaaaggccagagctctgagatgtagaggcaaggtgatttccagcagcactgttcatccaaattgcctgtagcaaggatttgttaagcaaacacaatgtcctgtatccacgtgatggggatgagctgatgagttaaagacatgctgtggagccttcaccataagagtggatttcaaaactactaaagccaacgctatgagcacatgttattcgcatgtttgggggatgcattagccatttggtacaacatccagtgtggggtaggactgcaggtggttttgattctcgctgtttaacttctgtgtttcaaaacatcttttacggtagtagtgttcttgatctctttgcttctgccattggctaatgagagttattttaacaacggaacttggggagtctatgggtaagacaccaagaggactagacagggaaattataaataatttaataatgttacaatgaaactaaggagtcttgaagatgtggcagtaggaagccgggagggcagaaggaatgccagccagctttgagagaagccctccgcggttgcctatttgcattggggcatggctgagattgcaacctttcttaattctcgttggtgaattgtaaccatccatgcttcctggtgaatgagagggtaggctgcactgtggtttccatgctcctagcaacacagaaacatcatcaggcatggatactgttgtgttggtctgagtagggcaataggcagggtggcttttccagtctgagaaggcaagatctaaatggaggccgagacttccacctgagaagagcctctcaccgatacccagtaacagctttgctcctcatctagctgacagacggccagagggaaacccagagctagcccaagtgctccttttcttggtgagttaacagcccggatggtggagagaaggaagcctgtagcccaagtaccatctgcctggctctctgataattgaggctttctgacagtgtctgccccagctccagccagggtagctgcttgtatagcaccccctggtggtcagagcagggaggatccaagcacaggccaatgcgggacagaacactcctggagttctcagtggtcacacaggggctgctgaagatgtgaggggacatgtgaatgctacacgtatgaagaaagtcttgcatggagacaagcttgtctgtcttaccagctgctcccagtcactacttttgctgtgattttgctcctctgcagaagggtaatcaggataagacagatttggtagcacaggcctgtaatcccagccaattaggagacgacaacaggaatatatcataagttcaaggccagtctaggcaacttagtgaaaccctttctcaaaataaaacacccgcacccgcacacgcacacgcacaaagagggccagagatacagcgtagtaatagagtacttcttagcttgcaggacatccaatgctaagtctttaacactactactaatactagtaattaataataattattattactattttaaagttgtgattagagcaagatacctgccttggagtgttatcaaggaagctgagaatgaggaaatctggtctggcaggaggttggtggcacagcgaatagccattcagagccctctccacaaatgtgtattcagtcttcatagggttgtaggaacagcggtgagaccgacgacgaaatgataatctcttctctttccactcctgtaatctggaagaagccaacattcagcactgtgatttagcggtatatgcacataattatttaaacacctacacaaacaatatgtgtgctaggtaatatttactacatagcatacatatgtaatagaataatcacacagaatgatagaaaacacgtgcacgcataggtagtcacctttctcttccgtgagtatagaactccaatgctaatgagtatttgtgagtgacttgctatgtgcctggcactgtccagtacactttcctcaaatcatctcggtcggataatacagagtcatcagaatagtttctaccctccgaggtaggaatcatgatccccactcatagatggaggaacttgggacacaggttaagtatctgccccacgtcacattctggggcatggcaaagcatgatttcaggcagcaagaggtgccagcacgcatgatggaagccaccaggccctaggtccttgtcccgttctctaggctgcctcttccctcctggtcctctatctcggagtcattgacatcttcccaagttactatgtacaaagttgccgtgttctcttccgagactgcaaagcatagttattgacatcacaatttctgctccctgtagggtctggtgagatcctgaatgatacgctggaggtccatgcgatggatggggaccctggtactgatgatggttcaggggatggagccttgttgaacgtcactgatggtcaggtgagtgaatgagtggtaaactttattcgatagcctaacggggggggggtgttcatggagaggtcttagttgaatgtcaccaggactgatgtcctgtggtatggaaagagcacagtggtcaagctccagggacacaccagcgagggtggaggagaaaccaccccagcttgtcttcacccatgattggcgataaatacaaatgtagcatgctcatgatgtatgggatccttatgaagaccgcaggacaggacagggtcaactgcaggcttgcccacgccctccttagcaattgtctttcatctttacaaagccagtttgagaaatggcttgatctgataggggcagagcaccatcttctcaactccagcatttgtgtacacacacacatgatttgtgtacactcacgcatgaaggcctgagtgtggatactcagcccatgaaagagctggtggcagtgacgggtctgttaccccagtatgagtgccagggagtcaggtaaaaggatcctagacgcttggtagccattcagcctcctagaactggtaagctccagagttagcaagagacgctgtctcaaaaataaggcggagagccatgggtgaagactcccatgcgctcatacatacatgaacatgaccatatacacatgtgcactcagacctaattcaccccacatgaaaccctagaaaacaaaaataacatgccatccccacatcctatgtaaaccactatatagaccaggctactgtcttcaacctcacagaaatttgcctgtctctatctcctgtgtgcaggggttaaatgtgtgcaccatcgttcctggcaaatatgtggcattttatgacaccggcagctacagctgttccatttccccatttgttctgagaccttgtagacatcttttcttttcccagaggaaactaaatgacagagaaagagagaaaggcaggttagcactggcgtgcactggggacagagtcctgcctgcacatagctgaaaccacaagagcaatgtcattatacttatgtctggatagatgtacaggagtggtcacaggaggtctgtgtgtctaaacagtgtccagagctggagccagctgactcaggaatcagtgacctatggtcacccagtgtgtaaacagacgttggcatgaaatgtgagacatcaatgtctcggagatgtcctctgtcccctggattttgcaagtctgggactggtctgagacttctgtggtgaagtcacaaatgtggaggttcctaaggtcagggagctgcagggatgtcagctggcagggtgtatgtaggtggaagacccaggtactcagttctctccagccataggcttgttgatcagagctaagggaccaacagcagggtctctcaccatgtcctgttttcaggggttatcagcaacagcaactggggaggccagtgtgcctgtcaccactgtcctggaagcagagaatggcagtatgcccactgggagccccaccctggccatgtttacccagagcatcagggaagtggacactccggtgagtagcttaagnnnnnnnnnnnnnnnnnnnngcactagcctcctgtctacacaatgcagagtagcaatactatggggcgaatccaggtgggcacgagcaactggctgcagggcattcactcactgggagaggcttgtagagcattgtgccacaccaggcactggtcctgctagccaggactgatggtcaataggataggctgagttcccaagacacaatgattaagggacatagaagtccccaaaacaacttgtgagtatagaaaaggggttcagaaaggtagaaggtgaacctgagagtctgagggaagtatccaggccaatggcataggtagatgttataggtgagggttagaggagcaaagacccagaggccacacaagaactgatgaagtacagggtgcctttggggtctgcaggggaatgggggggacatcctgatgtcacctaaagctgagaagatggatctggagaggcccagtacatgaaggcttctgctgggcagcctgacaacctatagtgaagttgcagccattgaaaggagagggtggagagatcttcataggattaggattctagaacaactgctttggcctaaatggagaaaggacagaggagtctggcctgggtacaggggcacaggtccaggctgaatccaggtccaggtgaacatgggtggccatggacatgtcagatctttttaaaagttccagtgagcaagggtctggaaagcatccattgattttgtcagcgtgtttctgagtggcaatggagagggcaatttgaaatgtggaggttctcagccaggggagcaggaggcaggaagcaatcaggtgatttggtggttggcagttgggggtggtgaggtcagagactaagggcagttagatgtgcctgtcctttgaaagtgagcgggcacaggacacaggtacaagagaggccttggctatctgtcccctaaagccacaggcatgggtcaaagtggtggtccactagtctggaccttcgggatatctttccatccaggatccagaaaatctaacaacaacagcatcaggggatggtgaggtgcccaccagcactgatggggacacagaggctgacagctcgcccactggagggccaaccctgaagccaagagaagaggccactctggtaaggagtaaggcgagctggaatagccttcttgcagtgtgtgtcttacactcaacaaactggggcagagggggacacctctctgaccaatgctagttcagaggtggaacttgccaggacttctaagtatacggctcagcccctgtagtctagcagagtctgagaaaagaggcaggtaacctgtgtggttagaagagtagaggggagtcctaggactgtatgcagagccttttgtccccaccagcagaggccaggggccaggggtatgccctacatgtgaggggaagagatgatgctgttgctgtgggttggtagggtgcagacaggcaggcagagcagggtgaggtcaaggtcatactgtctgcagtgtagagaaggctgaatataggcatcccaactggacagtggacccatctgtctctgtgatgtccccatagaagctctctacccattagattcaaacttgcctcctcatgccactcctgggttcccgcctcatgtgaatggagatagtctcattccagctgcttcacatgaagttaccttccctcttccttctgtctgatatccgatgagaacggagtccttttgacttttctacgtaaacctgtaattgactggtgtggatcctgcctgagtaatcttccccagacagacagttattcactcacactctgtagtctctcacagagcctggctgggtgttgcccctcttctttgaggcttttctgacctcgacctactgacccagatcctctgaccttgacctactgacccagctcctctgagacgccaagtagggtctggtccctgcccttcttggctgcaccttggggcttctgtgtgccagacccaagccacggcctcctacttcaagctcctctcagttccttcttgctctgcagtcttcccacactcctcctcactgcagagagactctccccacccctgtcccttcattcatttgtccttcagagttagcctaacatgggctgtgaaggctgctggccttatccttagaagacttcttcataatggacttggtaaacaggctccatgtgtagtgcaggcctggctccctagcacgtcatgagcccggtggggatcaggtccaatagacctggcttcccgggtctgctttgcctctctcaagtggtgggtgctggactaatttgctgagtggattcgtgaaggcagagggcagctccaagctcctcctgtctgtaacacacgggaaggcagccttctgctctgctgtgttctgctcttgtatccacacaggctagtgacagaattccccaaggccacctgactgttacacagaggagttcaaagttccctttcctctcttcttccgctttcttctttaaagacatagtatgtgtcacagcaggagaaaaccaggaaccagagtccatttctaccaagtctcagctttaatagaagctggataatggaggagctagagaaattacccaaggagctaaagggaactgcaaccctataggtggaacaacaatatgaactaaccagtacccaggagctcttgtcttctgcatatgtatcaaaagatggcctagtcggtcatcactgcaaagagaggcccattggacttgcaaactttatatgccccagtacaggggaaagccagggccaaaaaggggcagtgggtgggtaggggattgggggggtgggtatgggggggcctttgggatagcattgaaaatgtaaacgaggaaaatacctaataaaaaaaacacaaaaaaaaacaaaaaaaagacatatatcaacaaatcttgaataataatctattattgtcgacactgaaaagcctgtcattctccaatctgattttcacctttcagtgctacacacaggttaatacagtcactgcattaaatcactataaaaatgtaaaaaaaaaaaaaaaaagtagaagctggagcttggctagcagaggaaataggagggccgtctgcagaggtgatgtactccccaggaccaggagtatgcaaactaagcctgagatatatagcactgagcagagatggatagctaggtgggtggattccagaggtaggctgaggatgcccaggaaggcgtattctgactctgagccccagcagcttgtacactgaagcacacagtccttgctcagtgagtacagcaaagaggcagaggagttgctgagatctgattgtccccgtggtttcctttctgtagcatgtgcacagccaccgaagtggaagtgggggtcatgtggcatcatctcatgccagctctcttccagggttcacacggtgaggaatggttaaccccagctgtgtccaaaatgcccctcaaggcttttgaggaggaggaagccagtgggactgccatcgacagcctggatgtcatcttcacacccacggtggtccttgagcaagtcagcaggagacctacagacatccaagccactttcacgcccacagtggtccttgaagaaaccagcggggcccctacagacacccaggacgctctcacacccacagtggcccctgagcaaatgttcactgctgtaagtcccagctagcatcttctctgatatgtggggacagaacggtcagcattctgagccattaaggtcctctgcagagacacacacaacttcagctctgttgtgagagcttgggagactccaactggacagggaaaagagacagtgtttaaaaggggccaggttgctggcttttgtcccaatctgctacatcctagttttgactactcattttcctagaggtcaatgtcccgaaggtgggaaggattttaaggaagtcacttctgtgactgagccaagtgtgaggatgttggtaggtaacatgttttgacattgaacagccaccatagaagtgacacccccaagtcatgcagcctcgtggactggggtcacaatgacccctcctgtgaatatctttgacaggaacccacagatggaggagacttggtggcgtctacagaggaagctgaagaggagggatctggtagcatgccccccagtgggcccccactccccacacccacagtgactcccaagaggcaggtcaccctggtaagtgtcctgggggattccactcggctagcagatctttcggtgtggagaaaggctgccccaaccttctcagggtcagttctcatcttggtttgtaaagacagtgtttgagggcctttggccagacaagccagggcagactgtagcttgggtaggaaaaggccaagagtaaagactttgcttaggtttccaattgcctttgcaattgcatcaggattagcagtgtcacagggcataaacactgagttaggactgagcagggtctgtagaggcatggagcataaatggcatgtggaccttcgggggctgggggtctgaggctgtgggctgccactccgaccttgagctgtcctttggttctgcaggctggcttctggtctggagtcagttcagaagatgttcagatccatccctgcacacccttatggtggcctgatagggattgtcactgactcagagactcgggcaactcagagtcaggcttgtgtgaatccgggcgaactgctcttcaggggggagacagttttcaatgagaacctcctgctggtgacacacctcagtgtgacactctgaaagccgcccctcaaggtccagtcatgtgaccccttcagctgcagtgctctggtggcctgtgctcggggactgcagaggtcaggagagctctctgagaatactgaatggcccttgcccaagagcgtctcccagtgactagctggttaccatttgccttctttatcagtggttagagttgccctcaccaatcaactgatttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgagatgagagagacagagtacagtcagagagacagagagagagagggagaaagagagcagtagccacatgcatttggaagagtgatgcgtttggaagagtccagagcagagaaataaagaaagaagtagactgtgtatatatagccagcagattggacctaggcaggactgtctgtgagacaggagaaaagaacaggaaatagaaaatcgagaaaacagaggggagagagggagagaaggggggagagagaagacattgaggctagcaaggttataagtgaaggagtagaattggggagggggaagctcatgagctggagagaatttgtggtagaggagaaggtgagaaggaagtttgaaatgagtgtcaggtacttgcgctactgaggagccatgaggccagcgtgcactttgatatgctaacaagcaccatagctgtaggtgccttctgtccaaggtaaaggaaatggttcctttagttagaggggaaccagcttcacaagttccttgaggatgctggcttttatctaaccgccagaaattctcctacttagacagagcctatttctgggtatttgagctgccttttggagtttgaggaattggagtctcctttggatctaatagattcatctttcaggggtcttttcatctctgtctcccaccttcttttttctgtttgccattgatttgggggggggtggagaaactgggccaaccacccttgtatccttgagttttctgttctgagaagttgggctgttggggccagtcatactggtgggttgagggtaggggtgagtgggtggagcttactgcttctgggaaactctgtccacatatattaatgaccacaaaactgcatattaacagcccgaaattaaccaccacacaattgcaaccgggaatttgggttcaagcatcttcctcaatggagacagcctgatatgtaacaaaggatttttccctagaatgttaacctcaatatctgtccataatagaggaaacttgggactaatttaattaactagccaaaggagactaattgaattaaagtctattcaaatcatgggaacattagacataattaaaattattctcatttgtacccagtgttggagaacatgcttaaggtgccatgctaagtgaaagaagatggctataaactcgagtgtgctgtgtggtcttaactgtttggaaatacgtactctggaagggaacgctctccttaaatgttggcagtgttgcttcagactggtgggactgtggcagtgtggttaggttcttcgtgtgtttgttgtttttttgctgcagaactgtctaagtttttgcagtagatttttcttccactggtgtttgtctagttttgtagtgttgggggttgaatctaaatccttgtacacgctaggccagcttcctaccatggagtgacattcctagcctttatgacagaatttttaaagtaatgttttaattgatttatttatctggcgagggtggcagccatatgtacatgagtggaagccaaaatagggcaccagctgtcctctatcagactttagctattctcttgaggcaaggtttctctctgaacctaagccccctgcccccttttctcaactagtcttgaagccaacaagctgcgtcaacccttctgtctcgccacactcctacaaaacaaaagcaaacaaacaaacaagcaagcaaacaaacaaacactacagtcatgagcatgcgaaggatgcccagattgttagcgagtgctgggatccaagctctcatccctgagattgtgtagcaaccagttttatccgctgagacatctctctaaccctagattctttggtaaatctctaagaagagaatgagaggaaggaggtataagagaagcagggagggagaggaggagtgtggagaggggaaagagaagaaggagacacaggaggaagacaattaggaagagatggggtaggcgaatgagcaactgagcaaaacacagcaccctggcacgcaagtcgtaaaggcggatcattgctgagtgcttgtcaggcacctgctaggtgccccggcttctgtgtggaaagcttaagctcagccaagagacacctgccctgccctgggacagtctcagagtcattttgaatcacggaagccatgaggttcagggagtacaagacgagcctgactctgctgctcacctgcaaccaagttcttcacgtctctttgcttcatgccgctcgcaaaggtcaaggaccactgcacggttgggtcctaccatgacttgtgagattcagtgagttcatggatagagagtttgctgagcacatcataactgctcaatagatgagctacatgcaattatgtatcccatgaagctcagggagggctatgctcacatagtttctggaaaaagggatggagagagagcatggttgtgatttgagtatttgtgctgtctacagcaagccaccattatcagacatgacccagatactagtcagcaaagctcacccattttaaaattaaatccttccattggctgagtcctttgacctctaagggccctggctttccctatggaaagtcctgaatcacatgctttgtccctggctttccccttgagagggggttgaagaagacgaagacacagggcctgggtttgcctctcggcagatggaggatcttagtagatatgtagtctggggtgatgggggttacctgtggctcagctgccaggatgaaggggtgcttagacaaatgctgcccgaggtccaggtaacgggttgtcttctggaagaactgctagggcaagctattccaacatcactgtgacccaactgtgattcctcgggactcctgctctggcccctctccatctctgccctgggcctctgttttcatctttcttggagaacagtctctagggcagccagtggtccgtgggtgaggtgtcctccttggtccatctctgccacttcagggaacttccgaggcagggttcaaaggggattcggggagccctaagaagaagcctcctgacacccacactggggggtcaatgtccctctgcactgtccttttgttcggctgaaccattctttcatcttatttgtcaggacagccatttctctgcaggctttctgacagctgagagctcctcctcccctccctccctccttctcccttcctgtcttcctccccctctctttctcctcctcacatggacacttgtggcatccacagacatttccttaacaccgttattccaggctatggactagaggggctctctggagaagtccatggtttaaggatgggaggagtcaagacctagagaggctttccggccgtggtagaatgagcagttcactggttccagatgccaaacctctggcagggcccaaacaagggctgcaggaatcctcaggcaacacccgggtttgtgcaatgtgtctgcatgtgcagcttatcctacgtgccccttccagtgggatgcgggaacaaagggccaatgagccccgagaaccagcaggtgttggttgtagggggcagggtgacagggtatgccttgggccatccttataaaaggaaatgccttccttcagtttgtgtttaaagattaaaggtggacagtttctacagagaggaagggagcagtgagatatgtgtcattgatcccgtgggtctctttaggatgatgctgtggaggaggggcattccctggacctccagactcgatggctccttcagtcagacctcaggcttccactgttctggaggcctgtatagggttcagttccatatttcattcatatcattatattttctgggcccccaatggagcaagaggggtaccccaattagtccctggctcaagacatggttctttctctgggcttactatctctaggattgacaccccagaaacaaaccatgaatgccttcaatgggtccctctctgcttcccatttggcctcccaagttccccaagcctagctgtgaggtactccctcctctgtcagatgaaagcatcaaccttcagtggggcttcttacctctagtgctactacctctgccttgtttactgttctattgctgtaaggaggcaccatgaccaatgcaacttataaaaaaagacatctaattggctgcttgcttacagtttcagagggctagtctcttatcattaaaggagcacggtggcaggcatgcaagcaggtgctggagagaaaatgagagcttacatctatctgaccctcaaattacaggccaagagagactgagactgggcctggtgtgggcttctgaaacctcaaagcccacacccaggtgacatgccttttccaacaaggccacacctcctaatccctcccaaatgttttcactatttggggaccgagtatgcaaacataggagcctatggaggccattctcatttaaaccatcgcaactcccttctgatggccacaggacagtgagtcctgcccctgtgtctaacctacaaccctgatcctcctcggaccttagtgaggtcttggcatagatacatttgacaatcaataaagctatacccaagtccttacctgcagaatgctttcacactggaagatacctaggagctaagtctggagatacaacagaagggcttgaaaggaagctgagtccaggccacctctaggctgtaccccagggaggctgaggcaggactcagctggaaaggggagtatggccagaagagaagttggccatagacattttaaggctatagaatatgaacacttgaggtggcataactgtctacagagactggaggttgaatctgcatgtggggatttctttttcttcaggtaggagtggaagccgaggggtcaggccctgttgggggcttggatgagggctcaggctctggagacatcgtgggcaatgaggatctgctgagagtgagtattaaggatttggagggctgatgttggggaactgggagagaagatcgtgggtcaggcaacagtgactgtagattggccccttgggaactattgactcttgtgtgtggcagttatcacacactcccctttacatcatacatgtttgatatttacactgcattttcaatacgcatgagcctggatttgtgttgagaatccccttcgccaccttcctccttccctggaatcagttcctttctccctcatagcaggtttgttcactgaccttcacctctacccatgtctcccgcccaccccttatttatgaaagaattaccttggtttcttctatgtttggatcacagctcacactcagcttctagtgtaaaatcctgcatagccccccagtctgctcttggcccattcttggtgcctatggcacatctggcctgcccaaggctgggctctgctagtcctctttaaattgctcacagggaagtgtggctggttctagatgcagctgttgccccatccttggccccaaccctctctccagcccttcctctgagccctgtgctaccccagcgtgaagctcgacttagctgccctctgaccattactcatgcccagggctgggaaggttctgggctctgtgaatgggtggtgtgaaagcccagtagatctaccaagaacattctcggctggtaagatctgacagcccagcaggaggctaaggaaacaatcccctttagtaagcatttcaagatttggcctcatcttgaaggctgtttggctgaccttatagtcaattagaaagctgaattagccaaggctcctctgggactctagataattggctctttatcgtatgcaccatttgggagaaagcatggtgtgatctgcttggaaagctgtacattcaaatgtcagctccctgctttccaactgcgtgggtgtgagcccttgagcctagtgtctcctcgagcctcagtttctccctgtgcaaggaaccccaatccttctttatggcttgtttcgaagattggaaagaaggttaaatacatgcttggtattcagcctctctcattgattctaataaactgtctttcagggtccgccgggtcctccaggcccaccgggatcacctgggatcccagggaaaccaggaactgatgttttcatgggacccccggggtctcctggggaggatggagctcctggtgagccaggaccccaggtgagcaactgcagccttctccctcaccctatgatcatggaggtttcaatggggctccttttcacacacagatcccagacccagcactacccaaggctggaaaccaaaaccttccccatctgaaccattgctgagactctagggaaggacagccaagaacgttctgtatgcaccagtttccttatttgtgtgtgtgtgcgcgcgtgtgcgtgtgtgcatgtgtgcatgtgtgtgctcgcacacacacgtgctggttggggttgaaggctcatgcaggttttggaattgaccacagcataccacagttaggcctggtatgggaaagccttgcgtaatctattcctactctgctcctgatgtccttcaagaacagagctctgagcaggtaacctagagagagcagagtgggcttgtcttggggcacaagctgcaagccaactggccttgagttccccacgcttctctcctcctcgtagggttttgtgtggtttttagcagagattctgtgaactaattgtcactgatattccccagggccccgagggacagcctggacttgatggagcctctggccagcaaggaatgaaaggagagaaggtaggggacaatgtgaggttcccacccaggatgccagcctggccactctctcaccataacctgagcttgtcccctgtggtattctctttcttcacctctctgggatgttcccaccattgggctcacagtccccttacctgtttctccttcccactcctgtgtgccatagcatcactgaacagtagtgacaccatctacctcgtgccctacctatgaccttgctgtgtatcctgaccagacatccttctcttcctgcccaccctgtagcattaggaccttccctgatgtcctctcctcctacagtcatcctctgactgtgcctgtccaccttcaggtagcagaaactcaccgactcctgagaaaatatctatggcaccctgttgggcaaagccctaatgcatgtcgtggttggcaccagctgtttctgtagcatgtgactactgctcactgctacagctctgaacaacaagccagttgctgtatggtcctctctagaaggttctaagccgccacatgtggtatctgccttgtcagaaatgccacttctttttgtcattaatacctatttcagatacagtgacccttctttatcctaatggttatgttataagacccttccccacacatttatattgttaaacaataaattgttccttgcacacacacacacacacacacacacacatacctatttagtatctaacttaagcacagtaaaagattaactgcaatatctcatgatacaataaaccagtcataacaatataccatagtaaaatcactggtatcactactgtctactttagagctatcattaggtaaaacaagggctaatgaaagggtgaatgacggtctgctgatgacagctaagatactgatgagttggtagtatatagaacatggatatgctggaccaagagattgcttatatcctaggtaggatggagcaggaagctgtaagatttcattgttctgtcgagaacagtgtgaactctaaaacttgtgaattgcttatttctggaactttccatttaataatttcagcctctggctaacagaaaagctgcaaccaaacacagtgggacttggataaggtgagggggtactgaatgtccttctcttcactcttttggggtcagtgttttgtttgggatttgttacgatgaggtcatgttacctcggctggattagcctccacccactgtctagtgctagaattataaatgtgttccatcatgcctgacttctctcaacatttccagttccttcttcctctttctgagagtacagggagaaccttcttagcaatgacacagaagttgctagcattcctgtgtacccttatcctgccttagagccgaaatatccttccaacccagcacagcctctattagtcttttatgagtaagtggaatattcttcaaacagcatcttaagctagcatttctccttagcctgctttcagtcttctgaagccgcctactacccatgcctgtgctcttggggaagggcaggtcatgcccctatagccttaccagacataatgaagacatgcctctttatacaaagagagataataaataaaaacgagacaccttgcactagcgatatgttaatgaaggttcaacaaacccactgtctaggaggtaggggccctgtacctcacccccatgaacatgtgtgaagtgtttcctgccggggcaccatggccactgaatccaatcccagtttccgtccatcggccttgagtgtgcttaactgaaagggtaacctgatttttgttgcaaatgaatttttctcagaaaaagaaacaacggtgcaaccttagggaagtcatttcatacaaaacaacagcttcataagaaatctaggtctgcgggaagccccaccaacctacacttaccttgtctgctcctacaaagcagcggctaagcctcccacactgtctgtgcttgcagacaccctgggctgcatactgacgcccctgttggctacagctggctcagctgcacagcaaggaggaagagccaccctgccctagatagctgctgcagatctattttgctggttcattcctggcatttgctaagagatccactggttgtcctgggggcatgggatgctttggggttaagcaaaggcagactctagaaggacttggacatttgcatttggagagttgacgggaaaacaaacagtctggcatacagtcacatatatgacttcatttgggaaggaaacgagtgtctcagggtcctcatgagacatcagctgtggtgatccatttgactcccaactcctgtcacagtatcttcttttggctcacaaatccttattgacaaggtctagccaggacctcccatgactggataaaccgagttataagaagtcttttctcatgctatcaatctgggctataagcccaggtaattacgcaaaatggaggacagtcccatgcctcccaggctggcctccagctccataagagctgaggacaaccttgaactctaatcctcctgcctctccctcccagtgctgtgcactgtcatgcccagctcaaagtgagttgctttcccaccatgcagaatgagtaagactctatttatttgcctgggaaatgtaatactcatatataaaaccagtattaccaaacatgaacctgtcatcaaagtgtagatggtcattaagagtctatctagtagattttttatgatgctcagcataaacagaggtaccttttatcttccccatgctaagctgaacagctaaccatgacacctttatcccaggaaggaagaagtgagaatggcctattttcccagctgcagagcagacctgggagggcagttgaggatccttctagaaagcaggatactcggatgttattccttttgcattgacgcttctgcctacagttctaccaggactgaggcatgaagtcttcagggttcagggtattcatggtacccatctgtcgtagaaggttctgagacacccacgcaggaaagagtctatactctgaaattttcttaactactcagaatttctggggaaacttgagcacccaagagctgtctttgagtcatctcactgggctggaaatgtcgacgtagactcagcttctgtcttttcttgtcagttagaggagaaatttgatgatgtcgtcacaaatatctcttagatatcccaatctgctttggagcttggctcgtgtgatagcatcagggcacctttgaagactctgaggtagaactgcttttgcctagaatccataaaccagctgtgtttgaagtccaacacaccacagtattggcttcttggcttctctctattatcatcagttggttttggcatatttgtgtggagggtttccataaaaccaaagagactgtagtctgtagaggatcattactacgaagcccactcacaaaccctgcagactaccctacaaggaactccagcaggaaaaaaacgtcgtgtatctgggcctttcatgtctcctttatattgacatcttgtgatacccttgataattcagttcaccacaatgagccaaattttctactgagttctgttagccttcatgatgctctgactaaatacctgagaaatggtagaaggatttgctttggcttttggttcagagatttcagctcatcgtggtgggagcccacagtgagtcagggtcagggctcagaggctccgggcatcacagtaagagtcagtggtggggcagtacagaagagctcgtgttagccagaaacagagtgcatgcctgagctagcagctctccttttcccaactgtagtccatctggacccctagtctatgggtcatgccactcagattcaggctcatggcctccctctttatttaatccacaccacaggcatgcccagaagtgtgatttactgatcttgacattctcaggcccatcaagctagtagttaaaatttatcatcacagattctaagctacaggacaggcatggtagctcacacctttagtcctggtgctacagagccagaagcaggaggatccctaaaagtgtgagggtaccctggtctgtttgcatagtaagttctaggccagccagggttacataactgagaccttgtctcaaagtgttaaaaaaaaaaaaactttaaaaaaaagtgaagtacgatcttatgacacacagcactgttgtgagtcagtcagctgtagagttgatctctccatagcttcctacctacaaccacatatctctactagttggaatttccaagaaagtgctggactcaatgcacacaagttcttctggctaaggagtggtgtctgctattgtttcatttcggaagttcagcagatttcctgagctatttctcacagttctcaatttttaccctattcattcaggaaagctccagtaaggtagacccttctatcccctggctaatctgctcatgttccaatctgatggccaccatgcctgcgaggcagtggactggacctaagccctacctttttcaagctgagtaaaataacgagagagagagagaggggggggagggagagagagagagagagagggagagagaaacagagagagacagagagagacagagagagacagagagacagagagacagagacagagacagagacacacagagacagacagacagacagacagagacagacagacagagacagacagagacagaccagagtgtaaggtagtttctagaacttcctctcaatctgctacaagatatacttggcttaaatgaacttgggaaagctattggaaataatgcagtttcccctttcatgatatagttctttttaacgggatcaatcgcaagtgcagctgaaccttaccagagttggggcaaccttaggtatggttcacaagagccccgctggtggttgtgtgtctgggaatagatagttttcttaaggaggtactgaagcagacagtgtgcaccatgtaagtgctcggcccaaagggaagagaaataagaaactgcagctaaatagggactcagtaacttgagacacatttctgccccaggtcacacacatttgctcagtgtgcccctgttggccattggtgaaagtgagggtgggggtggggtgagaatggggatgggatgggggtagggatatgggggtgggtgggtgctgtctttgatcatgactctgcttagtgttccatttccttgtgtctccaaacagccaggacatctctgatggcttctgggctagggggcatttgagcttctgcaggacatccttagggccagctacagagggttctgactgtgaccattgggtacactccagcatcctctccctgccctgggagtgaggtgccacctccaacagactcaacacttttcctgctcaaatccttagcccaaggactgagcagggtctcccaaccaaagagccgttactgcgatgtggggcctttcctctatgtccctatactaggcacctgtcttccttcagcactgttggaaagagagcccacacccatggaatcctgagcctcaccgcaggagcctgaggaaggttatcaacaggcccctgagcagagagcactggacagagaagcctggtgcctgcctgtgggtctctgggtggcttgtctgtgtgctgggctacccagcgatgctctcacctttgccatttacctgaagaaagtcctgtaggctcattctcagtaaacattcccagagccagctggaaggaacctgaaaaagtattcaattcctggcttcttccttatgcctttcttggcagagccatgagacaaggaagtgtgtcaggctctgatgggaggtcagagaagctctgctttaggcagtctttgagtgaatttgtagttataaaagtaggcaaggtggacacacctttcattgctttctatgtctcatgcttcctcctccaatattcttgaaggatgatatatgctgtcttcagagcaggtctgtgcacagcaaactttccagattttggctgtttaaaatcttctgttagcctagtggtgctagcacttaggatgcagagggaggtgatctctatgtgtctgatgccagcatggtctatctagatagtgaattccacaccacacataatgccatcctggcttatttggttgcgtgtacaattttaggtttgaaaccatttgccccagagctttgaaggtaagcattccgttatggaggatgagctcagatttcactcccagtcccagcctacctaaagccaccgcctcttcccttggcaggttttaggagtcacttccctttgcttggtgtgctgaaatcccttggtgcatcgtctctggatgtggattctttaaagcatgtattctcctacttggtgctaaagagccttggggtggagtggcgtttaatctgggggcctctgggttgtgaagcttctgtgatttgtttttccagaaatgttcaacgtagacctcagccttctgctaaggtcaagtgcaggaatgtcaagttactgtctgcttgcgtgctgcttcctccattctctttattctttattctgtttggtcagtaattggaattcccgattatcctcctagctctatttgggcattcttcctatgcattttattcatttgtgctggttttcaaagcagttctgcatcctgttctttggtcttttctgctgtatttctctccaggatgtttctctttctcttagtcctatagagttcttcatttcaaccatcataagtttttatgtctgtggcccccactgttctcacctcataacagttcgttcttgttttgtgatttttgtctcgtcttccctcttctcccggaaagcatcagcgttcgtagcattcttgttgcgtggtgttctttgtgttgttcctgactttgtctcctccccagtgttgcctttcctcagatccgggattctttctgcgtgttggctaacaaaactggcatctcatgtagtgcctaggcctccgttggcattagaccattaaggaagtaggcacgggctacttctgaggcatacaactttctcggtggggatggaaacaccagaatgtccatctcacaggacacctcagaaactgatctcattttgggtgcccagggatcttccagttccagagcactgccctccctttgctcctgaacataactcttactgttcttatggtgttaaggcacccccaggtgctccttgacacgagtatgcaagaaggtgaggggaactggggaaggctgacggctgtcctgaagtagaaactcatcctgtctccctgtcagaggatcctgggggcatccctacttcttgtttccttcagggttacccctggttcttctccccacccaccctatgcacactcttgctttctccaccaccatgcagggcatttcagtctctgtggttcctctctggatgaagccttcttagtttcctgtctgtttcactttggcatttcaggccaggggatttctgtcttacttgaggacagtaatatagactcaccacctatctatcctacgggtgacggaggctactgctatgcatgggagttagcccaggaaaaggataagggaagatacagtctttcgtggctggcacgtcatagtctgagtcatagcttctgtgtggccgtgtgatagctgggctatctcctgccggagaacagcctttgataggttcacagcttcagggtttgaggtccagttgcctagctccattgtttggtctgggccatgtttgagacagaatcagggcagcaagatgacatgacagagcacagcttcaagctttcttggcagttgagggcaaggtggtggtgtggatgcagagctgattggctccctgtttcttctaacttggcccatggaccccccccccagcctatgggatggtgctacccatatttgtggcacgtcttccccccccttatttgatgctctctggagactcccttagagacacacccagaagtgtgcattacaaatcctcaaggcacttctcatcccaaccaagttgataatcaaaattaaccactaccccttcccttgtttaaagttgtaagcaccccttacctctatcatgacaggaggcagggtagggggcagctgccttggtgtgagtctccaagagactgctttgatctctccagcttcatgccaactgccttagtttaatctcaaggaggagggcttggttaattattgaagaatgggtttctctaggtttaggcctgacttgttcaagtagactgatatctatggtaatgtgctcagcctggagacaccagacaaacccagacagaacaagcctgttgttatagcctgctattcactcgtctgtaattctgcatttctctttgagcaagcctagcacgttgcattctaattggtccctgtgttcgtgtgtttcagggagcaagagggcctaatggttcggctggcgagaaggtaattgagaacagctcttctccccctctacttccctctccagtgtacccttgggccagaagagcgaacccataaatgtcacagagcaaagagaagcactccccagagcggaggatcaggaaagataggccagctgggatggtagggagccaatccggcaacgttcctccttcctcaatactctagtgagcacatcagccaagggaaatgccaattagtgagacagctgttctgtgccatcaagcatcgcccatcagacaatttctaaacttaattagcttcaaggagtcattttctgactcaggtgctcacacggcttcttctgggggaggggagaagttgcagctgttaactatcctgtcttctccttacagggtgaccctggaaaccgaggcttaccaggtcccccagggaagaatggagaagttggcacccctggggtcatgggaccaccagggcctcctggaccccctgggcctccaggcccgggatgtaccacagaacttggatttgaggtatgtttgccctttctgtggctgaagagtgatggagggtaaagagcactggaagccacacacactgggtactggtccctgggtagaggctttgtcaagtctcctgtgagtttcttgcccccagcatcctgcttggtccaagtaggtagttgcctggcagtgaactctgaaatccttgcttcttcctcccctagattgaaggctctggggacgtccggctgctgagtaaacccacaatctcaggacccacctctccaagtgtaggtagacttctatgaacccttttctgagagctgtcctgatgttacccctgggggaggaactcactttgatgattcacacacactgtgcctccaaccccatgctgtgctgcctgtaaggtactgactgcagtgaggaaacttgatagtcatcttcgtccctattggccagttccttactactgagcatctctgtttcatgacttcctgtcaccgtgttaggctcccaccaggtgcccaccctgtccactcgctcatctccagcaggcactgcccttgtcctgtgtggtacacctgcatgaagacactcccctggatattatgatcattgtcacacagaacccagagccaagtgctgagggagtaacttctaatgtacaagacagcttctcacacatacgggatctaagggtggggtcaggagggtactttcatgctgggagaggacctctgtggattgttgtgtgtggggactcttctgagtctggaatgggaatttcccccttgtactttgctccatcatctgggacagcatccatcggagagcttagggagagatgcaagaaggtagcatgcgccagcaaacaggaaaaaaaaacaaagaatgtctagtcatctgtttgcttattcttatcagggtcccaaaggagaaaaaggagagcaaggagccaaggtaagtaagcccatgggaggcagggtctttctagaaggtcatagaagcattatccatggactgggagctttgctctttacttccctctgctctaactagggtgaacgaggagcggacggaaccagcactatggggccgcctgggcccaggggcccgcctgggcatgtcgaggtcctgtccagtgtgagtatcacccaggttgaagctttgccacatgttttctgctttgctaagggggaatagcaggcaacctgtcacttcaggactttgaggctggtggctatacagggtgtccctgcctgcacctgccagcatgctaacctatctgttcctatcccctccatgccaccacacttgaacatacaactcttctactgggcagggtcaggagtcagacaaccgcctggaaagtactggagtcttgatgaagccccagattaagtgccccagaaaggctcttagccagttgagaagtcaagtcaaagctggagacacaggcctgagatcattttcactgctggcagagagagtactgatggctgtaaccctatgggaaagccactaattccagaacccagccgtactactgagcagagtaattctagagtcagacaagagagagaaggacagtactgagcatgctccaaactgccatcaggaagcatcccccatcttccagagtggaggtaaagagaccaagaggagctagggttatacccctgagggccagttcttattgggaggtgtcttcagaagagctcattggatggctctttgtttaaaaaaatctgttagtagtcatattccaaaatctcacttggaaagcttactatgtgggtgagtaaagtaagccttgttccactctgatcccccatttctggggaggcatcgatatgcccccgattcccagggagacagtagtgtgtggttttcatgtcaccatcaatccctatgaggaagcaaaggctcggcaatgcctccccttccacctgccccttaccttctccctgttcatacctgagtgtcatttaaacctctgtatctgccatcagcactctgatgcagacactcgtgccaaaagaaaaagtccccaaaacctgggaaaagaatggccagggttaggaggagaaagagtaggatttaaaagtgccaagcccgtggggatggaagtagacaatcttgagcacttgtgggggaagtgtaaattgcatggcccctttggagggctccctgacagtctgttcaaactaaaaatagatgtcttccagaatcgcacatagaaagctccacacaagatgatggagtaggggagaatgagttgaaggggaggggacagggcctaatgccatttatctaaagtaatgacatgcgtgagttatattacacatgtacacgtgtacacacacacacagacacacacacacagacacacacactttatatgggcacatgtatgtatgtatgtatgtatgtatgtatgtatgtatatgcttataactttaaaagagagaaggaattcatctactggataattttaaagttaatttaaaaggaaaagtgacaggcaggctggggctgtttgacggggagtgggagggctgggtgtgtttggcagtgactttggggtgtgatcaatgtactccatactgggtgacttcaattaaggtctctttgccagaagcaaggaggagcacttgtctttctttgtccttactgtgaatttttcctctttcagtctttgatcaacatcaccaatggatccatgaatttctcagacattcctgagctcatgggacctccggtttgtatctgcatctgcccttgggtgaggtctctacccagatgccccagtggaaagggttggattttagctccggaagcatagagccagagtctctcaaagtcggaaagaaggaagcctgcatctttgagtttatataacactaagtctgtggtgcagagttgtgttcagggaggagaagtgttcagtcctgtgcaccagaaatctgtgtgagatgggagagcacctggaaccaccgcctcttgggtgggatcgtgggcctacacgtatctgctcagtctcatttcttggaagaggatgctgctaatgggacactggagccagaggaggactgacacccacttcacccctcctcaacccattttagagctaaataaatcaacatatgggggaactcaatgcccacctcgaggctcatggttgacagggtctcaaaagaaggaaggcgttcccatggcacctgacagggaccagggaggagaaatgctggccataggagccttgaaggtccaccctcatctctaatggccactcagatcccctggttctctctccagacgttgggacaatttatatgaggtagaggagatgaaagtgcttggtacctcatggcacttgacaagtaactctggagccagagatacatgcctatagctttgcatagcggatgtctgctggggcagcccaccccgcagcacccagggaggtccgccatccatgttgggtggggggcgagggaaaagacctggaatatacctcaagatgtctgcagctatctggaagatgcctctgcctcagcagcatctgtgaggctcaatctaccatgacctctcctgcgctgtgtctcatggggctcccatccattgattgctactgaaatgaataatgcaaagacccagtactcaaagtccaaggcaggcaaggtactgggcaaaagtccattcacatggggtctttgttctccctagaactgctagagagaggtttagggtgctagtgggtgggtagcagagcaagaggagacagcctaaacatgaatgtctgcgtctctgagctgctgggtaccctgggcccttggtagatggatcccaggcctcgccttctgtactttcttccccatcagcgtcctcctcatccttaaggctggatcaaccttctacttactctgtagcaacttcctcctaagagcactcaagtattacattcatgtctccactttttttctaactagttctttttaaaatgtaatttcttaacattgtgtgtgtctgtctatctatctatctatctatctatctatctatctatctatctatctattttcctgtcaaactcctgtccctttaatagcatcagcaacctggacttgtgacccagtggggtgaagtacactctgcttgccagaccctctaaaaatccccatccctttcataaaagtctagctcccagcgtggacccacttctcccctggcctccagcctatcttcaagcccatcttcagagctgacttacccaggttcccatactgtccatccctgccccttggaacttctcactgagtcatcactaagaggaagcttctgtggagaacagggacagtgatccacagtgggtggaaatgggcttagatccttggcaggtccctgggatcagtgacttacccaggttcccatgtcatccctgctggattaaacgggctcaggtctttgccctcccgagagactgactatagcccatgaggctcagtactcctgactctgaaaaccctttgtctttggtgtgttgcaggggccagatggtgtacccgggctgccaggatttccagtaagtactgcagtggctagcttccacctgtgctcaggggctgggctcattctgtttatacccctgagatgctgttccctcatccctcacgactgagccctgctccatcgcacacactcatatctttcatactctccgcagacatgtcctctcctttgagacccatagggtttatttttaaccatctcatgttcattttttttctgccgtaagtgtcaggttctcctgtgtgtatctacttttatgatagctacagagggctgggtcttatgtctctagccctgggccatccagccctgggcagtagctgggtgaccccagcatatcaagaaacagtctgtgaagatgagagacataggaagtccgtggtacacaaggacagaggagagccgtggagtggaaggctgataattaacagcctgtgtgtaccttattggaaggcgacatgttttttgcattagctatcggtttagtcagagtttgtgcctatgcagaaggccaagagaggccccagggggagagctgcgctgcttctttgaaactccacaacttggaaaggcctgaggtgctgtgtccggaacaaatgaagaaaacagataaaagccccgtaggagtgtgttcctgatggctgaactgtggttgatctccgcttatcttttcatactttttggaacttttaatacaatgacgcttttttcccttttttaagtgagcataaactatgaagagggtttaaaaaataccatattcactagacattagaacagaagagggagcgagcagcaaacatccttgtggttagcgggggtgggggtgggggaagaggtctgacctcttagctgcagcccccgaggtggctgcttcaagtctgagggcacattctggaacattccaacatgctttcctccatgagaatgattgtgtgctctgaggggaacactgcagaaagttagggaggtcgcaggaacaggagccaggccacatacctcagacgtgagtcttcatctgacagatttggccctagttgtcctttccttaaaattatttgaaaaagaaagatgaacaaaaagttcaccgctaaacaataacactcaaatgttttcaggacgcggctgtgatgggtagcagaccctttcgcctatcttgctaaatagcaataaagcaataaaacgccttggggcagtgggcaccatgagtgggcaagtcattgtcaggaatgttctgtgtctgctggagttggggatcatgaaccctggctgaagtgtaggatttggctctgcggagggtgctgggcagcccagcaaggggtagggtctggggcacaagcgttagtgcaggggcaacaggtctggtgtgaggaggtcaaaggaacaaagtaacctctatgatgtgggagatgacatgtgagtcccagccaagattaatggcaggctaggatgctggatcccatcttgtgatgtggatgttgggccggcacgtagaggatgtccagagcagctgggtgagtcagaccagggggaccaggtaaaagcaagtccgggtctgcccgcctgaaggaaccaacggtcagaggagttgatgatgtctaggcgagcaggaatttctctaccaaagagttaaaaggcaggaaagaagtgttactgggagtcttggggagttccagcagcgggaatcagggtctccgtatggggttcccacccttattaataaaagaattaagaacatacttaagtggaggcacaaggacattttattagcatttagaaggaaaccccagagtaggcaagctgtaaatctcacagctgcctggaggaggagaaaggagaagataaacatggagatcagccttctggtggcaggagaccacccaggggcacgagtcttaagaaaaagcaaggaagtcaaatctttgattaggaaggaacttaaaaagcacctttacgctctggccagcatccaaaagaaaaggacaggagaaatagacctatctgaggaaaggatagttgacggagtctcccccccccccaagtgcctgagaaggaaaagaggtctgacctatcagctgcagtccctaagatggctgcttcaagtctgagggcacaccctggaacattccaacatgccttcctccatgagaatggttgtgctctgaggggaccagtcttcctagggctgttccctagccagctccatgagatgctccactggggcatcctgctccaacgcaatgtgggctcttcaggcctccaatgcccttggcttctgcccagttccttgcctccttacagttaggaaaagatcagatctagtcatgacttctgcctgcttgataagagcttgttctgagagaggcttgggggagcgacagagacaaaggcacagagacagacaagacagagagagagagagagagagagagagagagagagagagagagagagagagagttgttttctgtttgaggaaaaaaaacttttaaccataacacaatgccctccaatgattctttgcagggccccagaggaccaaaaggtgacaccggtgtgcctggattcccagggctaaaaggagaacaggtaggggcccaggtggggatgtgcttggatctggctggccattcctatttggccaactgtttccttctggagacacaatccctacagtgcaattcattgacgtttaaaggattcccaatcatcactattctctcatacctggatgctttctttaattgaaatttattgtcttattttttatatgtatgagtgttttgcctgcttgtaactctgtataccatatgcatgcagtgactgctgaggccagcaagggccatcaaatcccttgaaactgaagataatgaaggttgttaggagcatgtgggtgctgggacttgaacccctgtcctctggaagagcagcccagtgtgcttaacctccgagccatctctccagccaatggaaggtttttgtgaagaagtgctgtgccttttcacagacaccttctagctgatggcgtctctgatctcacacagaagggcactgttgtttctgcccttcccccgtctgaagagtgtatggctcaatgcctcctagaatgctgctctcgcatactgagccatcctatctggtgattttaagttgggacattgtgtagttagagtagatgtcatgcaggggatttctggggaagttcagggttcagagccaccctttgtacccctacacagcctcttacaatcaacttccgggtagtttttcatagctgaggaggaggggagcatccataagtagacagcaaagattctggctcctcctcatgcattcccttctccatttgtgtgctacccctctctcatcttttgatcccctagggatcctggcagtttctttcttataccaagtataataggaagacaaagacagaagtgtagtgcagatggtgaagggtacccctcacccccacccccaccccacccccatttcagaggttgcacatgggtggggctatacctccctgaagagtctaaaaggagcatctttgagaggactgaggattggaagtttctctgggctttctttctcatgcaccacattgcccccaggacaaagaaagaggccccagagacttggtcttcaacactaggaagcagagagctcagtgtgttgggccaagtttggaagcacgtgagagtggtgatgtctgcctccctatggtgggctggcagagaaagggtgggattgggttgactctcgcaattcttgtttcccatgttcctttttctatgtggcaaggtaggtagacctaagactctaggttccagaggctactcctgctgctaattctctgtcactttaagtgtctgggacagccaccaggcagctctgctccagctctcacagcaactgtacctcctgccgctctgcctctaatgcttttgtgcttgcctcttcctgctgctcaggactgcctttcctcgccaacaaagtggtaagacccacatgtcagctgcgggctttgggggatggagagagaggcttccctgctcactttgatgccctacctggccactttcaacagtggaaatgaggttgctgtattgccagcccaattgcccagggctagtgcagaggcctagaaggatgctagtttcaacacatggcctttgtttctacatgcgtcttttctagggatggtagatgagcctattgagggcaggatttaagagcagtatcctgcatccttacccccaaatctcccatcatctgttgcccagcatctaggataactctaactaaccaataagctatttgcacagaggcttgaagaatggaggacacctgcacatcaagacaggtgactcttgtgtggcaagaggcgggcaccatgcttatagtgttgcctcttccagtttcatctatttaaacaacaacaataagaattcttggaggggacaagtctcaagtcattaggaaagcaaactatcagatttgataggagctagatgtctaggatgccctggaaggacatcctatggcaagaagtatgctggggtctgagaatgagggtacagatctgtcctccttttggagcccttgaggatgcacttgaacagttaacttagacaactcatagaagaaaaatctcagaaaacattccatcatgcaagaggcttttctaatcctttagcaagaaggctttgcttgagtggcggggctggaggggtggtctaaaggtcagaacccatggcagcaggacggagagctctcaaacaaggcggcaggaggaggctggaccttaaaagattctctgcattgcagggtgagaagggagagcctggagccatcttgactggggacgtccctctggaaatgatgaaggggagaaaggtaattctgtcagcccaccctgagtgcagacatgctttggcttgccatctttggttgtatcttaagaagtgttttctgagtgacaagtgcctgtctcctgttttagggtgaacctggaatccatggtgcaccgggacccatggtaagctgggggtctctccactgggttgggacaagggctcaaacttttaccgtgcttcggctcacttagattgagttactctacttgtgaaaatataaaaggtaatgcagtaacaggtggcagagcatgtgtctgtttgtgggagacaaactacagtggttgccaggcctacacaagactttcaaaaataaacaaaacagggatggagggaagagagatggggttcagtggttaagagcacctgctgttcttgcagaggacccaggtgcagttcccaatacccacatggtgaattagctgtctataactccagttccaggggatctggcactctcttctagcttcagtggtcaccaggcatggatctaatacacattcatacatgcaggcaaaacactcttacatataaaaataaataaatctaaacagcaataaacaaccccccactggttgaccataggagtgtcccactttcactcctgcataatccactgtgggtacttcctgctcaacctctgccctccaacagtgactccagcatcttttggatccaaagtcacaagagttgtctagttggaagctgagacaggagaaagaagaaggaacgataaaggggactgggcatcaccctcgcatgttccactggtcagaactcagattcttgggcggggggagggggactcagatatgtagtgtagctgtgtgtccaggaagaagagtagatctgtgagaactgacagatgccagggagccccacaaggaccctcacatagtactgggtctgctgtgttattgctttgggggcggggtatgccctcttctcactttctgggtttcttcctgcccatctgtatgataaatggattggattcctgctagatagtatcacaggctctttgactttgctcttttaaaaacaggtagcacacttggacttttgaacactttggagttctttcttctaagaatgaactctaaacttccctgttgagcatacacacacacacacacacacacacacacacacacacactacctcaaatgaagaaagatcaggtgtggctcacgactgaaggtcaggctctgtgtaagcttcctaagggacatctcttttcagcctcacagtcctctggtgtaatcacatgaccctcccccaagtctatagacaaggacacaggggttcaaagaagataagtaatgcataagaaagtgggagacttgaggccaacctgccatgccctgtatctggtgggactccctcccccacctccacccctccacacaacctccgagagataagctgctatctatctatctatctatctatctatctatctatctatctatctatctattgaagcacagtgagtgtcaaagttcacatggcatctgtttgactgaagctggacctcaggcccggggagaaaggtttgcacgtgagtgaacgcctatgtgttccaagcacatccttcaggaaaccttctgaggcttttgagtccctgaagtcaggcagaaaagaccaaatatagactacatgggctgagagtgaaggcagatgggagagtcttgttcccaactggttaaccactcagtaacctccagttctatgggaaatgcaaacagttagtagtggggccagcaggaggctccagatggctatggcgggtgtcccactgaaggccagcttgtgcacagcttgccaaacacaggcaataagggcaccttttaatttgcataatgcttccatctgggctaactatggccctagagaccagtgtagcttatgactcttttacaaaaatgctaaggcttgttactcaaagtgtggtctgtggatcagcatccccccagcatcacctgggagcttagtaacaatgcagaatggcaggccctggcccatatactagcgcagacactcttcatctgcactttcatgagacccaggacactccatgtacatgcgcacgtggggaatgttccagagaaccacctaccaagtggcccacccatgccctgaaaactccctctacttttgcttttcacttccctgagagtaatatatatcagagatttttttcatgctgaccctctcttaatgcatcttttagggcatgctatctatagtaatggcggtgggcagaggggcacatgattatagctgctattcctcaggctccagtagacaaggtgattcctgccaggagcttggatcagggcagtgacttaagaagtgtgtggacccagaaaaccatcactggagaagggtctgtgggtcagggactctacaggaggaccgaggcattgttctgaggctgggcttcaagatgggtgggggtggggcagagactaccatcctccagcctgttcttgggcacactggcacagggaggagcagagctgattcagaatagaggacatggggaccctggaatgaatgaccaatgcaaagctccatgttctgtgccagcctagcatgtgagcacctgggcacgtgaggcacgaagctgctggcttcttgctctttcttccgttctgactgaggtggtcctggctgtgtagcctttagaaaagttgggagatctgaaaatctgagcaaatgcttctaggtgaggagaggcaggagaccaggaaccgggcaggcgggtactccagggccattgccaatgtcccttcatcctgtccctgctgctctccctacaagagcagtcccagcactcccctatctctggactctgagtttcgggcatttgctagcctggtgcttgttttgcttctagggacccaaaggaccaccaggacacaaaggagagtttggcctcccaggacgacctgtaggtatcagtgttccccagactaaaagatggggcatgtggtggcaaagctgacccacagcaagagctcactaaggcatcttgtgtgtatctcagggtcgcccaggactgaatggcctcaagggtgccaaaggagatcgaggggtcacgctgcctgtgagtaccatggctacttctgcacctcatgccctggggctgcagtgcagacgagatcctgttagagtgtccagtacctcgaaattcaatgagtggggcctgcagaatgtgtgctcagggaagctttctttcttcctccattgcttccagaggtgcacacactcagccccgctcccccccatctcactctcaggagggtcctgtgtcccacctagaccattcccatgctgaagagtgtcagtctccccaatgcagacaccagacagaaaggagaaggaaagaaaaggggttctatgcatcctgtgtcccccctccttgctcccacacacggcccaggaatgcagatcttaacggagcattgctccgggaaccagaatctgggttccaatttcagttctctgtgagctgctgtgtggctctgagcaggttgtatcccttctctgggcctcattatttgtgggtgtcagccaggacggcatagctgtccagctgtctcccgcatgctttaccaacccttttcagtatgccccagatgagggagtgctctggaagctactccctcccagcttccagctcagagtgtgtagcaaatgctgtagctgcctcccacatccttaaacacagcagcggcttttcttttcttccttcagggtccacctggcctacctggacccccagggcccccagggccccctggagctgtggttaacatcaaaggcgtaagttaggatggggttgggagaagctttcctggggaccctgcagtgagcaccagattggcctcagctggtgctaggtttcctgatgccttcacccctcatattctctttccacaggctgtttttccaatacctgcccggccacactgcaaaacaccagtaagtaactctcatgtcttcatgcagcaggctaagtaccagtgcctgttttaggaaacggatccatcttgccttgggcacttttccattcctgtatgtctactctctgatatcatctatctacatataggcccttaaagatctagaagtttctagataatagaccctggtaatgaaataccacacactggcttattttaacagtgagtcgtctattagtaaaacaaacatttggcctcaggggcggaagaagcataaaattgcaaaatagactccttcttaactaaaagaagtgaccggaactcgtggcctctgagctgggaactgggggttaaaatttgtaactactcagttccatcctcctcaaagattgagttacccaagaggcaagcgttatctctcccagttatcatgggaagacagctacccacagaagctctttggttagcccaaggtcacggagcatggggcagctgggaccacagctcagatctcctggtgaccaggaagcaggtgcaggcactgtgatccttgcccagcctccccctcccccaggcagttggcagtaccgtctgtaggattttgccagtatcatagggagacatttatttctgtgaggaaacacggggacaaggcatgagtcatggatctgtgcgcaatcattctctcattctttcagtaaatatttactgagctctccccagtgccaaggactcttgctaggccccggggggaacacaggaatgacctagacagacgtggtctctgctttctggagtttgcagatgatcatttcaaaatattctttgaagtgggcttatactgattcccgtgggaatgggaatgctgctggtcgctgatgcctctaactgatgcaggccggctggctgtgtattggcctaggcctatgtccaaatctgacctttgaggcgtccatgtgggcagcccacggtccaagcatgctagcctggaaggcagagcgcgggatcccccaggggacagggctgaagctccaagtgagcccaacagcagcaccaagggcgtgtttatccagataactgtagcgaggcatctgctgcaagtgcagcttctggagataccccaagaaaacactgcatctcctcatacaagggcagaggctgcctaggtcccactgtttcccagagctcaaggtccctcctctcaacacagagccccacctccttactacctcccacaaacaatcccaacacaccaagtatgagacagaagaccacaaactttagactgttgtgggaatgatactgcagttgtacaacctgtagtggaaccctgtgtggtatctacactcgggggatggtggggcagttatggagtgacttaaactcaatgccaggctcaacgtgttttgtcttgttttaatttcctgtggcatactgggacaccgtagcgtttggaggcatgggtgtttcctacgaggccctcaaagtagacattatcaaacagaaacacacccagcacttcgcaagcatcttccagtttcatcagtttaacatcatgacagtttatatactcctaccaccttgcttaaccacttgtaaaggtcgtccttagattttctttctggaaggttccttcctcttcccaatatcttttcatgatgacccctaagcagcttgcaatccccacttacaagcacagaaagatcccagatctaggtggagcatcttctggggaaagatggaggcagagtgagatggttacctttaattgtcaacatagaacaaatcaaattggccgagaaaagagtctcaataaggagttgtctagatcaggttggcctggaattatctagattacctaagccaagacaggaaaacctgcccactatactagacaccataccctaggcaagagattctaagctgcctaagagtggagaaagtgagctgacattcacgtgcatacattaattcattgctctctgctcttgactgtggatttaatgtgactaactgcttccatgcagtgctgccttgacttcacagcagtgatggactgtaacctggagttgtaaaccaaataaaccctttctcccacaagttgctttcgctagggtttccaatcacagtaacaaggaatgaagctaagacagttgaacagtgttatccagaactgcttggattccagacccctgtcacctaatgaagagtccataaaagcccctccaatctaatgacaaccctgctatttgtcactgccactgctgcctgacctgtgccttatgcctgtctctgattacactcagtagcaaagcagacgattggcccagcttcagaacttgctcagagctggcttggacacttggcctcacatgtgagccaatcctaattgataagaaaggaggccaagacactcagcattggctgcactcacgaatgcagtctggaagccttgtgtttcccttctgcttagatttttggccagaaatctcaatgctgtgtgctcgaggccagctacatcatgggtttcccaaatgaaggcctgagaagtctgtgttgagggtactgaggagtattccaaagccaaatagaagcctggccagtgtcatttcatcctctgcgatttgtccccaggacaaatgctggggcagggcttcccatgtctgactgggcctttctctctccccaggttggtaccgctcaccctggcgacccagagcttgtcactttccacggtacacactcttttcttcatggtttctcagggacattcctgacctagtgctggccatggatgaggtggtcaggaggggctaacggggcatgggggaggggtggcagctgagctgtgggacatacctctgtctgctttcctcatggacctggtgcatcccgggtagcgggaagcgctccctctgttcattcctttgctgatctgttcagaagacagtcatggacgcctgcttggtgctgtcccttgatgttcctgcctccttagtccttaaaatagttcaagtgacaggaaaactaattataggacaggaaggatgtctcagctgaagaaggcaaggcctgagtttctgcgttcaatccccagaacccacatccatcatcatcatcatcatcatcataaacaataactgggcttggtggacaacattgggggaatgacagccaagggcatcctctagtcttcacatacatttgcatgcatgggtattgcacctgtatatactcacacagacacatacacatacacgcatatacactcatacagagagagagagagagagagagagggagagagagagagagagagagagagctattccaagaaaacaccatgagtacttagaagacccttgcctagtgtgtccatggaaacgtctcagggaagcatgtttgaaaggcaggaccctaggccagagtgtagctctgtggcagagcactcccctagcatgtgtgagtccttaggtttggtccacagtgctgtgaggagagggcaaggcaagacacagtgatgcatagttataaccccactactcaagaggctgagccaagaggatcataagttcaatgtcagcatctgtcttacattaatccattggaacctgcctggtcctaacctcctggtagagcttgtgagaaaccttgttcaacctctctctctctctctctctctctctctctctctctctctctctgagagtgtgtgtgtnnnnnnnnnnnnnnnnnnnnctctctctctctctgagtgtgtgtgtgtgtgtgtgtgtgtgtgtgtgtgtgtgtgtgtgtgtgtgtgtatgtgtgtgtgtgtgtgtgtgtgtgtgtgaagaacacaccaaagagggacaggcctgtaatcctctttgacctccatactttgtcacacaatgtctggcttttggtcacagaattgaaatacagcataaataagggaaagtctttatctgcaatcccctgcagcttggctgtgtcacctggtgtccctaatggtgtcttctgtattttttgtcattttggtcgtcaaatccagatcatgttctgacttggtgcaaggcccctttctttttggtgctagggcaaacctaagttttatggggcgttgttgtcatttgagaagagatctttctatatagctcttggtagcctgaaactaacagagatccacctgcctctgccacttgacacctggaattaaaggcatgattgcctttggcttatttataattcatattatgacatatattataatttgtattagctgctggtggtaggccttgggtgggaaggggagctgggtttgctgtcatagatcttcgaggctcccctgggaggaggggcaggagcagaactttttggatgtgcttgtcctggtgagaggtgggattctataaacatgtctgagtgttactactgcatcttaggggaacacttatggttgccctactccctagcttctccttcacggatggctgcagcctcagttggaaccttcagtgctatgcatttagtctcagaagcttcccagcatcagtggaactgggacccatgtggttgtagttccctggtgctccctagtgggtgccatcacacctttggtgctcttggctcttcttctacattgagtaagcctgtgcttacaaaccttatgatactacctctagtctagagaacattggaagatttagctgctacactttttagggttcatgaattgagaggtctcacatccacctgtagctcctatcaaggggaaggaaagaggccttccctccctaaacactgcttgcctataagcctctgtcacatgtatctctcttttgaggagtagaaaacaatggctggtgtagcagtcttgctcctcagactcatggctgaggcacaagtgggtgttcattccatcagccagctgtgggaatggatgattcagcctccttagttgcactgtatcatcacccctgggaggtttatctgctcttcaagacaccaggctgcacagccccaggggacatgagactggagacctgagtgggattaggtctccgtctgcattcacaaactgtcccaagggagtgagaagccagctcctgcttggtcataacagccactgctaggctcaattcttaacctttctattctctgacaacactgcattgctgtgaactgagtcaagatctggagacctgtctgaggcagtgattatggtcttccgagtctctatctgttggcttctaaggggccttctagtctgatggattttgctcaagttgattttctgcaacctatttttcctttctcttaaatatttctgtgtgtttggtgacaggtgttaaaggagaaaaggggtcctggggtcttcctggctcaaaaggagaaaagggggaccaaggagctcaaggaccaccaggtatacctgcccctgttctaggcaatgccgagtcaggctaactacacaaccatcctgcccacgagcacagtggtctctggtgagaataagttacaggcctgacacatccaaagcagaacatcgtggagagagcaggggctagggttggatggctgaaggcagaacactgcctggtatgctcagaccctggcttccagccacagaaatacaggctggggaaggggtggagctgattttctatcattcatatgtaaaatatggcacaaagagaatgggggcttgcctgggatcctacagtccctgggtagtgggccttgtttaggtctggagatgcctccaagcctagagtcaaatctagtaaaccgatgcagtttcgcttttagtaagtgaaaaccatggtttctaacttggaaactctttgaaacctctgccattaagttggtaagcttacaaagcatttttttttctgcaggccctccagtcgatccagcttacctgagacattttctcaacagcttgaaggtgaatgttcattattaaacatggtctattatcctagtcaatttgttgttgctgtaactgaataccacagactgggcaacatggaaagaataatggtttctctggcacatggttctggaaatctagcaactatgcttgttagtattctgcagagttgcgaggctgtgcaggaatcatacagcaagacagagcaaatatgccagagggcctacttttatagcaaagctgctcccgagattacaatttactcctataacctatagacttcacctctcagtaccagcaacatacaagttcagggatgatgtttccaacacatggaatttgggcctcctgaatactactaaaactatagcagcctgtgcctcagtttcttgagtttctgtgagaaagagttcatgccaggcttactgcaaccttccatggtctcttccagggggagaatgaagatgcttcattcagaggagagtccagcaacaacctctttgtatcagggcctccaggcctaccaggatacccaggcctggttgtgagtagtgactccctgggaacctgtggcttttcctgtgccccacccccaacatgaataggtggttctggaatcaaagtcagtgttgtacatactggaggccagactttgagatgagcaggctctcctgtgtgtcgttgcttgctgggaggttagctcagcctcccaggctgggtggagtgagtgaacctcaggcaccagccatacatactgtggcaaggtcactctgtaaccagagctgtcaatagtgaggggttatcttagaggatgaagggaaagttctggtaatgtctttagaaggattcttgattcttctgatgtttgactgaaggctaagcctgtaaagattatctacaggtctggtctttatagatgggaggagggtcaggcagccatgagagaagatcaaggtttgccccacttttctaacctaacttggcttgaggcaagccctctccattctgaggactcagttcctccttgtgtggagtgagaaggccactctaaatctccagggccctctggatgcctaggcttgctggtatctttggactccaaacctgggctgatgcttgctggaactgacaccacctggcattactagattttcacaaacatgctaagaggagagatttctccataactatgtgcttgcctcaacagggacagaaaggagaggctgttgtggggcctcagggacccccaggaattccaggcctgcctgggccacctggctttgggagacctggtgttcctggaccaccaggaccccctgggccaccaggacctcctgccattctgggtgcaggttagtactgaatgatgtctcattcctgctgcctctgcctttgggctcagggtagcacattgggtgacatgtcagtctatttgtttgatagagggccggatggagcctcccatcttctttaaaatggatacagttcagatattataacatgcacctacttcaagtgtacaatccagtaatgttgaaggtactcacagtcatcttcgccagcacttgtggttacactggctcagtcctgatggctgtgaggtgctagctcactgtggtttctcagtttgcctagtgagtaattgtgttgggcatctttccacatattctagaaccttcctggctgttttgtcaatgccttaagaatttgtctggtctcatggaagaattttcttgattgaggttcccttctctcagatgactttaactgtcaggttgacacaaaactactcagcacagtggcctaaaggaccagtatgaatggtcactcttggtatggaattccattcaggcttcataacttctagagtaaaaaagtaaaaatgagttatgcaatcattgaacaataccaagtgccaggaagtatactgaccattttactacagtttcctgggaattcaagaaaactaagagcaaggcctggggaggtaactcaatacataaagagctccatatgccagcacgaggatccaagatccccagtacttgtgcaaaacattcagatgcggtacacacttataatcacagtgctagagagatagagacaggaagatccctgggtctcaatgtcagccagcttcaggccattgaaagaccctgtcttaaataaaaagaaaccaggaggcagctgagagaaactaacatctgaggttgtcctctggcttccacacaccctgggtatgtatgcatggcaagcacacacacacacacacagagagagagagagagagagagagagagagagagagagagagagagagagagaagaagaagaagaagaagaaggaggaggaggaggaggaggaggaggaggaggaggagagaagactagtaacttcattttatagctagttaatggcacccacagaatcaaagcccagatacccatatctctaaggcctatgcttttcttaatgttcactcagtggacattctgcagtgaacaataaaactgaacatccctagacccaaaaagctcaacgtttgaagcactctggtgcccaacaccttgtgagtactggtatggtgccacatgtggaaactctgtaccctgaaactgtttaatgtccaaaattattattgaaatcatcgatggcttggactttataccagtgaaaaggtgtttctccagcatatcagaagccctgaagtcaatccccagaaccataataaaattaataaatgaaatataaaatgatttttagtttatgattctgggcctatccccaagatatgtcatgcacatgtaaatattctaaaaacctaacaaacaaacaaacaaacaaacaaaacgaaactctgaaacccaccttcacatggtagcagctctaagcacgggtgtttcttgccaattgcattggcatgagctgggtgtggtggaacacatggtgggatcccacagagccttgtgtcgaggagagccttgcagagggtggccttggggttggctccaacatggccttggctctcctggctgaaagcagaaacaaggctcaaatcaggttgagagaaagggatgcttgccggctggaaggaggggctaagcaatcagtttgtgagatgagtagaccagcaactggaacccaagaacagcgtgaacctaagaatagaccatttaaggatgctctggccatccttcgcccctctctgtgtaccagcttcatgctagctcttcacagaccacactcactgcgcagaggggaagagggctgctgaaggcttagttcttccactgtgagctggaaatcaggggcttctttgtcaacattggtctgcaatgtcttgggataggacagttccaggacaacattctaattggcttgtctcgagctaggtgtcgactttggaccaatcatctctagtcaggaggtaggaccacttgggaacatggtagctcttactgtcaggaaatggttgtgggtgtgaagggaaagacctcaagagaaaaccacaaggactttgacaggcactgggtagataaaccagatgtggctacagggccttgttggataaataggcagtgcagacgatacaggggtttggcaggatgaacgcagaaggcagagaatctgttgttcacagaagcgcgtggctagaaccaaaatccaagtcttcccctgaccctgtacccacgggccacctaccacctatgtgtggacactcaagccctgtgttggaactgaagagttgttcaaagtagcctaaagaattaatggatccattttctaggatttacagggatatccttctacctgccaagagctctgcagattctggaggggatgggcttagagaggcagaagaaaaacaaaggggaaattccaagacttctgcgtttttccaaggcaggggcatttcaattgggccctccgcctcctcatattttctggggatcagtatggcagccttgagctgattttcagggatcctgagacagtacaggaactaagaagccctgggcaatttgcagtgtgcacacccagcctgaatttgcctggttctcaccagcctaccaatagagcattgtagtggcagggatgtctgctggtgtctcgcagacaacttttgaggtcctgcttctccagaagtgtgcagctggcaattagcagcctggtcttttcctgtccccaagaccagtgcttccaccaacctggtctcttcccacagcccagccctttctcttcctctttgacacccacttcctctaaatggtggtcacatgctttgtctcttgaaaaaaagttgtatgagtcagggtattttcaacgccgggacagaaaaattgactcaacctggctttttcaattaaccactaatgggtttcacttacagtcctgacaaataccaggcacaattcatccaggacaatagtgaagaatttcatctcttccccccaagccagtcagtctggttttaatatgcacggtggatagcccatagcatgcaatgaactgtgagcacccctctgggagtcagcagagacacacacacaggcacccataccacacactgtgctttgtatcacttctctctttttgtcttgtcccagctgtggctcttcctggcccacctggccctccaggacagccaggactccccggatccagaaacttggtcagtaccttgtatagtagcaactctacactggatagattcactggctactgtgtcttggtagtgggagggggaggaaagggagaggggagcgggagggaccaggctggaattccttttattttcaaattagaactctgccaggggctgagatgttcttcagttggtagactgttttcctaacatgcaggaggccctatgtttggtctctagcaccacatgaaaccaggcatggtggcacatacttcttgccttaacacttaggaggtggaggcaggaggatcaagaaattcaaagttgtcctcagaacataaaagttagagaccctatgtctaaataaataaagttccatgacaatagaaatgtgctgtttcaccaataatagatagacatttacttccttttcaggtgacttgttccataaagagctacagaaaacaaaatgactcgttgacgtagcctatgagcctttaattgactaaaactcaactgtggtctatttttaaaaacagcacacacacatatgtaaacagcatacacacacatatgtaaacagcacacacatgtgtaaacagcacacacatgtgtaaacagcatgcacacacatgtgtaaacagcatgcacaggtgctttgctggccacactcctcctgggttgttcagctagagcatggcccaggtgaattcactgtctcacagtgcagtgcaaggggtatggcttgcctgactgttagctatgctcagagagacagataaatgcccaccagacctacaaccaatccaagaccaaatgccagcagtcctaggaacctctttgctggttactgggtttcattcttaaaaagattgcctttcaaaagagaactgtccagcagacaagatttggctatttgggggatgggggtggggaattcctatgccattttgatgaatattattattgtcaagctgagataattttttcttttttcttttttaatatatttccctcagttacaatgagactttcggctggtagtttcttgagacttggtgctattcagaattttttttttgcagcttcagcttcctgaatctgctcctagatatgctaagtggctgccattcttattttaggcaactttttgagacagagatgccgcaagcccccgtttttttaaacacatatttaatattgcagccatccagctagactaaagactaagtgctaagtataattgcccacttgcttgcatttcttatcccaaatgaaaatgaatttgaaagtcactaaggcatgtgagctgacgccattagccagcgtagctgctgccgagctgtgtttaaaatcaacacaagtggcaaaagaaagcagcgtattgatgattttgctaaaaccaaaacccagcaaagacaactctgttgctacatctttatcttcacaggaaattatcatttgtgtttttattcattttttttataatttagatttgtggttcaaagcaatgcatgttttcatttcatggaagaactcccttagccaagcatgatagcatactcctaaagtcccaacactctggcagccgatgtagacggattatgagttcaaggcatgtcctggctacatagtgaaaacttgcctcaaagcttaggggataaggagacagatcaggggataaagtgcctggcacacaggcatggaaatcccagtcagaccccagtatccactttaaaaaataaaaagctatgtgtagttgcacactatagttgtaactgtagtgatagaggagtgggaacagagccannnnnnnnnnnnnnnnnnnntccattgaggtacaagtaaccctggcatgatgcttaaatagctggacattgctaataagtaaagtttggttttagtgttttggtgcagacccagagcctgtgcatcactcacacacatacatacactcaaactcacactcatactcacacattcatacacacagatacacacactcatactcacgctcacattcattcacacacatacacacactcaaactcacacacactcacacacacactcatactcacacattcatgcacacacgtacacacacattcatacacacctacacacactcacacatacacactcacacatacataggctcatacataaacacacacacactcacatacatgcacacatacacacatactcactcacacacctacacatgcagagagagagggagagagaacagccagggtctgatgatgtagctcagtggtagagcacttgcctagcgtgcacaggctctgggtctgcaccgaaacactaaaaccaaactttacttattagcaatgtccagctatttaagcatcatgccagggttacttgtacctcaatggactctggagaagagattgaatgcgtattcatgcttttaaagcatcattgtctgatgcaacagacctttttcttgagtgagggattatttatatagaagggtgggtgtatcacatttggccaccgtttgataacagtttggatttttaaatgatctgacaggtcacagcgctcagcgacatgggtgacatgctacagaaagctcacttggtcatagaagggacattcatctacttgagagacagtggggagtttttcatttcgtgtccgagatggttggaaaaagttacaggtaattcttaaccttccttacagccctctcccctccaaataccctccaacacaaagagcctccgccccaacagtgccagttcttacgagccctttcattggcatatcctccttctcttgcagttgggagaactgatccccattcctgctgatagccccccaccaccagcactttccagcaatgtgagtagctctcctgcccactccctgagcttcctgcccccttagagggccctgcaccaagctacctaagcctgttctgtgtgacttagtacttgggggaaactcagtaatttctaactaggacactgtcaccacagagtggagagagcctgacactggagacctctgttcccaatttacccacatcatgtagaagagtccctccttccctccctccctccttgcctcccttcctccttcacttacatattttgagacaagatctcactagtagttctggccagcctggattcacctgctgctgcctcctgaacgctagggttaaaggtgtgttgcccccacacctgccaggcaaacccttaacttttattcactgctataaatgagcataaacaattggcataatccgctgttggattttattgcaaccctttgaggccacaaccatcaccccatttttcagattccaaaactgaacctttgaagaggaagaaatgttggcttttaagcttcctcagcacagggatcttagagatcttgaggacacttcctcctttgctggtgactttttgtttggctgtaaaaggcctcccatgtaagggtcacagttaaaggcaatgtccagctatttaagcatcatgccagggttacttgtacctcaatggactctggagaagagattgaatgcgtattcatgctttaacctttacctttcatgtcacagccgtatcagccacaacctccactgaaccccattttaagtgccaactatgagaggcctgttgtaagtacaagtcatacatttcctttacagataatgagagtgtgcctgtaagtgctaagccctgtgttcggtatctagttttttattttgttttgtttatttcatgtatgagtggttttgcctacgtggttgtatgtgcaccatgtgtgtgtctctgatgcctgtggagatcagaagaggaaattatatgtcttctaactggaattataaacaactgtgaaccaccatgtgagtgctaggaatccagtcctagtcctttgctagagaagccagtgctcttaactgatcaataattcttaccacccaacggcttacaaactagccaggagggcacacacccaaaatagacagttgtatcacggtgtgctaagctattgagtgagaccaacccaagatggtggggttaccagaaagacaaaggaagtcactctgaaggaggtgaactctagattcagacctaaagaacactggagttcaggagtgagccaggcagggacaaacaaaagtaggaaatccaggcagagggaaagatggatcatgggagggtgggatgcgtgtgcacacgggtccttcctgtgctgcacttcaaactgaccagaggagtagacttcacagcaaaggtagacgattaggctgtagaagtgaacaagagccggagttagggagttttcccctttcctgcaggcgatgggagctgcccataagttgaaagctgagcaagggtatgtggtaagatggtgctttgaaatgacttcggtttgagtgtgtaagaggattggaaagggcagaagctggggtacaaagcagtaagctgcagaagagggctggtcagagagacacaaagggacaggagaagccagtttggttctggctgcgatgggaatgagtgagacagaggtgaccccaaattcccactggggtgatccagtggtcacaagctcccaaccaggcgtcatctgacatgaaggggttgcagactcagccctgctctatctctgctgtaaataaagatcgtattcctgtcactccagggacttcatagaatttgatcactcgaagtacagtcagcctgggaactctcttttctgctctcagtcattttgctatttccatacacccccttgtataagactttctcttcctgtccctatctagcccttgcctctgcaggcatggtacacatgagcttgcacacagctcagggttgtcccagcactatctcatgccctaactcccttaccttgtggctgaaaagaccaatctgcctaagtcagttcagagtcttgggagaagcactccccatggtctatcttagatcaactactcatttccacaccaataaagaacagcccagagatagagtcaaaggcataaggccttcagagagcaaggcataagccacgccgcacagaaacgtgccttctgcagtgctgccgtgtccagagaagatctcaggttcagcagagcaagtctgaagtggtcccaggacattcaaataaaagtgggagtgagagagagagagcactagagatgtctgaaacccgcctggagaccttcagcagtgcagtgggcattgtaatgggaatggggagtcccaaaaagaagctgtacagagagaaccaaagagaggctgatgggagaaacccagaggcaaatgagaagctttgccctcctaagacaaagaaaaaaggccaaagtactcaggagtcaatggctgctggggggacaaaaatgactgaaaggcagatttataagagagagcaaagtgtttatgaaggcaaaatgattctaggaagctaaggagaaaattctcagggggagagagagagaggtaatttgggtaaacttttaatgagcccaagaagaagtcagtaaagtgaccaatggagttttaaagcaatgaattggtttttactttttaaatacatctatttgtgtgtgagatgcatgtgaatctctgtctctctctgtctctctctgtctctgtctctgtctctctctgtctctgtctctctctctgtctccctgtctctgtctctgtctctgtctctctgtctctctctgtgtgtgtgtgtgtgtgtgtgtgtgtgtgtgtgtgtgtgtnnnnnnnnnnnnnnnnnnnnaggaaatgggtgcctatgtgcaagccaaaccaaattccctaatggctttggtttggggctgatgaacaaggtgttaggaatgggaggcaggacaaagccaccctagaagccacgcttgtgaccaggctgggagcatatccagatttctcaagcatggcctgcacactagaatcagatctccaaaggactcctcaatccgaggagaatgtctcatgcatcttttattaaatctaagaaagacattctcaccccaacgtctgttcacgggtgctaaggctgtcttcactgagggtggacagctgcacctgggtcacaccttacagtcgaagtgggcctcttcctcagaacaggaagaggagggtggggctgctaaccaccctgtcttactctttgcagctgcacctggttgctctgaacacaccggtggctggggacatccgagctgatttccagtgcttccagcaggccagggctgcaggcctcctgtccactttccgagcctttctgtcttcacacctgcaggatctctccacagtcgtgcggaaggcagagaggttcggccttccaattgtgaatctcaaggtaaagctgaacaccttcgccactgacgtcaggcacatcaatccccaagtggcccaagcacttgccacttcaatcactgtcctcgctgagctgaggactccagaagtagtagctgggtcacactatgaagagggagccaaaccctaaatgtgtcatttgtctttgtagggccaagtgctttttaacaattgggactcgatattttctggtgatggaggtcaattcaatacacacattccaatctactcctttgacggtcgggatgtgatgactgatccttcctggtaagtgcaggcttgggccctgtgacgtagcacaagaggcgtttctaggacatgttctaacaatgagctacctccctggaacactgccagtgtgaagccacagtaaggcagctgagtcacgggaaagccatggccttggagccagaagcctcgggtctagtagctcatgataagacctgggcaaagcacttcactccatgagccacagtggccttgcctgtcaaatgagtacagtcattggtacaccacaggacagttgtgcatatgactgtgggtgaaaacacagtgatactcagtgcctgtgctacaacacatctgaatgcaggtctgaaaggcacagtaggcccccacggccctacgctttaagggctcccggtgtcgaggggcaatagataagagactgtgtataaatgtggacagttttgtagttttaaaatagaaagctgataaaaggaacagaggggaggatttcatttttgagggcaagaatgaaaaggagattcctgaaagagggggcccctaagatgtgaaggagtcccaagtctgaccatgagagaggctacccaacaagtgagctcaggagcaatggtccagatgtgtgaaacctaaggatgccattgggagatcgctgcaagtgggtatggctgccaacatactctgtctagagtatgtctagaaagcaggtaacagccacaaggcacgggagaggacttggcattgaactgtgggtgaggaggaacatgtctctccctttgctacactaatgctaacttcctcaccaagatataccacaaagaactgctatttaggaactagggtgatggctcagcgggccaagggcttgcagcacaagcacggcaacctgagctcaggtctccatcacttatctcatagccaggtggggcagcacgcttcagccacgccagcactgagtggcagaaattggtaggtccttggtgtttggtggccatcagatctaactaaattggcaagctctaggttcagtgagagactgtgcttcaaaaaatagagtagggaatgattgaggaagacatgcagtgttgaactctgaaacacacacacacacacacacacacaaactgtaaaataaaataaaaagaaatgaagaacttcctgttattaaaaaaatgccatttaaaaagtaacactataaaattcctttctaggccccagaaggtggtctggcacggctccaacccccatggtgtccgtcttgtggacaagtactgtgaagcctggcgaaccacggacatggcagtaaccggatttgcctccccactgagcacagggaagattctggaccagaaagcttacagctgtgctaacaggctaatcgtgctgtgcatcgaaaacagtttcatgacagacactaggaagtgataaccttcccatgattcttaagagagtgttctaagatatttcttatgtgaagagttgacactgaagtctaaaatgttgtaaatattacaagtttggtttttatatatattacacatctgtcaaaagagaaaccaaagaaaacatacctcagtatactcaaaaggaaagacagaaaggactcagatccaagtcaaatccaatccacatattggtgctagattctgcaggaagacccccccgcgccccccacccccaccccccgcagtgtgaacacattccctgacacagagtaggacagtctgaaaacaggccagcatgattccccagtgcattcttcagaaagcgatttcttccttgcaaccatggctgttgagtgtaaaatgtgctttgtgtttgcttacaacatcagcttttagacacacaggcccttcctaagtcacgagtgatccaggcgcttggtgactccacgcacgcgcacacagccagggaaagggatccgctcagacgatcccgctcatgtttcctccggctttggtgtggtccccactaaaatagtattgccatcatgctgtagagttctgcgtgtttacccagtcatagctgagcgtggcatctgttgatgtaattctgacttgctgggaagttaaaactctaggagagaaacagcacagaatccttccctccccctctctactgtcccttcccattcccccgccccggtcttatgatttccatttggcaagccttgaattacgactgcagctgaaacagattggctgagaggaattttctgaaaagaaaaaaatctctgtatcattgtgctatagactttgatatctttttccatgtaagaacataaagacatcttttccaggtgctttctcctgtttacgtctttccccctgggtccttcattccttggcactgtggcagaagagggctgggtgtgtgtgctaatattgtcactagcactggagacaagaggggtcggggtgaggtagggatgactctgagtgggaggcaagctctgctgtggttgcctcagggtctcagtgcatggctttgggctcttctgtctctctcaaggagaacgggatagacacactcagtgaacaggatagacacactctcagtgaacaggatagacactctcagtgaacgggatagactcagtgaacgggatagacacactctcagtgaacgggatagacacactcagtgaacgggatagacacactcagtgaacgggatagacacactcagtgaacgggatagacacactctcagtgaacaggatagacactctcagtgaacgggatagacacactcagtgaacgggatagacacactctcagtgaatgggatagacacactcagtgaacgggatagacacactcagtgaacgggatagacacactcagtgaacaggatagacacactcagtatctgcttcactcagtaaaagtttatcatcggtaaacgaggtccccagctctgcaaagtgggtacattctaaacctctactttacaaatgaagaaaaaatgcaagtggaggctcggctccttcctgggtccagtcatgtggctggcacgtgcagggctggcttcaggctcaggcccaaagtcctctcaaggcaccactggatatggatgcctgttggttccatctccactccaagtgcatgattctggaaacatcatcagtaggcaagaagcatgctgagctatttcttcccattcagtggggactggcccagaaagtcatcggagtgactgcatcctcctaagtccttgaagtaggaaggaaattcagaacaaaaccaaaacaatataaaacaaaacaacccagaccgtccacttcaaaatccacagcaggaagagcatagaatctttctaatgagtcagaaacagaaatggctacaggggaaagtcccagtggtagatggctggggacagatccagtgctaagttacaggtggggagttcttggcatgggcacagtggcacgaggaagaggacaggagggtgctgagtcaggaagtatagatgtcacccacaccagtcagagcccaccagaacagagaccatagaaaggacacggtggagcagagctgagggaagccaggaagagagatgcccacttctcctgaccctaggagagggtggtgagactttccccctctgcatgccctggaggacctacgttcacagacaagagtcaactacagctacgtgcactctgaccaatcattccaatcctgtgcttggcattcaagagacttcactgagtgtttgccttgctaatctttcctgtcccatgccaaaatctacctgtctggtctttcacagggtctcttaggcaaaccacatagactcttctgatgggccacgtcatgtcctgtaccatcttagcaaagccttaatcattgtctcttccttcccacaacactgctgtgacatcccctaggctgacatacctggtgtcatacccctctcactggctacctggcatacttcacacctgaaatataacactcagctagctaaaacatagtggctgaagggtctccaagccttcactacgcattggcctggacgacttgggggtactagaaggctgttaagccaaccctcacccaggccaaacacaggaaggaatatgtaggtatgtatggctataacctctataagctggagggctttgagggtgctctgtgtctgtatcaaagaccttcaggtcttaagcttgtggcttcaaccttcctggatcttccatccagcaatataaccagagcaagagaaacggctgccaacccacgtaggagagggggccgatcttatgaggacaacagcttgggaagaacagaatagcaaatgagcggagcagctcagggggtgggaaggtaggggtggggatggcggtgggagggtgtgcgggtatgggtggggatgtggggtggtggtggtggtggggaagagttctggtgtgactccatgatatggcctgaaacagacctggtaagatgaaaaaactgggtcacaggaactaccctcaggtctccagtgtcctctggatcccttggctgagggctgtcatctgtacgtgaacaggatagaagcagaattgtgggaactgtcaacagcctagtatcgtggctgagtattagttaaggttcagaaaaataaagagtaaaaataaaaagaggaatgagtttgttcatgagaacaagaagtgggacaggagtacagacttaatgtggtaatgtcacacttgggttaaggtcatcttcccatctggctgtctggctggcaggctgacttctgcttttctctgtgtatgtctccttcctttcaaccaaagacaagctgccttcgtgggtcagggtgcagacagcttcagacctgcattgctctctgttaaccaagagctcacacccacagagggaaggggaggcttcctctccccatgggggttacgtcagttcctaaaaatgaccaccactggcctcacttgagttgtgtgtccagtgtccagggctgtgatgggcagcctcaccagagaggagacttgcaggagaaaacaaaacttcctccatccaaaatgcctaaggtctctgaaatgaccagaacactgaaaagattaaaacacagattcatcctggccagcaagagggatgggatggtgtgggcaggcaggcagaagtgagctcacgtcagcttggagttctacagtaaagcatctaaactttatcttacaatgaatgggcaggcacatcgggaagatctgaagcgctggatgggattggctctgggttggttagtttgctcattcactcagaagtctctgggatactcatcttttttctcctgatcatgtttcattgtggagacacaaacataaataaatggtggctcctttttcaagtccaccaaccccttccatttttttttaaatcatttttaagtttcctttctccaactcctttcatgaccccttccaattcctggcctcctcctctttaactgttatcctgtgcataaatatataaatacaacctgaccaagacaactctaaatgccacagactgttctgaattccatgcacatccctcggcactcaggaactctccagtcaagacaaatgcattgtcccagtctcccttaacctagtagcaagagagagacttttccagctgcttctgagctcctgagtcaccaggaaagcactgagtctcttcaaagccttttctagccagtaataggtttccctgtcttgacttctgtcgggtcctctaattcgtgtggcagtcaaatgctggagagttctttgcctctgaattttggctctgccgcttgctgtccacgtcatcactggcgagttttccaagtcaagctgagcatcatccctgcatttaatccttccctgcaactaactcagtgttttcctttgacaaatagggaatcactgaaagtgctcctcattggatgagcttacttgtagtgttggaagtgatgttttagcacttcggtgtgcctgccattcttcgcctggccaggtgtaaccaggaggagccgagctttcttccccatgctgtgctagatgctatctcccaatccacatagcttttccagccatcttcaagcccaggactgattccccatgtcctccctggtacaaccctgactgttgctagtgagtatccgctttccccacatactctggctgccctgctttccactcctttttccaaactctggcaactaaaatgctttttatcatcttacttagtaagagctcagtcctgagactaggggtagatccctttgggttagcagggacacagtgtgaagtagacttcctatctcctgcatgagcctggccagtgtgccgagttctaaaaaggacccagaactctggtataaagaaacttcttttttcttcttttaggcttgctctccctctcagtgaatgacacaaccatctaacagggcctgaatggctgattatttagtcattcactcaagaaatatttgtgttatttttacgtggtgcaaaaacaattgtatatacatttgatgtgtttgtagtgtgtgtgacatgagtagagcgagggtcagatcagggtgatgacattcacatctcctcagacactcactatctctttgtgttgcaaatgttcacacttctctttgctagctatttcgttcagcaattattgattgactgtcccatcagcagttataacatccagaaacactaagtgtttggaacttcaatgttatttatggcttaagtccaaaaagttcccccacaggctcaagatctaaatgcttggtccccagcctgtggcactgtttttgaaggttgtggaacctttaggaggtggggcctggctggctgaaggaggtcactggagggttggcctttgaaggttatgtctgcccatgagccatgtgaacagcctctgcctcaagctcctgctgccacagatggagcgtttctaaccaccatgcttctataccaccatgggctgaaacttctctctaagagtgtgagtcaaaataagggaacggaagacagatgttccctttcagcaacaaggagaatgacatggacagtgtgtagcaacttaagtgaccgccatctggactttttaaaaagatttatttaatttttggttctttatatgtgcatttatctctctgtgtttgggtgtagggcaagcgggtcatgccaccagacaggagaactgataaggctgagtgaactcagaccccgggaatctcagagacttgagatcagcaggagtcaattccctccttatctatttctgttcctgctctggaacacataactccaataccccactgaaaggaccatggcaatcagtcatagagcgtaaacacctagagttctccatgctaataaggttatctaaactccgccccgccccgccccctgctccacccccgccctagagttcagtcaatgagcttcccttcctgggcattccttcgtgcaaaaggtatttaatccctgttcaccctgagtaaaatgtatgcattcacattcatcatctaataaagcagtttaatcaagcaagggccgtctcttcatcaaggatctatatgggaaggccttcatcttaaagagtcacacctaaatctacccggaaggccttctcctctagcccctctgcgctcatcgggaatcagactggttctgcactcttgtcccaggctctgtcttccctttcctgctcaatatgtgaatgccctaagagaagtgtggactgaggacaccagctcctgactcccagaggttggcccggggaacacaggcgaccaggaaccacagcattcatcccagcccccactgtttctccttccagtcctgccaaggaaaccatggaatgtgggcctcctgtttcggacttccttctcccagtggtatgccagcaacattctgggcaccccagggcacagttagacatatgggcatgtgtatgcaaacatccacaaaggccagaagagtgttggatgtcccaagctgtaattacaggcagttaagatcttcccaatgtgggttctgggatgtaaactctagccctctgaaaaagctgcaagcattcttaagcctatagccatttctccagtccctcttgttgacttttaagtgtttaaagtaccaggaatagtgcttccccaaaccatttatggaactagacaggggaagaagggcagggcatgaagtacagccagctagtaagtacagtggtagctggctcccagtgtcctctcaggagctctgggacctgtcttctggaacctcagattttccaccagagtaagggcgctgtggtatttatatatttgtggattcggttttaaatgactgcagccatcttgagtcatagccaccatggttgcccctagtaattctagtcggattattcctgcatagctttccagcaaacgataatgaatggctccacaccaaccatatatggagctttacaacagaaccattcatgtttccagagatattcctgactcttccacagatctgaagaaaacccaggcacatcccatttcaccctggatgaagtcaacttaatcctcacccaccaatctacactctttctgacccagattttgaggacccagctgatcgtgctgcctgcgaggaccacattttcatcattgacataatggttaatcaattgtcctcttcgatcctccagctgtttgcctcttttccctcagtctcggcacactgggaccagtcttagaacaccagggctaagctattccagaagcacagaccaattctaataggttcctgaaaagtgggtgggcaggggtggagttagggcaccatgtcgaactccagctggccgcccataagcagactgggctctgaaggacagagcaggctctcagggcaagaagcgccattacaggaatggagaggcctatgcgtgctgcatgagggctgcactgtatcatgtgcagtttgacaggaaaccactcaggtttgatttcaagataacaacttgagcttataacaacttcttagaacctcattgagatgagaagaccgaagcggagaaagggatggtggagggggaagaacgggaagatgtggtagaggaggaagtagtgaaggaagaagaaaaggaggagggggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaagtcactggtagaaagggaagcaccccatgagccagaactgtgactgatcactgggaagcatgaacctggtacgactggatagctgataaccacagcaaagaccaggcctgggccccacttgttctccgactgctggtccgtgcaagcaggggattgctgaggaagaggtgggggctcacagacatctgtaccacaggccacagcctcagcagatctgctgatgctctatctctagactttcatgttcatgaacagcagcggcagcaatcatgtcactcacctgaggcgtcctggtggctcccaagcgggaacgagcacatgggttagaaccaatggcttctatttaaaaaggatgcgtataacaaaaaaggagacaacttggtaaattcagatttgtaattctcagtgaaattttagaggataataaattagataaatttgggaggatcagcaacagtccttggagataaaataaggtaccactgaggtggctcaatgaggaaaactgtggctgagctggcctggtgacctgagcttcatctccagctccatggtagaaggaaagaaccaactgtagaaagttgtcctctgacctacacacacacacacacacacacacacacagataaagagatacacacatacatacatgcaagcacatacatacacagaacaagcatacacacagagacacacatgtagacacagacacatgcacaggcacacacatagatgtatgcattcacatacatacatggagcatgcacacacagaaacagaaacacacagaaacacatgtagacacagacacacagacacagactacatgcacacagataaatacacatgcatacatggaaatgcgcatacacacacggaggtggggcatggatttcaaaattgcaatatctaggtactcaacctgtggaaaaatcttttgaaaaattataaccaaatgaaaatcgatagagaattgagatctcacacagtagagagcaaggaaccataatagaaatctaatgagaagaaagtcacactataaattctagctatgttccaactggtggtttctaatgtgtaatatgcgtatgccatctgaattaaggtggcatttactttattattctgacatgttaaaaaaaaaggtgtctgtagatatccaactcataatttcacatttattttcatttaatatgaaactaaaatgaatccatgaaaaagttatagcgtgtttgttgatcttaggcaactaatggcacaggccgttatgatgttagggtgtgtggtatgaggctccatgttgttagaatgtatgtggttagggtctatattgttgccatggtaaatgtgcttctgcttcttgacatggaaaacatgccagcaaggatgtcttgaggtggtattctagcagcaggagttaagtagaaccacgtatcacaatggtggctgcagctggactaaggggcaaaggctaacatgggcagagtttactacaacctctcagcaggccacgcccagccttgtcatcagggctccaggcaccattttgttctgtccagtaattcctcctgatctatgggtgttgttttctgtgatttccattatccatggtcacccaccattcagaaatattaaatagaaaatggcagtttaaagaattcataagttttacactgtgcatcattcttcacaccatagctatcctccttgggctggttgcttttaacagtcaacttaagacattctaggatcactggagaattgtattggtgaggaactgtctagaccagattggtgtgttgtagttgtatctgtgggaacttctatcttccttccttccttcctcccttcctcccttcctcccttccttcctcnnnnnnnnnnnnnnnnnnnnnnnnnnnnnnnnnnnnnnnnnnnnnnnnnnnnnnnnnnnnnnnntctctctctctctctttctctctttctttctttctttctttctttctttctttctttctttctttctttcttcctttctcctgtatgtatgtattatatatatgtgtgtgtgtgtgtgtatgtatttcatatgtatgtatatatatcttagatctccatctctatatctatctctaatgtgtattaattgtcttgcctgtatatatatgtgtgtactatgtacatgcccggtgcccttggaggtccgaagacattgtcaggtccctgaaactgaagacaagatgagtgctgagaaccaaacccaggacctctactaacacaacaagtgcccttacctgctaggccatctctgaggccccatttccttagtggcattaactgagaccagaagccccgccccaaatgtgggttgcatcttttcatgagctgagccctgaactgtatgagtggaaaaagtgaggtacacgtgcaaggatttcccccctg

SEQ ID NO: 1454 - DNA, 4077 bp, Mus musculus
agcgcgggtgactcaggcgcgggcagcagcggggatcccgccgtcgccaccgagcgcagcctttgttccgcgggcgaagtacagctggggtccggcggctgcaccatgacacacaggaggaccgcgcagggccggcgcccgaggtggctgctctccatcatctccgcgctgctctccgctgtcctgcagacccgcgctgcgacagggtcagcctctcaggttcacctggacctcacagtgctcattggtgtcccattaccctcgtctgtgtcctttaccaccggctatggcggtttcccggcttacagctttgggcctggtgccaacgttggccgcccagccaggaccctcatcccaccgaccttcttcagggatttcgccattggtgtggcggtgaagcccaatagcgcccaagggggcgtgctcttcgctattaccgatgctttccagaaagtcatctacctgggcctgcggctttcaagtgtggaggatgggcgccagcgggttatcctctactacacggaaccaggctcccacgtgtcccgtgaagctgcggttttctccgtgcccgtgatgaccaacaggtggaatcgttttgctgtgaccgtccagggcgaagaagttgctcttttcatggactgtgaggaacagagccaagtccgtttccagcgatcgtcctggcctttgacctttgagcccagtgccgggatctttgtgggcaatgctggagctatggggctggagagatttacgggttccatacaacagcttaccatctattcagaccccaggacccctgaggagctgtgtgaagcacaagagtcctcggcgtctggagaagccagtgggtttcaggagatggatgaagtcgctgaaatcatggaagctgtcacctacacacaagccccgcctaaagaatcacacgttgatcccataagcgtgccccctacttcatcctctcctgccgaggactcggagctttctgggtctggtgagatcctgaatgatacgctggaggtccatgcgatggatggggaccctggtactgatgatggttcaggggatggagccttgttgaacgtcactgatggtcaggggttatcagcaacagcaactggggaggccagtgtgcctgtcaccactgtcctggaagcagagaatggcagtatgcccactgggagccccaccctggccatgtttacccagagcatcagggaagtggacactccggatccagaaaatctaacaacaacagcatcaggggatggtgaggtgcccaccagcactgatggggacacagaggctgacagctcgcccactggagggccaaccctgaagccaagagaagaggccactctggcttttgaggaggaggaagccagtgggactgccatcgacagcctggatgtcatcttcacacccacggtggtccttgagcaagtcagcaggagacctacagacatccaagccactttcacgcccacagtggtccttgaagaaaccagcggggcccctacagacacccaggacgctctcacacccacagtggcccctgagcaaatgttcactgctgaacccacagatggaggagacttggtggcgtctacagaggaagctgaagaggagggatctggtagcatgccccccagtgggcccccactccccacacccacagtgactcccaagaggcaggtcaccctggtaggagtggaagccgaggggtcaggccctgttgggggcttggatgagggctcaggctctggagacatcgtgggcaatgaggatctgctgagaggtccgccgggtcctccaggcccaccgggatcacctgggatcccagggaaaccaggaactgatgttttcatgggacccccggggtctcctggggaggatggagctcctggtgagccaggaccccagcagagattctgtgaactaattgtcactgatattccccagggccccgagggacagcctggacttgatggagcctctggccagcaaggaatgaaaggagagaagggagcaagagggcctaatggttcggctggcgagaagggtgaccctggaaaccgaggcttaccaggtcccccagggaagaatggagaagttggcacccctggggtcatgggaccaccagggcctcctggaccccctgggcctccaggcccgggatgtaccacagaacttggatttgagattgaaggctctggggacgtccggctgctgagtaaacccacaatctcaggacccacctctccaagtggtcccaaaggagaaaaaggagagcaaggagccaagtctttgatcaacatcaccaatggatccatgaatttctcagacattcctgagctcatgggacctccggtttgtatctgcatctgcccttgggggccagatggtgtacccgggctgccaggatttccaggccccagaggaccaaaaggtgacaccggtgtgcctggattcccagggctaaaaggagaacagggtgagaagggagagcctggagccatcttgactggggacgtccctctggaaatgatgaaggggagaaagggtgaacctggaatccatggtgcaccgggacccatgggacccaaaggaccaccaggacacaaaggagagtttggcctcccaggacgacctggtcgcccaggactgaatggcctcaagggtgccaaaggagatcgaggggtcacgctgcctggtccacctggcctacctggacccccagggcccccagggccccctggagctgtggttaacatcaaaggcgctgtttttccaatacctgcccggccacactgcaaaacaccagtgttaaaggagaaaaggggtcctggggtcttcctggctcaaaaggagaaaagggggaccaaggagctcaaggaccaccagggggagaatgaagatgcttcattcagaggagagtccagcaacaacctctttgtatcagggcctccaggcctaccaggatacccaggcctggttggacagaaaggagaggctgttgtggggcctcagggacccccaggaattccaggcctgcctgggccacctggctttgggagacctggtgttcctggaccaccaggaccccctgggccaccaggacctcctgccattctgggtgcagctgtggctcttcctggcccacctggccctccaggacagccaggactccccggatccagaaacttgttgggagaactgatccccattcctgctgatagccccccaccaccagcactttccagcaatccgtatcagccacaacctccactgaaccccattttaagtgccaactatgagaggcctgttctgcacctggttgctctgaacacaccggtggctggggacatccgagctgatttccagtgcttccagcaggccagggctgcaggcctcctgtccactttccgagcctttctgtcttcacacctgcaggatctctccacagtcgtgcggaaggcagagaggttcggccttccaattgtgaatctcaagggccaagtgctttttaacaattgggactcgatattttctggtgatggaggtcaattcaatacacacattccaatctactcctttgacggtcgggatgtgatgactgatccttcctggccccagaaggtggtctggcacggctccaacccccatggtgtccgtcttgtggacaagtactgtgaagcctggcgaaccacggacatggcagtaaccggatttgcctccccactgagcacagggaagattctggaccagaaagcttacagctgtgctaacaggctaatcgtgctgtgcatcgaaaacagtttcatgacagacactaggaagtgataaccttcccatgattcttaagagagtgttctaagatatttcttatgtgaagagttgacactgaagtctaaaatgttgtaaatattacaagtttggtttttatatatattacacatctgtcaaaagagaaaccaaagaaaacatacctcagtatactcaaaaggaaagacagaaaggactcagatccaagtcaaatccaatccacatattggtgctagattctgcaggaagaccccc

SEQ ID NO: 1455 - protein, 1279 aa, Mus musculus
SAGDSGAGSSGDPAVATERSLCSAGEVQLGSGGCTMTHRRTAQGRRPRWLLSIISALLSAVLQTRAATGSASQVHLDLTVLIGVPLPSSVSFTTGYGGFPAYSFGPGANVGRPARTLIPPTFFRDFAIGVAVKPNSAQGGVLFAITDAFQKVIYLGLRLSSVEDGRQRVILYYTEPGSHVSREAAVFSVPVMTNRWNRFAVTVQGEEVALFMDCEEQSQVRFQRSSWPLTFEPSAGIFVGNAGAMGLERFTGSIQQLTIYSDPRTPEELCEAQESSASGEASGFQEMDEVAEIMEAVTYTQAPPKESHVDPISVPPTSSSPAEDSELSGSGEILNDTLEVHAMDGDPGTDDGSGDGALLNVTDGQGLSATATGEASVPVTTVLEAENGSMPTGSPTLAMFTQSIREVDTPDPENLTTTASGDGEVPTSTDGDTEADSSPTGGPTLKPREEATLAFEEEEASGTAIDSLDVIFTPTVVLEQVSRRPTDIQATFTPTVVLEETSGAPTDTQDALTPTVAPEQMFTAEPTDGGDLVASTEEAEEEGSGSMPPSGPPLPTPTVTPKRQVTLVGVEAEGSGPVGGLDEGSGSGDIVGNEDLLRGPPGPPGPPGSPGIPGKPGTDVFMGPPGSPGEDGAPGEPGPQQRFCELIVTDIPQGPEGQPGLDGASGQQGMKGEKGARGPNGSAGEKGDPGNRGLPGPPGKNGEVGTPGVMGPPGPPGPPGPPGPGCTTELGFEIEGSGDVRLLSKPTISGPTSPSGPKGEKGEQGAKSLINITNGSMNFSDIPELMGPPVCICICPWGPDGVPGLPGFPGPRGPKGDTGVPGFPGLKGEQGEKGEPGAILTGDVPLEMMKGRKGEPGIHGAPGPMGPKGPPGHKGEFGLPGRPGRPGLNGLKGAKGDRGVTLPGPPGLPGPPGPPGPPGAVVNIKGAVFPIPARPHCKTPVLKEKRGPGVFLAQKEKRGTKELKDHQGENEDASFRGESSNNLFVSGPPGLPGYPGLVGQKGEAVVGPQGPPGIPGLPGPPGFGRPGVPGPPGPPGPPGPPAILGAAVALPGPPGPPGQPGLPGSRNLLGELIPIPADSPPPPALSSNPYQPQPPLNPILSANYERPVLHLVALNTPVAGDIRADFQCFQQARAAGLLSTFRAFLSSHLQDLSTVVRKAERFGLPIVNLKGQVLFNNWDSIFSGDGGQFNTHIPIYSFDGRDVMTDPSWPQKVVWHGSNPHGVRLVDKYCEAWRTTDMAVTGFASPLSTGKILDQKAYSCANRLIVLCIENSFMTDTRK

SEQ ID NO: 1456 - DNA, 116704 bp, Homo sapiens
ctcaagtgatctgcccaccttgacctcccaaagtgctgggattacaggtgtaagccaacgtgcctggcctagatctgatattctatgactgtatatctgggccttttatttgtattagacagatatttgtattatttaatgctaataaacattattatttattattatttaatttattattatttaataaatttattattttattattaattaaaaataattggcctcttattaaaaataaatggcctctattatttaaaataataataaaataataaaattattattaaataataataaaataataaatttattattaaataataataaaattaaaaaatgtttagtgacatgttaaatgccagagtcatttaatttcacacattcaacaattttctatcgttattactattttttaattcatgaaacttgaggcacagagactgagccatttgctgtgttgcccaggctggttctgaactcctgggctcaagtgatcctcccatctcggcctcccatcacttattttctttttttctttttctttcttttttttttttttttgagatggagtcttgctctatcgcccaggagggagtgcagtggtgcgatctaggctcactgcaagctccgcctcctggattcacgtcattctcctgcctcagcctcccgagtagctgggactacaggcgcccgccaccactccaggctaatttttttgtatttttagtagagacggggtttcaccgtgttagccaggatggtcttgatctcctgacctcgtgatctgcccgcctcgtcctcccaaagtgctgagattataggcgtgagccaccgcacccggccccatcacttattttctaagaagaggggtacagctccagctggtaaagaacagtctctggatttaaacccctgttgtctgattttggatactttatattgctcatttgtcagatgttggatggggacttctttgtcccttgggaatggcctctatctccccctattctgtggtttttggaagcccacagccattttcaatatttaagcacattcccagaaagcttatcttcttatgttcacctctgatgctgagctcttgtttctaagttctggttataactcatcacagcatcccatgtgtgcaaactttgttctgttctattgaccaagacgttgtattaatgtctcagttgatatccacaaaagtccatttttataaagcattcgtgtgtcgggcaaacttgagtgaaggctgttgtggttgctgggggaagggtcattgcaggagggctttccatttgctggaatgcaaacagctgcaaaccaagcattagacttaggattttgcaaatgttctgggggcacccccatgctggaaatatttcactggctgcttcatcacacagaacttctggcctcacactatcttgatggtgcttatcagctcttgccactctgcctttagctgggtttcccaaaatgcagagcctgaggcaaagacttctgtgccaatttatgaagttcagttccaggaaagagggagggggaaaagaagcagggaagaagtaagagcaaataacaggtcttatatatagatgagtcctcagtcttgtgggacgtttttttgagaagctgctgctcagggtggctgatgtgtgatagggagggagaaatagtcatccactggtttccatctctcattgttcagaagctggccacatattatttccttcgcatttccaagttgcttatgtgtgggcactaaatgaaccctacagcatctcatgtctcaggattaatatagaagtccctaagtatgaggtgagagttatacactttgtgcaaaaatgaaggcactgccagttttacccgtaattgattggagtccctggtgagttgatctctgcagcaatggctgtggctggaatgaatgaccacttggaggcaggaaattcagagaatttgaaatggtgcattagagatgtgtggcgtagtttactccctgcactgcttaggtttgccttcccaatagatctagctcctatgctatcatataggaccttcaattttgaaagaatatgatgttctcacttattttctttgtgtgtgtgtggtggggaggagttgggggcagggtcttgccatgttgcccaggctggttttgaactcctgggctcaagtgatcccatcttggcctcctatcacttattttctaagaagaggggtacgagtccagtcagtcacagaatccctttcaagatcataaccaacttagatctctgagaagattttagccaggagagtgaaacaagccaaagtcccctcagctgtagctagtgccatatccctcctcccccacccagtctgatttcctttattctcagtccatactttggatgatctggcttgctagcctagtgaggtgacctagacctttatcctttaagggtctgacctctcagctgccttgattgcttcatgtgcccatttgctatcattacaggatatgcatgtaccaagaaatacaccaggacattccctggattgtaaatatatcttctctgccccataaagtagctgctactgtggctcccggtggccatcagggctcaatagccccacttatgcagtcactctttttttgcctgcttgcccactggcatgaggagctcaaggtgaccagatagtggtcacaacttcaagttagtggccttattgtatcttttggaggagttctgctgaacactagcacctctaccccaccagagcttagtttcagtggatcactgggagaggaaaaggactgaattccaccactactccttggtttccagacccaagtattctagtttttggagacacagcaacatgtattggccattaattcagtgactttcccaaccacattctggaggagagtcctacagctcagcaccaggtggtccctaagctggtgccttagctgagcctttaacaggccttcccaccattgtattaatctagatgtttctggggtatgtgctacatgatcaagtcaatggagtccttgatcattcactcattgtcacactgcttttaccataaaatgagtcccttcatttgaagcaatgttgtgcagacaacatgccgataaatccaacattctgcaagtctttggatggcagtgctggcaaaggaacttggtcagggagggcaaacccatttccatttgggtactgatgctgaagaggaaaacatactcaggacagggtctgaggggatcaacttatcaccaaagggttggctggcctctcggaggactggtgccatattgagggctccgtgtcagtcttttcagctggcaggctgggcattcatcaatgtcagcagctatatctgctttagagggatggggcccatgcttctgggcctgtgcttagcatttacccctgccatcattgtcactgtttaaggcttctccgtgtcagctccttgatagtcaaggagagagactggctgacatccacaggatcagtcaccctgtcacctggctgttgaattatctcctctgtggtggatggtttctcgtgagcattgagatacaaagaccaacacgtgtgctcatttctgtaggtcaatctacattatgcttccctagatctcctggtcccagatcatccaatcttgtctttcaggcctctggccaacatcgaagtcatttgcccactgctcaggcatctacatacatcataatactatactacttctctctctttcaaagagtttgaccaagtgccccactcatagttctaccccctgggaggagttctcttcaccgttatcctttgcggccacccttgagaaggctgcaatgcagcaacagctcatttcaactagcactgacatatcacacaggctcatgtgtgaagcaacctgggttctttccttaactgattactggttgtaggaaaccacccatgaagccctaagtgtgaactcaagaaggggtgttggtgcaaagcagtaagtgacctgggagtctgggctacctgttcacataatttactcgtgctgtctagacctttttaggcctgatctcaaatatataattggcatagatagtcttagcttctggcagaacccttacattagcaacttgacttgtagagtctggtaggaaaagtcaagtggaagtccttgaaactacaccctttcctccacttcaaggcagtagatcagaagcaaaatcacctctcagaaagtattgcaggggttagaacccctatcatgacttaaatgatgcagggtatggtagatcccattacatttcaattaattagcttgtataggcccctgcgaaagccaaatctattatcagatgatagtggatttccaaaaatcagatgatagtggatttccataaacttggccagatggtagcatccattgcagctgccatgccaaatacggtatctttactggaatataccaacatagcctttggtgtgtgggatgcagagtgacctggcaaagtggaatcacaaggaagataaaaaccagttcacttttacatggcagatacagtagtatatattcactgttttgccccaggagtatcataacagctctttgttataatatagtccataaggaccttgtcattccaacatgccatggactatcctgctggtcccttatactggtgacatcatgctgactgaagatagtgagcaggaagggacaattgccttagatactctgttaagatgcatgaataggtcagaagctgagagataagctccatcacctgtctcatcctgggttattcagatagtagcatctgaggctaagtcttgtgtgcctctatggcattagggagtgtgatcttagagagcagaagtgaaaaggaaagggaggcgaggtaggaggaagagcccaataagaggcaatagacatgacggactgctctgcaagcattgtgtgaccatcttctgagatgccttataaattactttcttggcacagtgcatctggaagaggaagggagaaaaatacatctactggcttccattggctgaaattttgccccacagggtgttatttgcactgtacttccaggttgctcattgcaggcactaaggatagtgctgaggatgtcatgccttagcatcaacagggaagccctggggtggaagtgaaaggtgatcaatgtggacatgaggccaggggctgtgagttgtatctgcctgaagttggtgagagtccaggtagagttggtctccacaaaggggactgctgttagaacaagtggccagagaccctggagacgggtgagactaaaagaatttcaagcagctatcttaatttggattcccgcagcaaaagactcagaggcaaggattccactgccagcagttcacttggtcagttttcttaagaagcactggaaggggagtggggaaatgaggtggccaataaagagtgagtgcacaatacccctgtgggaaaccggagctcagtcctgtggaaactctggatagaagtatagaatgtgtgcctgcctaggtgttcccaccagctgggtaagggggctgagattctcatccaccagctcctgaccatcactgattgagagctgcttggggaaggggttgctccattaatttcccaacacttctggtcttctgtgcttgtgggcagagcaggctccaggggccagagaaagcgctcaggtgaagggatgcaggtgctggcagttggaagacagccaccctgcacataaatgatcaagatggaggggatctggacaggatgttgcagtggcacataaaaggtgtctgatacattctccctcctttttcttttcctcttggattgtcagattttcaaatccatcattttctcttatgttgaaccaatgactcttgtctcagcctgtggcccctctttgcatatccaaacacatcaagatgctcagcagaacaaatgagtcctccttggaaggtagttgtgggcttaaacagtcattattttctcttggttatcccaaaggcagctatctctttagttattctagtaaattctattctagttagctagttaaatctattgcactttttctgcacattaaatcagatgatatgcaagctctaactacctcctgtagacgttctcatcacaactccacaagggaggcattgtacccatgtagtgaataaactgaggtctagaatgacatgcactatattcttggtaacttcttcagaaaccaaagttttagatgatttccacagatttttgtgccccttccagctgcttgagacagtatggagaatgcttttggatattgagttatcagggacattgggtagattatgggaaaatggaacagcctattaatttagtccagttctgtaagagttgggacataagatccccagtcttcacacatcccaatctcacagattacactgaacggtggtaaacaatttagatcagcttgggtatgacacgaagcttcctcttggctatttctacaacttaacattgaatggaaggaaatcacttaagccctaaaaacactgtctggcaggaggtaaaatgtcttgcttggcttcctgccccatccctcccacacccacagctgggaccatttggcccccacttcagctcccaggcctgagaccctccctgttcttcatctgcctgagttcagggacaagctgcaaactgagagcccttcttgaatatgaacatggtctggcttcccaggagaaataggtgcaaaatcaacaaccttaacacgagtctatttccagtcatttgtagatgagaagtgtgctttgggaaacttcatttttagattccagtgaattgggtatcatcagttacagagaaccaacaaaatatgaaatgtgcacataggacttccctgcaagagtagaaaggaatctgttgccttatgcatatgtatcttggactgataaattggatcacaatcaagtcttcacccttcatgttatatatgtaactgaggaggccaggtttgtttcataatggcaccttcatttttatttttttcaatgtacacactttatttgtatattaaacaagtagaaatatgtttttccccatctttctttaaacatgttcttctccccatatatcttctgtttacccatttttaacaggaacatgagcattcaacctattccattttttcttatatgcaaaggcagagtgcaactgtgataggggcaattgattcttagctttggttttggggacaatatggggtggtgggaactacggcaaactggacagtactgccttagctgaaggcagcagcccctattcaatgccaatcaattgttggcacagagaatgcaggccttatgtcgccaggttttccaaaatttcaaaaagaatccagaagtctcaattttactgtgcaattctctaattatcaaatattgctagccaatttaatttggaggttgacacccagcagaccagataaaacatatctatgggcaaaattgaaggctgggcatggtggcttatgcctttaatcccagcactttagaaggctgagatgggtggatcaacttgaggtcaggagtttgagaccagcctggccaacatggtgaaaccccgtctctactaaaaatacaaaaattagccgagtgtggtgatgggcgcctatagtcccagctacttggaaggctgaagaggagaatcacttgaacccgggaggcggaagttgcagtgagccaccattgcactccatcctgggtgacagagcggcactccatcctgggtgacagagcgacactccatctcaaacaaaaacaaaaaccaaaatcaaaaatgaaacaaaattgagcctatggctgccagttcacaatctctggttttaaaactgtcaaacagaaccctagatctactatgtagccataactgatgtggtttttctaagcagtatagaaatatagttctaagaaagtcaattatattcctagttaatgtggtactttacaaacaatagagaaatatagaattatgaaagcaaattccctatggttagtgaatcaaaataaaataaggttaggcccatcacagagtggctgcaagtgggagagaatttacattcacagggaatgtgaacagattaggaaagaggcctcaagtggacaattttgtcgggatgcagttcgccttatgtgttagctccacatgaggccaacctggttctcgagctgctttggctactggagcctcaatcccttaagaggttgatctagggtcccccctctgtcttgccagttgtccccctccacaggccgcagccccgatgagaatatccacaacctctaataatagaagccaaaatccaatggacagagagcactgtggtgtaccagtaggtggtcccatcaagggactcacagccaccattcaattcaaggtagttgtgtccattatccaggtggagaaataaaaaatcagaccaagggcaagatttgcccaacttcaccctgcagccagggccagcattggactggaacccagactcctgatctccaggccaaccatccctcctctgagccctcaccgcccaggctggcatgaaccctttcatatccgagtgctctgtgtctccactgcgattttgctcttgagggtggagagtgagtctaatcttcttgcttactggcaggcagcatggctgagtggggaggagcatgggtgttgcatctgccattcattagccttggaatgttttgaacctcagctttcttatctatgaaatggggatcatgacagtatcacctttccatggctgttgtgggtattaaatgagataacacagctaaagcatttagcagagggcttgggacataatccacaccaagtaagcattagttgcttatatccattcccatgccatctcctctgcaaggctaactcacttggcaagaggtgacccatcctctagagtggaactgaatcaaacacaggaactgaccacagagccacggcccactgtggctacttggtgcttcaggaagagaggtttctagtgtttacctggcttcagagctgtccaggtctcagccaacttcagcggtgcctcttctcactccaagatctcacactatgtgccgggtggtaatcttaataaaaagcgaccattgagggtttacccagtgccctgcgataagctctgcacagatgggttagtctgccctgaaccgcctcactcccactgagggctttcggaggcagagcctggttcatgacccccacatctcatcacagggcctggtgtgatgcctcacccaagactgtgctccttcattcatccagcgtttattggcatctcctactacctgagctgttttaggcagggaacaaagcacagataagccctcctggagcttacattctgatgaagggggcaggcaaggtatacatagggaggaaagccctggaatccagtacattaaaaacttttattaggattatctctgctgcatttagttgtatgtatcccttatggcccccaggcaggtccactcctgggcattcaagtcggtccatgtgtcaggcgtgcagggtgggtcacagcatctaggagctcagtgcagcttgggactttgggacatacgctccacctctctgagcctcagtctccttgtccatcatataaggaaatcactgattccagccttcctgggctgtggagaggattccctcagcggctgtgaaagagtgctttcttgcgggtcagccccgacaggacagacttaagggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggtaagacccgcttctctgcttcctcgcgtcccgggcccctccaatactcttgcccgcctcaccttttctccctcgggcacatcttgcaggaggaacaacgggcagtgctggtgtctgctgatgctgctctcggtctccacgcccctccctgctgtcacccagacccgcggtgcgacaggtaagcaacccggtcggagggtggcaccggctgcctccgcgcccgtgggggaagtcggttttggcggcggacgcggctgcgatgcgtgcctcattcctggacataaaagggagtcttgccactcagtgcgcactggcggtcccgcgggcggctacctcctggcagtgcaggggttatagctgtgaatgggatccctgggcagctggggcggttggagcgttgtctgggcacccgagatgtctgagctgggtgcggagcctccaatcttaggcagagagggacttcagaaacagcgccagcgccagcgccaacagcctcagcgcacccagcgccagcagcttaggttgtgcgtgctggctggcttctggtaagggcaggtctggtgcctctccgcacacaggtgcgaagcatgaacaccgggagggacatctggggcttttgctgctcaagaaataacggaactgaattgctcggttgcttaacccagctctgagttacctaagcggtcacgtctatcatgggcagtggctccaccggtggtggaaagagctgtggcctggaagccagagatctgatcccttccgttccccgggcctcagtttctccagcagaactcaggcggttggctgaatagtaagatataagttaaagtagacctaagttaaaatgggcctcggttaaggtcagactgcctgggtttgaactgtggctggctgagtgatcttgggcaatggatttcatcgctctgtgcctcagtttccccatctgaaaaaggcgattaattagaccattttaccttcctagaaatgttgtgaatattagagaaattagaaataatgtgcttcccatgattccagtatatactaggcacaaaataagtgatagaaattactgcttgattcttgcagtaactatgtgttggaaagcaatgcaagtatttttatttttattttagattcagggagtggtcatgtgtggttttttacaagggtatattgcacggtgctgaggtttgggcttctattaatcccatcgcaatgcaggtatttttataacattgaggttgagagaagcttagaaagtggccagtccaaaagccaggacttgaatccaggtctgtaggctcttgcccttgctcagctctttctccatgcagttttgcagaagagccatgctttctatagcttctgaccccctcccctttgaatttgggggattagtacacatcttcaattgaataagggaacagaaagtctaggaaacaacctctagtcggcccaaaggaaacgggattgagaaggtggccttggttaactctttgtttgcctgaagaagcccaagacagcccattgtctcctgggcaacaagacccaaatccgatgatagcttttcctgccagagtgtccagcctggcatttattgcagatcaaagggcagctggagtatagttttagcttctcagccccatggctcatgtcagaaagttgcaattttgcatatgatatagggccctgccaactcagtggcagaggccaactttgggttccatggtcttttgtgaactttgctgcaacttccagtttcccaaaaggaagatggatctggggataggaactttggtgtttctttctcctcctgtgtgtgtctctgggatccctcagtgtcagggctgttgtttctaacacaaaggaagccctattcccatttataatgtaaaaagggagggccagcaaaccttcaggagctgagaacggtctaaggagggccatttgcaactgatgggttttcagtgcccctttggggatgtgaaacgattcctaaaaatgtaaactatcctcctgcaaactgcatttgtaatgcaatttaatatccctaatacttataaaacactttgtatatccaggtggaggtgtgaacatgttcatatttcattcatccaatccttacaaccactccaggaggtgaggactgagaacagttactatctctgtttttcagatgaagaaacagaggtccaaagtcacaagacttctaagtggctggggtgggatttgaaccagacagtctgactccagagtccttgctcttaaccatcctagtgtgtagttagaagagcttcacggatggagaaggctttaggggttccatggtctccaatgagccccacaatctgaatgtcacaattgtaacatgagtccattgcatggcattgtgcagtcttcaaagcacaatgtcaccttcaccacgtccctggaatcaccacccagcagtgctgagaagtaaattgggctctgtcttacagaggggatgtgacttcctcaaggccgcatgactgtaactgggtagatccataatagccctctcacgtctgtgaacttctgggctggtgctgttccttccataggaccactgcccaactggctataaaaaacaattgccaagacttcatagcactatgaaccagcagtgttttaagtgccctgccatgaatgagctcagtcaatcatcacaacaaccccatgtcttatccccttttacagatgaggaaactgaggcacagtcttttgcccaagggcatgtagccttcagtaatataagcacaatttgagcccagagggtctgactccagaatctgtacttgtaaccactatgctgtatgcttaagtggggtggcttctgaaagcatgtttgtaagtgggctgttatgagcggaaatacatgttcccaacgatttggcagtttcttaaaatgttaaatatatacttaccctacaatctagcacttccactcctaagtatctacttaagggaaaggaaagcatatggccacccaaaaactcatatgtatgttcatagcagcattatttataatgaccaaaactggaaataaagttaaattcaccattagctggtgaatagataaacaaatgaggtgtatccatttaatggaatactactcagcaataaaaaggaatgaagtattgatcaatgctacaacaacatggataaaccttaataccattaagctaagtaaaagaagccagacattaaaaagcaatacattgtaagagtccctatatatgagatttctgtaaaggcagaaccacagagacagaaaacagaagcagagattgactgcaaaggggcatgaggaaactttttggggagtgttctaaaactggattgtggtggtagttgtgcaactctataaatttactaaaataatctaactatacatttaaaatgggtgaattttatggaatgtaagctatgcctcaataaagctgcttcttaaataaaagaatgtattttcccagagcatctaggccccagatctggtggggcttcaaggtggggttcctagccagcctggtacagagctggcacacagctcacaacttaaaagctgctggcctcttagggcattgattctctcagaaaatgggtccagagttctgcctgcacctccaggtctctggatcgactctccctactatccctgaatgccattgtgggcccaggacagggctcctcaggtaggggtagaacacatgcatatgggttttttgcaggtagttgatctgttaaaaagtgggtctttgtaaacttcctgatatcctgcacgccctaaaacagcacaagttcaggtattggaaaacctgggttccactcactgacttcctccatgaacttagatgagttgcttttcccactctgagcctgttttcccatctacgaagtggagaggcaagagtcactcatctctgtagtcctaatttaaaatgttgggaaacaaaacaaaataatatttttctagtttgaggtttgattatttcacatagtttagttcaacaaacccattctgtgctggccctcatgctggctgggtacagaaaggatttgggcacagagctgccccaaaggggtcatagttcacaggaagaaagaaagggccacagacaactgtaatgccatttttcctgaagtcttctcatctaccatgcagaatgtcctgtgtgcagccaatcccatccttctacaccatcctgtttaaagacacacttgtcggccgggcgcggtggctcacacctgtaatcccagcactttgggaggctggggcgggcagatcattaggtcaggagattgagaccatcctagctaacacggtgaaaccctgtctctactaaaaatacaaaaaattagccaggcatggtggcgggcgcctgtagtcccagctacttgggaggctgaggcaggagaatagcttgaacctgggaggcggaggttgcagtgagccaagatcgcgccactgcactccagcctggcaacagagggagactctgtctcaaaaaaaaaaaaaaaaaaaaagagacacttgtcagtgggtgtcacccacatggcctcttgtacctccaatggtcagggttgagctggaggacaacaccaatccttccttttcctggtaaagtttcagggtcattggaatacccaatattttagaagataagggggctattgtccaggtagggatggtggtgtcacaagtaatttgctcttgctaataaagtgttgatgattgcaaattatttgcttatgtttaaactgttttattgtgaaatacaacatccattcagaaaagtgcatgctaaaggtacagtacaatcttgtatcacagagcaaacatgtaatccagatgaagatataggataatccccagaaggtctcctaaacccctttgctgtggttttattttcccttctttctctctgaggtaaccattaccttgacattaacagtcatccctttcttgctttttaaaaatagctttactatctaagtgtgtatcccaaaattctgaagttctgttttactcgattttgaactttttaaatgcagaatctattctttcatgtctgattctttcaatgaataataagtttttgagatttattcatgctgctgtatgtggctgtagttcattgccattgctgtataatagtccattgcattagcatagcatatgttacttatccattcttctccaacatttgggttgtttccattttgggctaatgtaatagtgtcgctctgaacattcttgtacatttctctcagtgcacatgtgcatgaatttctgttggttctatacctacgagtggagtgctgaatcagagtgtgcatatcccccaactgagtagacaatgccagcatgtcttctaaatggttgtacagatccacacagctaccaagaaatgagggcctccatttcttcacatcctcaccagcacttgatcttgtcactgagcttaacttcagcatttctaatgggtgcatatttgatcttactgtagccttaatttccattttcctaattattaattaccttttcatatgtttattgaccatttagatatccagacttactttttattgaggtgaaatttacattatataacagtaaccattttgaagtgcacaattcagtgtcatttagttccttcacaatattgtgcaatcaacatctctatcaagttccaaaacattttcatcaccccaaaagaaatatctatgcccattaatcaattgctccccattccctcattttctcagcttcaggcagtcactaaactactttctgcctctatggacttgcctattctagatatttcatgaaaatggaatcatacagtgtatgacctattgtgtctgacttcttccatttaacataaagttttcatggttcactcatgttgtatcatgtgtcagtacttcatgcctttttatgactgagtaatattccagtgtatgtatataccaaattttgtttttccattcatttgttgatggacatttgggttatttctaccttttgttttttgtgaatagtgctgctctgaacatttgcatacaagtattcggatgcttgacggcctgtttctacttctttgcacctaggagcagaatttctggtcatatgataattctgtgtttcaagtatgacgaacccccaaactgttttccacagtggctgcaccatgtttacatccccaccagcaatgtatgagggctttaattatgcacatcatcgccaatgcttgttttcagtttttaaaattatagccattttagtggatataaaatggcatctcattgtggtttttatttgcaattctttctttctttcttttttctttctccttccttccctccttccttccctccctcccttccctccttccttccctccctcccttccttccttccttcccttcccttccttccttcccttcccttcccttccccttccttccttccttccttccttccttccttccttccttcctccctccctccctctctctcttcctttctttctttcttttgacagagtctcactctgtcacccaggctggagttggtggccggcccatcttggctcactgcaacctccacctcccaggttcaagcaattctcctgccttagcctcccgagtagctgagactacaggcatgcccagctcatttctgtatttttagtagagatacagtttcaccatattggtcatgttggtctcgaactcctgacctcatgatccacccacctcggcctcccaaagtgctgggattacaggcgtgagccactgtgcctggcctatttgcaattttctaatgacaaatgacgttgcgcattttttcaagtgcttcttggccaccatcttctctggagaaatcctgatttaatgggaagcatatgaatcagagcagcgcagaacttccctctaaccaccccactcttgctccctggcagtctgatttgcttttctgagtgagagagatgtgggtaggagtcacacctgaagttttgcctcattgacctgcagtctccatctcccaaaggacaattgtctagagctggccactttgtccagagctggactttagcaatttgtcattattataaatagtgctgctgggacatcttcagacaaatggcctttttcttttggattatttcctttggcaatatttccccccaaagaactcacccatcaaagaacagaactggttggacagttcttactatgtatttagatggatttttcttatttaatcatgatgcttcctagtataattgccctcactgggttctcactgtacctgagatggagtcatgctcctggccccagaggaccctgccttcctccactaacactaagtccctatggacttcagctcacatcaaatcactggcaggcttctgaatgggacatgcaacgtcccacacctgtgcttttgcataggctagtgccatttttattctattattattttttgggacagggtcttctctgttgcccaggctgtagtgcagtggtacaatcttagctcattgaagcctcaaagtcctgggctcaagggatcctccttcctcagcctcctgagtagctggattacataccctcatacccagctaatttaaaaattttttgtaggcatagagttttgctgtgttgcccaggctggtctaaaactcctggcttcaagcaattcacccttcttgacctcccaaagtgctgggattacaggcgtgagccactgcacctggctaccagtaccattttaaaaatgcctttcccccatagtacctggggacccccaaatcatccttctaagattctactctgggaagctgtctctcctctcccaggcataatgagcatctctttgtctcagggcttctcagactgtacagtgaccactgattagttgcctgcatccctaactgctacataggaagttctatgaggcagggatgggcctgtccaactctgaatcctggaacagggatttcaggtgcaggactggcatgaagtgggtactcagcatactttttcaatgaatcaaagaaggaatgaaggggttagtctagcctgtggtctaatgcaccaacttactatgttctctgtggtgtgtaagtcattccaattcttccatggctttgtcagctgtagggtgaccttgactgagtactcagggaatattatagggctgtcgttttcttcaatagtgtaataactagttaggctggaattcactctaatgttaatttgctctttatctttcttattatattaattggataaaaatttatttcccagcttctctctactcatcttattcctgattgcctcagtttgtcaaaagttgtgcatttatcttttttcttctagctaaatatgtaagttgattttccagttttcttttgatatctacagcttgatcacttaaaatgaaccatagattaggatataatctctcttttttttaagtctctctatgttgcccaggctggtcttgaactcctgggctcaagcaatcctcccaacttggcctcccaaagtgctgggattacaggcatgagccaccacacttggccagattagggtataatctaaagccagttcttttccaaagtggtccccaggtttcccccaagtactaattaaagtgtgagctattgcctcatcactgtactgcccatcattgttgtgtgatatcttatcatataatattttttcttttaatgatatacttttatttctggtatctctgtattactgatcactttcttgtgctaatatgtgtatgtcgttttaaatccatacaattttgatgcttgttactttgtgctatgttttacagtctggtaagagaagttacccctgcctacctccttcattaagccacgaattctttagtataggttggcttattccataatttctgcatggtatgattagataatgggagtgtaccagtggtagtgggtaggtgagggttgtaaaaaggaggcaatcttacaataagactcaatttaaggcattaatgtctagtgtggagaatggataagcaaataagacctcaaagtcagagcatcagattgtggggtatgacctattgctgtcaacaaagtgcccaggggagctaaggtggtatcagaggtgttgggaggagccaggtttgctgactgattaccttcttctgctctatccaaactacagagaggaaaagtctagggttagagcagatccaggtcaacatctaatgagagagacaggggtccctggtcacctaatgaatgcagcccactctttatccccattataaccaaactcaacccaacccaaccctatccaacccaactcaacctaatccaattcaacccacctaatccaatacaaccccatcaaactcaacccaatccaacccaacccaacctaatccaatccaaccaaacccatcccaacccaaccaaatccaatccactccagttcatatttgttgcataccatgggtggtttaaaggacagaacagggcaaaaaactattctgagggccctggtatctctcccaagtgaccagggcccctgaccttagatgccagggaacccctttctgggtttggagagcttggctggagtctggcttgcaggcaacaccctggccttaggcctctctaggagttactcctcccatcactgagggactcaaatggggcccagcttaaaacactcctcccatctaggcagtcttttgtgactagcttcctcccaaagggaatttctgttgaagtcttcaaaatggtctgtctgttctgtattatggcttctcttacagatgtctgtcttcctcctattattcctggcttcctgctgtcccaggcactctctggagtaggtggcaggatggctgaagagccgcattagactcagtgcccatcctggagggactcatagttcagtagtagagacagtgcgcagaagctggcttgcatgctaaggagcttgtcctgagtttcctaacacagtgtaagcaagcatctgcactgccaaagtagggatgtccatttccaccaggagatgggagaggcagagggatgtgagaagtgtttgtaagagattcatttttttcaataaaattttaaaaattggtaataaaaataatacatagttattataaaaactagggccaaaaagaggagtttaaaaagatcacatattatcttgtgactcaaagataaaccctgctagcatttgatggactgtgtttcaagtttattttccacccctaagtatgcacatagatcataatatgaacagaacattctgtacattgcatttagtgtttagttgatggcttttttcccccttaacaatcatctagacaccttctctggaacattaaatactcgtctctaatattttttgtgtttgtaatagtatttcattgtttggttgtcttgtaattaaacttttaggctgtttctcattgctcactattatgaacactattgtgacgatcgtagtcttgtagctttgtatttgacgacttctgcaattatttcctagcacaacacaatttcctaaaacaaatagttgggtctagtgcatgcccatttttaaggcttttgttgcattgttcagacaggcaataataatttatactccctgcaacagcatatgagaacgccaagcccaccctgccttgtctattactgctgtgtctctaacccaaaaggagcaaatgacaacaggtaaaggaacagtgccaccatccttctccaaatggtggccttactcaaaagagctgagggctcctcccaccctccctctccactcttctccttcattcatccattttgcacatgtctgtggaagggctagaagagggtttttcaggaaattagaatgtgagagctcatgtcatgaggaccttgatggtcatcaggcctccagtaccttggaatcattttggggattccaagggggcctggtgcccagtcctccagctcttcagggattcttcatacatctgagataaggtccagacaccagcaggtttgaaaatctcctgggtgcagtctaagatgcagccaaggctgagaataaccaatgcagtccaactgcttcctttcaaaggtggtgatgctgagtcccagagagggactccttgtcttccttatctgtaaattagggcaattcctactctaaggattagtgatcgggcctgtcactggtgatcagttcaatgcctccttacttccctgctcccacatcactgtgggttccttgagggcaggaagccgtttttatttatccatgtttccccagcatctgacatggcactaaatggacacaatgagcatttgaataagttaatgaatgaatcattcaaagcctgggactgtggagatcttagtgaaaacccagcattatgaacctttgaccagcaaagtctatgtgcgcctccagccacactgaaagaccaccctgcagccatccactgtgcaggatgatggggctagagcagggtgagagtaggcactgcctatagtatgtatatcaagaatagaatgtttcatgaaagaaaagttaagctgtgctttttctggcataggaaagttacaaccatttcatctcacagaacatagagtagagattctagctgatgacaagctgaacccaagttcttgcaagttcaacagcattacacacagaacctctgaaataggcccagccaactgcttctcctctccaactacaatcttagtggctagctagttctgacttgattgtctagctcagagaaggaaagtgactagctcatggtcacagttcaagttggcaggagagccaggtctagaaccaggtatcctgactcctaggccagtgctctggtgcttcacatgaacctaagaaaataccaagggtatggctggggtatggtggctcatgcctataatcccagcactttgggaggccaaggcagatggatcacctgaggtcaggagtttgtgaccagccgggccaacatgacaaaatcttgcctttactaaaaatacaaaaattagctgggcgtggtggtgcacgcctgtggtcccagctacttgggaggctaaggcaggagaatctcttgagcccaagaggcagaggtggcagtgagccgagatcatgccactacattccagcctgggtggcagagaaagtccccatctcaaaaacaaaaacaaacaaagaaacaaaaaacaacaacaaccaaaaaacagtatgatctgtgctaataattatatagtgctttttatgtgccaggtgctgttttaagttttaatatataggatatacatatatgttatatatacacacatgcatatccacatacacacatctgtgtgtgtatgtatatgttttatataatatacattttatatgtacatttacatatatgtatgtgtatctgtgtgtgtatttcatatgtgaaattctcaccacagccttgtgaaatgaagaaattcaattacaacttgacatcagcacacaggtctgtctcccagcctccatcctctccaccctagaatccatcctccacactgcagccacagtaatcttctagcttcttgccactcaatcttcttgcttctagcatcttgctacgtgtggtccatggaccagcagcatcagcataacctgggaacttggcagaaatgcagaatctctggcttcacccccagaactcataaatcagaatcacaccatctaggggactgaggatagcattttaacaagatcctcggtgattcgtgtgcacttttaacatttgagcaacactctaaaccagctctgattgtgttgctccctgcttaaaaccctttgccatcttcccatgatcaccatctgtggtaggcagggtcatggccctctgaaggacccacagcctaacccccaggacgtgtcactccattaggttctatagcaaagggagttaggctgcagatggaatcaaggctgataatcagctgacctcaaatgagggagattgtctccgattatctggttgggcccaatatcatcacaagcgtcctcaaaagtggaaaagggaggcagaggaaatcagagtggtgtgatgtgagaggacttgagcatccttgtttgctagctttgaaaatagacgaaggggccacaagccaaggaatgcaggcagcctctggaagctgcaaaaggcaaggaaactgattttcccttaaagcttccagaaagaaccatggtctgctgataccttaatttttatctcagtaagacctgtgttggacttctaacctccagaactgtaagataaaaaaacttgtgttgatgtaagccactaagtttgtggtagtttgttatagcagcattggaagataaatacagccttctactccttagtgtggcatttgaggccctctgaagttccaccaagtgctgtcctggcctcatctcccagaatatcccttcccacaccctaatctcaaaccaacagagtctccagagtagctagagtatgggaagggacactctgaaaaaaccagactagggttatttctctctctctctctctctttgtgtgtttgtgtgagacaggttctcactctgttgcccaggctggggtgcagtggtgcaatcacagctcactgcagccttgacctccctgggcttaagtggtcctccagctcagcctctcaagtagctgggactgcaggtgtgcgccaccatgcctgaataatttttctatcttctttttttttctttttttaagaaatggggtttcactgtgttgcccagactggtctcaaactcctggtacaggcaccatcacacctggctggggttgttctctatgccaccagcacctagccctgtgcctggcccctggccagtactcaggcaatgccttttgaagtaataacccagtggaaccctgttacgttcaggtcgccaccagccacggaggagcccatgacatgccggaggcaactatggcaacagtgcgggacatggtggagactctcccagagcctcagccttaacattcctttgctcttcttctgctgtgggcaaatcactgtacctctctgggcctcagtttccccatctgggaaatgaaggggttggaaagacaattctaaaagcatcgttagcatgaacatgctaggatatctgagttcagtttggccgcacgttctggcagttgggggcagtgattcggctcagctctgctcagccctgttcatctcactgctgagcacatcctgcactgtcatcccattcacaaagtgggatacaaaactgcccagcaactgtgtgtatttggtacaaaacagactacagctgctcattccccctgtctagttaaaatgccaaattactcactctcccacagaaagaaaaaaaggaggggtggaagaaaccatttctcactgcagagtttttccatgtgacatattttctaattttatttcaggtctaactgtctgcagtagatggctccatttcagggtcttcccctccccttttagtatatgagctttcattaaggaatgaagtggctttatttgtttaatatttgcaagtgtgggctgatatcaaattgcaactgaatgtcttcattttctcggcggagggaagttctctaagatgccccgcactggtttagtggctcggattccttggttctaggcctggtcacaggagctttgccaagtcccctccattctctggacttagaaactcaaagtgagtattccgcaaagtgaggaaaaggctggctcatcacggagatagggtggctggattggaagccatggctgatgcgccccatttctaagagtggttccatttgagactgtgttggaatggtatgcagctcagtttatgtctgtgctcagctcctgtcatctctgcactgttgctttagttcatggaatggctgagaaatttttcatacctggaaagagtattgtagctttgttttaaagaaattaattctggccaggcatggtggctcacatctgtaatctcagcacttcaggaagccgaggtgggaggatctcttgaagccaggagttcgagaccagcctaggcaacatagtgagaccctgtctctacaaaaaaaaaaaaaaaaaaaactaaaaactaaaatgatctgggtgtggtggcatgaacctgtagtcccagctactcaggaggctgaggcaggaggatcgatcacttgagcccaggagaccaccatgcctggccagaattagtttctttaaaacaaagctacagtactctttccaagttatgaaaaatttctcagccattccatgaactaaagcaacagtgcagagatgacaggagctgagcacagacataaactgagctgcataccattccaacacagtctcaaatggaaccactcttagaaatgaggctgcagtgagctgtgattgtgccagtgtacttcagcctgggcaacagagtgagatcttgccataaaaaaaaaaaaattaattctgcccctgcaatgtctgttgcatgcaacctctcccttctatcttcttgccctgcctggcttcaggcctgtgttacctctttctgctgggttgctacagcagctccctggccagcaggatctcccatctctctgtcctctagcatggcttctcactgtgagtcagagtagcttgtctaaaacacaggtcccatcatgtcacatcccctgtcaaaacgcttccatgttttctgtgacgcacaatgcattccacactccttgggttgcagttcaaggcctcttctcctctcacatccctccccgtaccctggctctaccaccctgaactgcttgctggtctctgaattgaccatgcatgttcccttctccaagcctttgcttgcgctgttcctcagcctgccctatggaaatcctctgcattttcaccttgatagacttgttgcttaaactgtggtccctggaccagcagcatgggcatcatccaggagctcattagaaacagagtcccaaggccgggcacaggggctcacacctgtaatcccagcactttgggaggccaaggtagggtgattgcttgaggccaggagtttgagaccagcctgggcaccatagtgagacaacatctctataaaaaattagcatgatgtggtgacatgtgcctgtactcccagctacttgggagcctgaggtgggaggatcgcttgagcccaagaggttaaggctgcagtgagccgaggtcacaccactgaacgaaccccagcctgggtgacaaagggagactctgtttcaaaaataaaaaagaaaaaaaagaaaagaaatacaggatcccaaatcctgcctcagacccacaacatcagatctagacccacagcatcagatctagacccacggcatcagatctgtaccttaaccaggcccccaggtgatgtgtgtggcactcaagtgtaagctgcagtgctgtgtagcttggagggcaagtgctgaatctgggcagtcagatagagctggcctggttccaggctctgcatgtatcagttggtgaccttggacaatgtactaatccttttgaaacctcagtttcctcatctgtagagtgaggaaactataaacgaaataacgccccaagctcttagcacagtgcctggcacatggaaagcccttaatgaaggggagtggccagtaacaaggttccatctcagtgctagctgatgttgtgcctaagctgtcctgtgtcctctctcagcattgcttgtattgggtttattccatcagaggtgagaactcatttgtaagtccatcttgctgaggatgggaagggccaggaccaagtcatttgtgtttggagtttagaatcattgaccttccagtggagggagataaacaatcataatctgatgtggggaaagtgaaacatagctaaacaaggactttgcaaagtgggtgggatggaattcattccagagtttctgcccttggtagaaatggccattctgcctgttgtaacctgggggctttctcattcatccatttgtttacccacttttatgtaatatgtattgactgttctctgaatacaagcaatgtgtgatatcctgggcagaaaatgaaaagcaagataggcttgctgcttgccctctaggatcctatagtctaatgggggacattgatgctaaataaaggattgtacaaaaagactctttatgtttataaatggtagaaaatgttagaaagtgcaatgagagctatgaaagcacatgccaggacactctcatctgtaccagggtgtcaggagagtctccccaaggaatgggatttaagatgagatctgaggggtgaacagatttagccaggaaaggaggtggggatgatgggctggaagaggagtggaatgttccagatacagagaaacagaatgaggagaggatggaagagacagcctgaatgtggctcgaacacgttgagggaggaaggcagggtgaagtttctgggatgaaagcagggccttcgcccaggagccgtttttcctagcctggccctgggggagcatcttggcttcccaccctcggtcagtcctgcagcactaccgcccagggccacccggggtaaaggcctttggtctaggtagagtgcagtcaagccctggattctactacctgccttgctcctgcctctgcttatcagacagtgaattgcttcagggcgggggcaaagggtctctacctttacatagcgtaagagaagagaatttaagagacttgcagtaaaatgtcaggaaggcagagtcagaagaaagcccggagccagcacaaagagcccctggtccaccttggcctctcagggcctcccaggccacgacagctgcctggcaaagaggtggtggaggcaagtgaggaaggtttctaacaattgctgtctgcggttagactccagtcagtcctggctttggaaagcttcctcccgtctatacaacgaagaggtcggaccagcgctaaggtcatccaggtctgacatgatctctttttattttttatctctctctggatctctgtattgagaatgtgcatccgtaaacataggaagaattctcttgccagggaacagaaatgcggtttggggaggaataactcgggtgggaggtttttagatgctttcactcaggggagcaattcctttagacatggttgtacccgtgagacgtgggggatgcattacgcctctcctgtccaagccattcctttggagacctgcttctcaaatgggtgtgctcacagtccttggctgtgtgacagtagcatgcgaagagccacattgtttatttcctggaggattttactcagtggttggtaatttgtggtgaggagaccagtaacaactggggaataatttggaacatttttatattattaaaacaaacacacacacatgtttggagtggaattcaaaacttaagtgcttttaaagataaagcaagagaattaaattttcaaggtcctggggggctctttggctagactcaggccctcaggtttatctgatgacagagtgctttagcagagatgatgttatatacagatttgaggtccccaacttgtgggggatatttagaattattgcaaaggatacatggacattttctgtctacagatacctaacacctgtgtgttgagggggctattaatgctttgatattgacaagatggagatggtcactgccctccaaagctttggattagaactgtcagctccaagagggaaggaacttgtctatcactgctggatctccggcacttagaatagtgcctgctgtacagcaggtgctcaataaatgcttctggaatgaatagaaatgtgtgtgttgatggccatgagaagctttcatttctccatccacgtttacctttccaggaatagcgtgtggagctgctttagcatggagatcttgggtggaatgtgaagaatgctgtcatgcatatgcatgtgggaggctggtcagccttgctcaggttcaagatttccaagaatcactctttggaggcagccttccacccagcgtggtccatgctgcatagcgtaggctccttgtgtgagaaggcacagttcaccatttatgcaccttaggtagctaggacccactgggcctcacttctcacaatgcctgcaagtccccccaaacaccttactcccatcagaacccactgggaacctgaggcctcagaaaatgctggactttggggatcaactattccagctcccccaaattgcagacgggaagatggaggttcaaagagagcaaggaacttcctgggagtcacacacattttagcgatgtgactcccaacaggttccttgttctagaactgggtctggaactacgtcttctgatatccaggtgggtggcatcactccattttgaaattccccagtgctgcttgatcacatccgtaccattctcagggatgtgcttgacagtagtgtgtggttagagctgagctttggaaacatcacatgaactttaaatcctggttcaacactttttttaattatgtgacttgggcacattgctcagaaagagtgtgggtttcctcatctggatggtggtggtgggtgatgggtataggagtcctacctcctgaggctatatgagctactcagcaggtaatgcccaggagtgctcagagccagggatggggaacccagtgctgagccatccatcccacaaagttaaggtcatgcccatcccgttcaccccaaatctccatgacttgcagtgccaggcatgtgacggtgtgtgcttgatagtcatttgtgaatgaacaaatgaatgaatgaacaaaatggacagaatatgcttagcacctgacatttgccctgtgccaccaccctgagagctaagtattgccacctctatttccagataaggaagctaaggctcagagaagttaaagaacatgcccaagatcacctggctagtacgtggctgagcagggacttacatacaagtttctctggcatcaaattccacgtcctttgccctgcaccattctgggggaggctggtcctcctggggttcccccgaggtcacctcccctcccacccccccattcttggtctctagttaggaggtgtccactgggttttcatcttggaaggtctgattccctctcccattattctggtggtccacaggctgttcctccagcaaacatttggagactgtcaagctgtactttcatctaaattaaacaagagtcagcctgtttcaaaatatgacttcagggtcaccatctgttctggctgttcccttaaactcaaatcccattttggagccaaatggggctccagcatcccacagagagtgtgtctctttgcacaactgagcaggaaagtctgtagaaagacacagtgtgtttgacaacaaccctcggacaaatttctctggttatttcttttcccctactcagcagcatcaacgtcattgcatgtgaaccacaggtccccaccacagattcaaatgcattcctttctacattgggtacctagtgtgtaccaagctctgtatgaggccctttcccatgccatcttccgggtcatgggagagagtggcctggatcttacagtggggggaatacaacatgccaaagctgctcgagctggtcacaccatcagtctgggcatcagttttctcatcttggggacattggactgggtattttctgaggttcttcccagctctgaaggttaccctgattcttcatcagcgccttggccaatgtaggcgagatttcacggtgcccactgaagctatgagctcgttctgactgcgctgcttgtctgccctggctgaattcacacaagctcatctgttgggacgccccgggctgttcccagggcagcttgattttgcccagggcataacatgccaagtgctgagaggctgcaagaaagtatgtctcctgctgttgccaaactatcgccttcgcaccacattccagatcacccaattccaccctctccttggcaagaaaaagaaaggggacccaactgcctagggcagcagcttggggtgaaatgaggattcctcctaaaatggtcagctagaaccttcctcaggaatctgccaaggcacccggttgcctgttgcataaattttagtctccttggctggacatttgaggctctctgactccagtctcctaaaggaaaaagaattgagagtagcaagagctgggaagtcccaaccactgcagttaaggcctgcagtcttaagctccttcagcttcagtcatctcatctgaaaatggcatagccacagtccccaccccatcagactgccttgaggttaggtgagctaatgcacctaagtgctgagctcagggttggcctgttgtgagattaacatttctaagtctgaatctctctggatccataattctctcctttttgctccaatgctggaggctatctcggggtcccatttctcccatccttggaatcactcacttggcccttgttttcctaattgtgtgggtttgctcatgctctgctcactccactgtgttcacctgtgtgaagcatctcaggcctatctccactggcccttccttcaggtccccttcccagtgtcccccagtgggcggggagtgctccctctttaagcccctacaggactttcctgtcctttgcttatggctccaagctcaggtcacctgtatctgggccccgtgttggtgtctggtcctttttttccaggggacccaattccttgtcctcttgatcccccagagcccagcccaggtcacctgtatctgggccccatgttggtgtctggtcctttttttccaggggacccaattccttgtcctcttgttcccccagagcccagcccagcgccaagtccagacagggttggaaagtggatgctggttgtggacaaggccagactgggcccaggatagaatgaatgatagtaaggtcccctcctgactcttcttctgggagggaagagagaggaccattctcccctagggagatgtaaattatggctgccttgaggcctgtggataacaactcaagagatttcattgaccccatagtatcaatcatgccaaagaaatcaagaaacaacccaggccatgtttcacttagagaaagacttagaaagctcagaattaaaatactctttcaagctcctcctatcattcagtgctcctcccaacccaatgctgcacccccatggaggagatggggggccttctccacacaggaggaccagggatcttaccgttctgctcctgggatctccagggctggcctgtcccatcctaccttgccccatggccccagctcatgctctgacacccggataggccatgagcagcctccctgaggcctctagccaaacctcaaggaccctaacagtatataacagagaaggggaagcccggttgttcacattctccacccagaccatgttgcagaggggaggaagatggaggcagctggaaatgagtctgaagtctgagaagccagtgtgtttaagagagtcactctcatctcagtgaaggagagccgagggcagccattttgcagaaggctgctcattcaaagcctcctgcttagggagaggggattgcagcccccagcaaagctacaatcgactctgtgtggttattaatattatattatatctcaacagtggggatcaggtgagagctaagctattaagtgcatattaagctaaatggtgctggtgggattacttgtgacaactactggcattcattagaattctttatgattgatgataaatatgatgtgttaagacaggcatacaatcacgctagtctagagtccattaagctcattcattcatgcacatgtgtattatttgtacattcattcgttcattcattcatcaaatgctcaatttatgcctacttcaggcaaggtctcacattagggagatgagggtgacactgggagatatggagatgaaacagaacatgctacctacctcctgaagggctcacaggctgctgagggacacaggtgaggaacagataacagagtagtgagaaattggagctttctgtgaaactggccctggggtggaatgggggttcctagggagatagtatgactcgtagacctggccaccgcagtcccctcctggaaggtgtgtgccgacccttctctgtactgactttccctggggagccacagctctgttggagaccacaagtttccccctgcctgcagaaccctctcctgacaggccttgacccagggggctggagtgcccaagcctctctacatccacttacctccaggggctgacttggacaggcttcctgctggccagccttcttctcccacagctggggccacttggctgcctcaccccaggccctaggacattcctgttttccatcagtgggatctagtgattcaggggacttagcatcccaacagcctggctgggaggtggcttgaatgctgtgctatgatcacagaaaagcgctgtctctaccatctagtactggggccctgcctgggttggtccatggtggaagcagttacaatcctgcccctgcaccctgtgcctgggtctctggcccctgcaccagacgtctgtgctgctggctgcctgctcttgtctccaggtccatgactgcccatgactggcctccattcaggtagtaggatgccatctttgcctcaacagcacagcagttctcaaactagggtgtgcatcagagacactagggggctggttaaaacacagggtgctgggcctcagcccagggtttctgattttgtaggtctggagtaggtctcgagaatctgcatctctaataagtccccagatactgctgctgctggtccagaaaccacactttgagaaccactggcgtcatggataagcagacgggctatggagtttgaacccaggttgtctgggtccaaaacctggcccagccacttgctagctgtgtgacctaatccctctgcacctcaacctcctcatctataaaaacaaaggtaataagaacaccctcctcactgttactgtgagtattggatgacccagtccaggcaactcacttgcaatcgtgcttggacacagcacacagtaagtaagcattcagtgaatgtgtgagtttcctagggctgcggtaacaaacgaccacaaactgagtggcttaaaacagtagtaacttatccttgtccagttctggaggcgagaagtgtgaagtggaggtgtgtgggctgggtggcactcctcctggggctctagcagggaatccattccttgccactttcagcttctggtgactgccagcaatccttggcttgtgtccacttcattttaatctttgcctctgtggccacattgcctcttcctcttctgtctgtcaaaccccctccatgtgtcttataagaacacctgtcattggatctagtgcccacccagataatgcaggatgatctttttatctcaagatccttaacttaattacatctcaaagactctaaatgtaatgaacatatttagaaatgaggacatggacatatcttttctggcggtcaccactgaacccactttagggaacacaggctattatcattattaagttgttccttcagctcctgcagttgggcctggcctatagcttcctgcctgggggcgggggcggggaaggaggagtaagctgactcccaggttccagcttctggtcagctgcactttattcaagacaacccattttcaggctggggcagagaattctgcctattaagctatactggctatgttatagcatttcagcatgttcagatttcattgatctgagaaaaaaacgccaatcccagccccccagactcctgtctggagccctttgtccatgttaattgttcctcataccctggcaagttgtacttggcaaagcattttctcattcaaaactctactggatcctcactgcagtctcatgagaaagattgtatcaccctattttgcagaagagaaaactgaggcccaggggaaaattgcacaaagctgcctttcatggcaattctaagcagtaatttatgggagagaaaagaaggctaatgtcactgataatactaactaccaccaccgctatgcttcattcatcgtgggcctttgcttggccctctgctcagtgttttatgtctattatctcaggtcattctcaaaactctctcctgaagtaggtagcattcctcttgcggatcgagaaactctggctcagagaagtgaagtatcttatccaaagttgcccatcttttaaatgcagagttgaggttgagtctttctccctaataccaggttgctcagagatccgtctcctagctctgaaaaaatgtcagggcagaccagaagagaacagtggctgcccagtggccagcaagactgtgggagaccccctctcgttgtcagcagagccccgctcctggtagctggtagggaggtgcccagtgttgatgcccccagccatagggagggagtcagggcaatgggaatagagaggcagatgggcccaaggtcactgagggctgggacaacaataagggtgtgcttcctggagtgggtcaggcttgggttgaagtgacattcctggagagcagcagagacagactcaatgcctcgcatcagacagatgagggcttaaaatctccagtctgggatttgatagctgggtgcccttgggcaagttatttaacttcccagtgcctcattccttcatctgtaaattgggaacaaaaagagtggggttgttgtgaagaagtcaggggctataattagcatcaactgggaagtttgtgcagcctccccatgcccaagccacacctgaaccagctcaatcaacatctttgggagtgaggcaagagcattagtagtttaaaaaaaaaaaaaaaaaagtctccccaggtgattctactgtgcagccagggttgagaaccaccgctatgcaagtaaagcacttcgtgcccaggacatagtaagggctccgtatacaggaactattgcccattcactcatgcacaaaacaaacatttattgagcacttacctatgccaggctctggattacatgccaggcatcacctgttcacagcagctgtctgaatttatttatgtactatttctagatagcttccaatagagggatcgtggaattcagtgctttgtgaagccaggaccccaagtccataattctagggagaaggttttactgacaacgaggaaaggagggaaatgcagaaaatgtacccaaatcagagaaaccaaaccctgtgtgtgggaagagcagtctgagctctctgagcccttaagggggtagcaggagaagacagtgtgggcttcagactttctgtgggctcctctgtaaatatctgcccctacaacaccccagcttccacagctgtgatgtggaagggctttcaatgattggtttgattgtttttagcctcagaactcttcattcaaatgagacttaatggaacccaaattattaaacaaatgaagtctgaattgcttgggtgtatgtatatgagtgtaggtgagtgtgtgtggatgtgggttagtgtgtgggacagggtctatgaataggttgtgagtgtgtgagtaggtaagtgtgtgcatgtgtcagtgtgtgagtttgtatgagtctagggtgagtgcgggtggaggtgcatgagtcggtgtatactggagtatataaacgtgtgtgtatttgtatatctatgtgttagtttgtgtggcgtgaaccttcgaaagtatgtgtatgagtgtgtgttatgagtatgtgaacctatgcgtgtgtatgagagagtggtaagaataacagatttgtactgtgtatttgtggatgtatccgtgtgtgcatgtgttcctgtgtgttagggggccaaggggcaggacttctgctaaggcctcctgtatcctcctccctttctcatccccagccctggaaaatactgcttgaaaccccctggtctatgtgtctacactggccctgccagcagtcctgtgtcgccttggaatgctgggcctgacggcttccaggagccatgggctgtagagcatccatgtccagcaggtcactgcatgctcccatcccatgcccctcacgtgcccctgacaggcccctttttctccgtgccattttccatgtgttttcctcccagagccctgagctgagccctccagagctgcctgccgggtgggggtgatgactcatttcagttgatgtcatcctcaggattcaaggctctcaatgcactcaaagagtctttgttccccaaatggaaaaggaaagtccgtacaccgagaagagctgacaacgaaactcttcccagatgcccatgggtgctcacgcctgcccgcacctgctggccttcactgtgccacctagtccacatggtccctggggtggctctgtgcccaggatccaggaaacagaggttgagggaagggggtaaaggaagggacgtaaagacccccactgcagcaagacagcaggaaccactgcttcttcctgagattggatatgctcttgcactgcggctaactgctgccaggactgaggggtccgcgtgtgtgcgcatgcacgtgggcatgtgtgaagggagcggtggtgagcagagctgggtcacaggataggggagtcaccccatgctctcagcagagccgggtcacaggatgggggagccaccccacgctctctctctctgggctgctctcctcagttccttatccgctgggcctgttcatcaattatgttgctaattctttcatggctagcaggtggttgtgaggctgaacggaggtgctgtactgacagcttgagagtgccccgccctggtcagcacccaacccaatgagcgaggactcccagtgtttaccaaatgctcactacacaccaggccctgtgcgaagtagggttctcactgtgttgtccgttctcacaatatctctgtgagccaggtcctagtgctgccccactttatagattaggaggctacagaggggcgaggtgatctgtggaaaggccatgagtggcagacccaggactaagcataggtctgtctgatgccaaagcccaggcagttagcccttacccgtggctgtcacttgagagtgggcatcagattgacgcaggcaagaccctgaaagactctgattccataggcccaagcaggaggggcagacctctgacttttaaaagctcccaggggtgactctgatatgtggctagggctgcaaacttcacaccagcctaccttacctagtcccatttgaatcttgactccaactgcttattaacctcatggatttggaacagtaatttaagcctcagttttctaacctgcaaatggggataataatatcatccatctcagaaagaatcaagtgtaaggatgactgatttgtggaaagccctttgaacagcacttggcatgcagcaagcctgcagaaaattttagctgctgatgctgttgtttcttgacattctgttcattcagagtcccctttgccaggctctgtgctggtgctgaggaccgagagatgagttggcatggtccatgcccagggcccatgtctaagcatatgagagcaaggtgaactggccactggactgcagacagatgagggtgtctgggaggaaggatggagggggactgagggaacacagaagtatgcagctgggcctgggagagccacaaggaaagcttgaaaggcaatgggctgtaacaggcagagcccagcttcacatcttcagtgctggctgctgcaccgaggattctgagtgagtgacttcctgtctctggggcttgactccctactctgcaaaatgagagaatgatccctgcgttgcctgcctcctggcagaaggaacgggtaagaggatgctttggaaacagaagaggatactggacaggtgaggattacttcctgctgggctaagtgcttttcagctgctggccaggaaaaccaagcttcagccaggaccccagctccaggcttcctcaaatcgtcttctccagtttaggtcagaggctcgagaaagcaagaacgagagaacaagagagcaagagagaaagagagagagggagagagagagagagagggaggagagcttatacagtaacttcattgaacaggaaaattcctatgctatatatgaaaaccggaaaagagaaggaggcgttctaagtttacatgtagaaaaatgctcttctgtaattcagaaaaatagggtctttgattgtggccgagccaggtctactttctaagttgatccaggattttttccctggcaaggaaacagttcttttttaagaaatgcatcgggtgataggtttttctaagaacctctcgcacctttgctgggtgcagataaaccctcaggcaccgtggattgtgttgtgttcattttcctcagaaagggagtcaggtggaaacgggagcccccagagactccagcctgggtggggctgagtttccacacaggcagagagctgtgacattttcctgagcacagtgctccttgcctctggccaggccttgctggctaaagacaaggaagtctgtggggagggctgggtttgtcccggcccctgttggagtcattccttccaggcctgaaggctgtggactgaaagaaccggcagttaggggcggttagaaaaactgaaacactggcgggagacaaggaggaggcagacgatgaggctgtcagacctggcaagggcctttggaaaatatttagtccaaggctctagtttgacagatattgaacctgaggctcagagaagggaagggactgctcaaagtcatatgccaagttggtggcagagtccaccttgcaggctgaggccctttccaccaccccatgcaacatctgagaggtcaggatgtagaagttgaggccgacttgtgtgtggtctcagaggggtagagagctaggcccagccaggtgggtgggagttgcaggggcggttgcctcagttcaacatgagaaaggacttccgaagacttcgaattgtgcagcaatggtcaggtggccgtgagtggagatgagcaggtggaagccaggtggctttggatgggtgagcattgtaggaagctcctccccaggtggtgagctgcactgtcccacacagtctgcggttgctgaactcctgtccctccagggaggtgggagaaagggaagtcacatgccagatgtgatttagacatacccagggtccttgggggccacctctctgtaggggtgtccaaagggaagggaaagaaccgtcccagaagatgcaagaaccccaccctcccaacttgctggcaggacaagctgacaaagggcaaggaggagggacacgtggcttctccgacggtctgccccccatgctgcaggcgcagaggagggggactgagcacctcctcttctccccagggactgagtgccaagaaactcaggtgagaggagcccttctggggtcccaagggcagtccccccaccttaccctacataccctcatcctactggtccagccccaggccacaggcagtatagggtcatctggaccccctcagccccggccccccagtgggaatacacccacccgcttgcaggagtcaccgtggccccgtttaagctgactgaagtgtgccgtcggtctttagaggcgtgtgtgggaatggtagaaacccaggaggggcaccttcagcctttcccagcactcggtgcagagaaacagcagaggagggaaaggaggcgttatgggttctaggcctggcttggccaaactcactgcatggcctcagacctgctctcttgggtcccttaacagacctttcgctttgagtctgttgttgggatcccggttcacagcgcaggtggaaagccttccttgcagttggtggaagcgcagttcccgtagagaccgccaggagccgctgccgcgcacggtcccggggcgtcctcagcctccctcgcgcctccgtccggacatatccgcagcgctccttcacctggagcgaggaacgctccttagcctcctctggctttaaatgctaactagcgctagcgctgggctcaggtcccagatgatcgtctgtgagagggagctttgcaaagccagctacagttctctagggaggcaaggctccaaagctcaggctagtcccgggcactgcttcaggaccccacagatggaaggactgatccagcccatcgcacggaaggggaaaccgaggcccagcggggtaggggaggtgccagatgatgtccctgagcctgtggcagagaggaggaggagaggtgagagttcgctcctgttcttcatctctggccaaatcgctgtcatctgtgtggaaggaaaacctgaaccctgctctgtttgtttcttcatggctgggattctgcctggtttccatggaaactggctttggacccttgggaggaaagtcgcaccctgccctgactgctcagattttcctctgcctcctctgtctctgaaaccgtctgatttctcctctctgcgccctgaggaggggccaccccaaaactgcacttaggagtctgaactagatttgagggagggaggctcaggttgtctctccctgtgtccgttccttcacagcatccccttggctctgtggatgtttagaggaggggggatgactttggccctttttgcagagtgagagtggggcccccgtgtgttggggtgcagctgagcctgactggaaagatttagatgtaagaagatggggaagagtgatgtcactagaaggaatagcatgagtgaaggcaaagacacggggggagaatgaggagatgaagcagagggtgtctcgagtagaattttgcttttatgctgaaggcactggggagccattgaaggctttggagcttgtaataggagcagatgactactaatggtcacctagatagtgagctgcttgagcacacatgttccaggcttagctccatgtctccagcactacacaaggcacaatgtgggagctttagaaatatgatcaaattcatgaattggaaaagtaagttgaaaacccccattggaaatgaagctatctctaagcattaatgaagtgagagaataagaccggtcagatgcagccccaggaagtgtttgaaggcagtgaaaatacatagaataaatcacagtggatgtggctctgagagtctatctggtctaactctctgatgggaaaactgagatcagggagggggactagctggcccaaggtcacagacagagtcttgaacctgagtccttcctcccctccctgggtctctcattgccccatggattcatgcctcccagatgggctctctgggccagtggatccagcatcgtggagatgggagggaacgtggactttcaggtgatggatgggcatgcagtgaggtcactgttggatgtcagactggagcccgacctcagtgactctcaccagggcctcagactgtgagcctggcaccttcaattcaggaatgcctaggatttagttcagccagcaaacacttcctgaggacctgctcagggacagagcctgggtgtgggggagacagggagaagtggacgccagttcctacacttaaggaggttccaagatggtagggtccaacaccttagtcatataatgccatatatgctacatagagtcagggccaagtgcaggagcgggaatgcccagactacctggtgggggaatccaagaagacttcatggaggaggtgatgacattgaagttgggccctgagatgtgtggagcagttcctcaagtggagggaacagcatacacaaaggctcaagggtgtaaaatgtaggacccattcaggataccttgagttttccagtatgacaattgcatgggaaatagcagggtaataataatagggaaagaaatggcagctaccatttattaagcactctgtgtgctaagcagtgtgctaaacattttaggtatattattttatttaagtcacacaactgtcctctgagagaagtattattatctggggataagtgtgggccgcttccaagaatcctcaggctgcagagttccatcagcatgctccacgccagtccccagtcccctccaaaatggtgggatgtcttcccaccagctgtgatctccaccctcctcccttcttgcccagcacagagccatccaaggtcaagcccatggacccagttgctgggcctgtttgtcttggctccctggcttctcctcccctccctggtggctgcctaaacaggtggccctcctgctggaggccaaagggaaatgagccagcaggcccaggcgcagccgcgagtgagcatgggtcactccaggtcaggggtcgtcccctaccacgccatgccatgggacagtggatgtggaaggatgtggtgggggttgctgagagcagagctgggctgctggggctgacttgggcttgctctacattcatggctggcctccctcttggcggactctgtggaaacaaggcctgcgggccagcgcctatccatgtgtcctgtcttgaatggctgaggtctagggggatggagggtgggagggttaggaagggatcttttttgcagactttggtttttgttaagcttataccttgcatttcccatctgtcgtctcattgaatccccacatgggaagtgggcagggacctcccctgatcaccaggaagtcatcgcccaaaggctttgtgtttggtaaagggcaaaggaggggtctcatcccagctgtgtccaaggaagaggatgttctccactgcaggctgcctcctttgccccctctccagctgaccaaccattggccaggacctggagtggtcggggctgtgggagggcaccagctctgggactcgtggtaccaagactctgtccacccttgcttggctgccccatctgttgcttcctggctgtgcctcctggccatggaagtctccctgaacatcaatttccctgtctagaaaacaaggatgttggatagattcatgaatttttgtttttaagcagactcctaggcataagaattcccagaattgccacatgcaagcctggatctactggccatgggaagcactaggctggtttaagcaatgagctttctgagtgggagcctctcaggcccttctccctgtgtcgcctgaacgcttaacctggccctggatccctcagagacaccacttggaaacaagccacaggatgtgaagctctggtgcttttactctctgtggcaccaggaattttccgagcagaaagaggcttccccctcctgttcccagcaggaaagagagaggaaatagaggaaaagctttttactggattggataagcgaagaagaaagcagagctctcagtagggtgtttgtggttttgttttgtttttgtctttaaaccgtggaggaaagaaaagaaatctcagtgggatgtgtggttttctttgtttcttttccttctttttttctttctttctgtacaaagataagctgtatctgagtgaggaaaagcaagaagaataggttttatgatttctataagtggatgcaaggagataatctctttaaaaatatgtagatgtctttacttttcataccatgtatatgctgtaaaatagaaaaaagtataaaaagatatccagtgaaaagcaagtctcccagcccccagccaccagcttccttccctggagacaaccactgccccgtttcttgtgtattcttctagagctattgtaatataccatatatatttaaatatatatggtatatttaatttgtattagtacatacatttccaactgatagcaattcacttctgcaccttattttgtctgtttttatatagtacatcttgattgtttcatattagtacttaaggaatcacatcttttgaaacgctgccttggatttcgttgtgtgaacctgtcatcatttattatattaatcattcccaaagatgggaattttaggtaaatttaaaccacgatgctgtgaatatttgtgtatgtactttatatttcacatatgtaactttatctgttaaaaaattcatagacgtatgactgctgggtcaacaagtacatgcacatttgccattttgataaatgttattaaattgcctcccaccacgttataacaatttatgctcctgccagtaacgcaggagaaggcctgctgccttaaacccttgccaacacagcgtattctggtctttgccaatctgatagggaaaatggtatcccttcgtaatcttaactcattctatcattatgaatgaggttgagtatttttcatatgtttaagattttaatttcttttactgtgtctagaattttctattctttgcccatttttcttttgggtattcatttactttgcatattagagaaatgagtttgttgctgtgatttttgtagcaaatatcagtcatttcatggttttggggttttctttgacattgcagggattatctttattattattattattatttattagttctatgcagaacatttttttctaagtggtcaaatttaaccaaatttaccaatcttttaactaaaattaatttctgttttaaagcaagttgtaaactggagaggataagcattcaattgagaatcaaatctgagttcatggccagcaaacacttcctctctattaaccttagtttagtgttttctaaaatgaggtgattggaggctgagcgcaggggctcacacctgtaatcccagcattttgggaggccgaggcaggagaatcactgattccaggagctcgagaccaacgtaggcaatatagcgagaccctgtctctacaaaaaaatgaaaaaattagctgagtgtgatgctgcatgcctgtagccccagacatttgggaggctgagaggtggaagggtcatttaagcctgggaggtggaggctgcagtgagctgtgatcatgccactgcattcccacctgggcaacagagcaagactcttgtctcaaaaaaaaaaaaagaggggacttgagaatatgtacacattcattcatttgttcattcattcactataagccctgggttggttactgggaagacagatggcccagtgggaagagaggcaagtgacccaatagtgacatgcaggggctatgatggaggaccccgtgtgtacagagaggacttctaatgcagcccccagaggggagggtgtgggtgcgggaggtgaagcgagatttcaggggaagcgaggcctgggctgatgagcaggagtcattcagtgaaaataactgggctgggctggggcagatggcacagaggaaagcattcctggcaggggtgggagtccctgggacagcatggggcacgctggggctgtgtcaggcatgtcagggagtagggagtgcagctgggtcctgaccacagagggcctcttgagccaggtggcagcagcctggtcagccctggccctgagggccatgaaaaatcctatttcatagaaggcttctaagcaggatagcaacaggatcagatgtgctcttttgtcgaggaggggttaatcgttttcataaaaattgtatgaaatattttccatgaaatttgctataaagaaaaatacaatgaatatttcttttgaataccacctgaacaattaacactatcactaccgttgaaaagccccgtggacctctcccaaattgcatctctctgcctcccctaaatgttggcaagaatatgctgctggtgggtctgcgacatgcatgacacggttgcttcagagaacaattttgcaatattcagggaagctgtaggtgcacatacccatattatccaataattccacttccagctgtggaattacctgcacaggtaagcaggaggagatgtgtataagggagtccgtggcagtatcatttgtaatattgatggaaacctcaccttccaccaacagaaatgtgaatcaacccattgtagcttatttataccatagagtactgttgtgaaaatataaggccaggccaggcgcggtggctcattcacgcctgtaatcccagcactttgggaggtcaaggtgggcggatcacctgaggtcaggagttcgagactagcctggccaacatggcgaaaccccgtctctactaaaagtacaaaaattagccaggcatggtggtgggcacctgaatcccagctactcaggaggctgaggcaagagaatcgcttgaacccaggagtcagagggtgcagtgagccgagattgtgccactgcactccagcctggtcaacaagagcgagactctgtctcaaaaaaaaagaaaagaaaatataagatcagagccacatgtatcaacagggataaatctaaaaaatacaatgctgagtgaaaaataaaagcaagtttcagaagaatgtgtgcatcatgccaccatttatatgaggtgtagaacacacaccatggttctacattctgttagaaacacgtatcgagtggacatacaaatgcgtgggagtgataaacaccaaattcacaagaatggctcctgccagagcatgggcagaggaaaaggactgaagagagttcatgggagcttcagctgaattgatactgtctttcttacgtggagtggtgggcacatacttgttcctcataatattataattattttttttagagacaggtctcactctgccacccaggctggagtgcagtggggtgatcatagctcactgtagcctcaaactcctaggcgcaagtgatcctcctggcccaacttccagagtagtagattacaggcacgcactaccacattctgctaatttttaaattttttgtagagatggtctctctgtgttgcccaggctggtctcaaactcctggcctcaagcaattttcctaccttggcctcctaaaacactggaattacaggcatgagccaccataccaggccctattttaaaattttaaaaaatgatatatatagagagagatagggtatttctttgttgcccaggctgaagtgcagtggcatgatcgtatttcattgcagcctcaaactcttgggttcaagtgattctatcacctcagcctcccgaatagctgggactacaggcacacatgaccacacccattaatgtataatgtattttatttatccattgtttttcaaaatgatttcaacatataatcaatataaatagtattgagatatttttccaagcaaagtctttgaaatttagtttgtagtttacatttatgacacatctcagttgggaagacccatttttcaagtgctcaatagccatatgtggctactggttatcaaatcagacagggcagggtctggtacgatagaaacttagaggtcaccagttacaacctgatacaactttatcaacagatagagttgtgtcaggtgacctctgcggttcttttctaaaccagcaagtctagatgacagtgatgacgatgatgatgatgatgatggctgccttttttctttttttttttagacagggtctcgctctgtcacccaggctggagtgcagtggcatgatcatggctcactgcagccttgatcacctgggctcaagcaatcctgccacctcaacctcctgggtagcggggactacaggtgcacaccacctggcttttttgttgttttgtggagatgaggtctcactatgttgcccaggctggccttgaactcctgggctcaagtgatctgcactccttggcctcccaaagtgttgggattacagttgtgagccacagtgtgtccagccatgatatccaccactttttaggcatttggcatgtgccagcactttgtattatgtcctttaatcctcacaacaacgctataggctaattactcgctttttttaaaattgtggttaagcatacatagcataaaatttggtattttaaccatttaacaaccaagtgtctcatattgttctttatactgtatttttttgtgtaacctagatattccataataattgaggttagtactggcggtgagcagccttctctgtgagtgttgcggagttgagatgggggcatggcagtcagggcatctccctctcccagccactaagtatacatacccattcatgggaagtttgagttcctggaccacctggagtcttgactccatccttcttgctgctgaagggtcattgatatagtaggcagactaggtggagccccacccgcaaccccggtacagactcccccatctcagtgaggctgcagcagtgaatcagccagaaatcacaccagccatggctcgaaaatgtcctgccacttaccagctgcataacctcgggccagtcatctcatcttcccaagggataagagcagttaattgccagggctgctgtgaggactgagtaaaactatgcatgaaaaccacattgttattattctttataagggagctcaagggcacagaggcaggctcccatgtcagcctcactttcctggtcagtgctgcaggcgtgattatccctgcgcattgacctcttgagattgttcagtggatataataaaaataaagaatagcgaatgtttgttgcactgctaccattattaaccaggggtttccgtggacggtctcatttagtcattcttttggagcccattctagtgcctgtatgatagaggaagacactcagacttggagtggttcagtgactcactggagttcacacagctacgtagttgtgtccaataagatggtggcaagttgggtaaactggaaatcaggctgattcctcaggtagggctttccttagagggtctctcgagtgtttggggttttctctggagacaaacccgccaagtcctcagaaaccacttaggttctcagtggcctctggcctttggcgatagcccagacagccatcaatcagtctgccttgccctctggcctccagaggaggacactgctcgattctgatcctcactcattccaggcctcctcatctggttgaatcctcaggatccggcttcacttccaaggccaaagggtgttacttgtccattgtcctggctacagtggtcttgtccccctctccctgggacttgccttcctgtctcactactggtaccttggatgtcaactcagaagtgggtgcatgttgctgcaagctagtctgcagctttctcctggggaaaatacttggatgggccaacattctggagcctgggggccttttcaggacaccataatggagctccaccatttctccctgcaaggtgtggtggcatagcctctggggtcagatgctctgggtttgaaacctgcatgcaacttaccttgagcaaatttgttaatttctctaagcctcagttttctcagaagtaagatggggataagagtacctaacctcataggtttgttgtgaggattacatgagctaatgtatgcagagcgcttagagcagggcctggtgcagacagagcttagggaatgtggatgatgatggcggtgatgtcaaaggcgatgacaatgacgcaaatttcaattgccttgaggcctgggaacacttcactgtgtccctgattttccctgcacactcagaggcacttaaacaatagacctcattcaaaacaaaacaaacctatccagtttttttgtttttgtttttttgagatggactctccctctgtcactgaggctggagtgctgtggtgcgatctcagctcactgcaaccaccacctccggggttcaagtgattctgctgcctcagtctcccaagtagctgagattgcaggcatgtgccagcatgcctggataatttttgtatttttagtagagacgaggtttcaccatgttggccatgttatcctcgaactcctgacctcaagtgatccacccacctgggcctcccaaaatgctgggattttaggcgtgagccaccatacctggcccctattcagttttatagtggggaaaaaaaaaatctccaagtcgatgggtgaacattatatattctagggattactcataagtgttttccaaacgcaggtcatgaactattagtgggttataaaatcaatttagtaattaattaccagcatgtttttaataaaatgaagcagaaaaagaataattaaatgaaaagaaaaatatttgagtgcctggtgagtattaaatcatgttctatgaaacttctgtttcagtgttacagatatctgtctacacgtgtgtatattgggttgcagtgcaaatgcatttctttttgtgggtcgttgtcaaaacgtttgaaaaacaaccatttaggaactacagtttcagtggggttcctgagtgatcccgtttcatttgtgactgcgtttcttcctcattttcaagcaaagtggaatatacctgtaaagcgtggcctctctctccctccctgcagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactgtgagttaaagtcccactccaggtagatcagggaggtggatgaacagactcgccatgcaataaatggagcaactattattgttattattttattcttatgtcctcaaagaagcatgcgtgttatgatgggaaataacactaggcctggaaccccaaaacctagatttccatcctcagttttcaacttaccttgtaaatttgagacagttatccagattctctgatcctctctgtgtttccttatctgtaagtggagataagaaaacctaccccacagtcttgtaggtcaaataagataatctgtgtgaaagcactttgtacgttttaagattttatataaaagagcaaggtttgttatagccctaaatggtttgatctttggatatgggtgacaattgcacgtaagtaatttctgaaaaggtgggatacactagaataccagagtgagaggtagcttttcccgccttctaggcaatgtgcacttaaaaaaaatttaaactgactttactatcaaaatgggcttttatgaataaggcattctaaagatcactaagttattgtagttactcatttagtcagcacacgtatttactgatgtctcgttggtgaacaggacagcaccacggggtggagtttgggtttatctggagtagagtgaaagacattggagaatgttaagaagttaaaacacaaagggcaatttttaaatgctcactttaggagcctcatggagaggaagctgtcaggtgtggggagaggggaggagagtggaggcagggaggctgtggtagcccttcttgggacgaggccttcaaactcagaagcattgagctgcaggggaaagagctttctgggagagggagatgtgcgtttcagggcctgccgctgacaagctggggacctggagacaggaggctgctgtggtgtgcacacttgaacacaatgctccccaagggcctctctggcccaggggtcagtatgatactggcccaaggagagtccccccataactgagagtgggccaagaggtggcctggcttcgtggttgagactgcaggctgtacatcctcattcccacgcttttacctgttcgtctccattgccaaaacaatcatgtcttccactggcagtcatgctgtgtacgtgcaaaccgtggcttctgatccgtctcttttccccagggctccctccagcagctcaccgtgcaccccgaccccaggactcccgaggagctgtgtgaccctgaagagtcctcggtgagctcccctactatcccacagtgggccctgcaaccccagcagccgcagcctggggagggctggatgcccagacagtggcgtggagtttctgaaacctctcattttggcaactgctgcctcaagtcctattttgggcttttggcgtgatttcactttttaaagagcatcagccatctctggtgtggggagctgtgtttcttataaggtgtcaggatcttccatggctgtggccgtcaatggcctgctttcccgccttcttgccaagaaatggtgtcaagattctaaaatcaaagttaaaactgagatattctgggagtaaattcctataaaaaacgatcctcaacttagcttttatgcttggcaaatgagttcgttcctaagctggggatggagtggtgggcaggaaaaaaaagatgactccttcttccctccctctaaggattgactgagcacctgctgggtgccagccctgggtaggtgctggagataaaggaataactgggaactgtttaataagctgctcatatgcacttccatacccaaatacagtggcagagctgagtgtgatgggaaaagggggagatcctcaaacccaaactcaacgtgtcaggtgggagcaggagaggaaagaggaggaacttgaagccagttagggagcaggtgatgcctgaccaatgacaagggtgaggcctcccagggagaaggggtccaggatgcagtcagaggtgagcagaaggtagcgcattcctgcaattcctgttgccttttgggtggcatcaacgtcacaacagaacataaattgattttgttaactttgtaaaaaacaaaatgctgtcgatttcgttggaaagcccctgagaggtggaatttgggcctgtgagaatgcctgtgttccatgagccagtggtcccagcctgacagtcatgtgatgctgatcagtgtagtcacgcgttagtctctgcattgccattaatactgaaaaagtagaaacaacccaagggtccaagaacaagggattggttacaaaatcacagcactcgggctccttgtctgcctttaggaggctaattagaaagattaggtaatgccaggaagtcatgcttcggctgtaattgttcccagcgcaagattccaatgacagcctcacaaaggttgggagagtggtggggacctggatcgaatgaaagtagatatgttagagagagtgagaaatcattgtgtattctgttagagcaataaaatgtggaaagaaataaaatgaacaaccaggctgggcgcagtagctcacgcctgtaatcccagcactttgggaggccgaggtgggtggatcacttgcggtcaggagttggagaccagcctggccaacatggtgaaaccccatctctacaaaaaatacaaaaattagcccggcgtggtggcgtgtgcttgtaatcccagctactcgtgaggctgcggcaggagaatcgtttgaacccaggaggcagagtttgcagtgagctgagatcgcaccactgcactccagcatgggtgacagagtaagagagaacctgtctcaaaaaaataaaaaaataaaaataaataaataaaacaaataaccaaccatgcacactgcacacacgctgtctccttaaccccactccgtctctcatagacacacacacacacacacacacacacacacacacacacacacggtttccctgtaggagagtcggtttgtcagtttctgtaactttcccagtcatccaactcttatgggccctgcccgctctgcccggtgtgtggcacagtttgtctccacacaggcatctggagagaccagtgggctgcaggaggcagacggagtagctgagatcttagaagccgtcacctacactcaagcctcggtgagtactgggatgctgtgccatgtgatcttgctcagcttttagcaggctgagaattactagagggggcccagagtcctgggtctgacctctttgtttccagacctgtgagcttaatcgttgactcatctgggggggtcaggaaaataatggccaatgggcactttgcaaaatcccctggtgaaccgcaacaccagcttcctcagtgccaccctgtgtgtggccatcagagggctgtcaagggcaaacgctgtgctgtattgctttggagccttgggtaaaaagcctgtggccttaggtaacttactcaaccattctgaacctcaactcctcttccaagaatggtgattctaatagccctatctcatagggttgtttccagggttagatgatgaagtgcagggacaagcctcagcccagcatctggcatgagggaaatggccctgaacgatggctcttgttatatttgctcagtgctccagctgtgaaagcacagtcaggaccccagtcttgtgagtcacagagtcctccagggagctcacttctgacgcatgggaaaggcaatcctaacttccagtggcctggacctcctccctcctgggaatgctccctgtggctgagacatggaagtggttttgaaagcactgagtcagactgtggggacacccaggagcctgtttttaatgaaaacagcaagcagcagcagagtcactaaatacagcagagcttcagccgtctccttgcctggtcgggctactttgtaaacgtatctctaatagaagaaatcagggagatggaaattaggcagtggctggagattacagaccttgggcagcagggctgtgcatgcagcagagctgtggatgcagcagaatagaactagactctgttagcactggaaggacccaaagtcctgtacatctctttctgtacagaggtgtacggaaaactgccctttgtgtacaaactgagcaaaccaaggcccagataggggaagacactgactgaagggtgtatgggccggactggggtaacagcatgagtctcctgatgcccatccatggggtcatggcctgagtggtattgcaaaagtccatcccaaggatggcggccaactcttggccagttgggatgaatgaagtcaagggtccaagttgcctgcctacctggtgattggggagggcaactgctttgggtggtgtggctatcctgtgtgcccatcagcccttggccatcccacaggcatgtcccaacctggggcagtaggacacagagtggccttcacatctgatgctgccctgtgcaccagttcacaattcacagcgaagccaactcaggcaaaggtgccaacagcccaaggttgcccttagagagggacaggaaaggagagtggagtttgagcctgagatgatcacaggggacagaagtagggcagagaagcttgggagggggcaccagagctgggcagctttggacagagatagagaagtgggaggggaaggaagagaactggcatttcttgataccactgtgtacctggtgctattgtgtctggaattggtgggttcttggtctcaccgacttcaagaatgaaaccacggaccctcgcggtgagtgttacagttcttaaaggtagtgtgtctggagtttgttccttctgatatttggatgtgttcagagtttcttccttctggtgggttcctggtctcgctgtcttcaagagtaaagctgcagaccttcgcggtgagtgttacaactcttagggcagtgcctctggagttgtttgttcctcccggtgggttcatggtcttgctggcctcaggagtgaagctgcagacccaccccatgagtgttacagctcataaagtcagtgcggacccaaagacactaacagcgatatttattgcaaagagcaaaagaacaaagcttccacaatgggaaaaggacctcaccaagttgccgctgctcactcaggcagcctgcttttgttcccttatctgaccccccccacatcctgctgattggcccattttacagagagctaattggtccactttacagagagctgattggtccgttttacagagagctgattggtccattttgacagggtgctcattggtgcgtttacaatccctgagctagacacagagtgctgattggtgcatttacaatcctctagctagacacaaaagttctccaagtccccactagattagctagacacagagcactgattggtgcatttacaaaccttgagctagatacagagtgctgattggtgcatttataatcctctagctagacataaaagttctccaagtccccactagattagctagacacagagcactaattggtgcgtttacaaaccttgagctagatacagagtgccgattgatgcatttacaatcctctagctagacataaaagttctccaagtccccactagattagctagacacagagaactaattggtgcgtttacaaaccttgagctagacacagagtgttgattggtgtgtttacaaaccttgagctagacacagagtgttgattggtgtgtttacaaaccttgagctagacacaagagtgctgattggtgtatttacaatcctttagctagacataaaagttctccaagtccccactagattagctagacacagagcactgattggtgcatttacaaaccttgagctagacacagggtgctgattggtgtgtttacaatcctttagctagacataaaagttctccaagtccccacccaactcaggagtccagctggcttcgcctagtggatcccgcacgagggcagcaggtggagcggcctgccagtcccacgctgcctcctcagcccttggatggtcgatgggaacagccgccgcagagcagggggcggtccccgtcagggaggcttgggccatgtgggagcccactgccagggggctcgggcatggcaggctgcaggtcccaagccctgccctgcgggaaggcggctgaggcccagtgagaattcgagagcagtgcgggccggtcggcagtgctgggggacccggcacaccctctgcagctgctggcctgggtgctaagcccctcactgcccagggtcggtggcaccggctggccgcttagagtgcggggcccgccgagcccacgcctacttggaactctcactggcccgcaagcgctgcacgcagccctggttcctgcccacacgtctctctccacacctccccacaagcagagggagccggcttcagcctctgccaacccagagaggggctcccacagtgcagtggtgggctgaagggctcctcaggtgtggccagagtggacgccaaggccgaggaggcactgagggcgagcgagggccgccagcacgttgtcaattctcgctattgtatgcatgatttcacttttgtttcttgccaccctgcaaggtaggtggcatcagccccattgtgcagattcaaaaatgaatgcccaggaggtggggtgcctcttccagggtcacagggtagtgaagtcaggactcaagccaggcctcactccccaggcttggaccctccccaggaccatggcactgcaggcactggggcagatgtggggcacgtgtcagccaaggggggctatgaaatcaatccccagactatctggaaaagtgaaaaagaaaaagttgttggtgatttgatggacttggtggcctctggggaacctctaacactttctttccatgcttccccaacccaacttttctcagtggttttatgggaactggtgcatatcagagttccaccaagcgtgaatcccagctctgccacttactagctcttgaccttgagcaagtgacttaagctctccaaggctcagtttcctccttggttacaatagagtggacctgcctcatagggtcagtgtgaaaattagacaaattgccctgtgcaaaatgcttggacagtgcctgttgttgctactgttgaccagtgggtttgttgtgaggattaagggaggtgatgtgatgtgtcagagagcagctcagtgctggactcagcaccgggcatagtacagatgcctcgttcctcttggggcctcctggttggccagtggcttgggctgacaggcatgccaaacccctgtggctgccttcagttattaaggggattgccctgggctgtgcctcgaggcctgatggtcctgaccttaacctgtctgttcctgatcatcagaatgccttccctgtgcacccgtctgtctgcaccacagttcacgctcttccacatgcttccatttcctttagtctcatttgcagggaggtgtttggggtctcttctacataggagggcactgaggccatggagatggttgctggaggcacccagcctggaggtggcagagccaggtctccagctcagggtccagagtgcactcagtcatgccacccctgagctggggacttcccccttttaacatctcctggaagggctttatggcattttccggcagccaccctctaggacggggaatttccctcttcagctcagacagtccccgcccgccccttgtctgtctaacttctttcttggaatgaatctcacttccccatcctcagcctttccagcctgccaccctttgagacatgagccgtcgccagtgaactgaattgcagactttctgagtggtcagggactacaaagtctgcccctccttgccttcttccccatttaggattggggtccttgctatccaattctttgcattttcagaaagttctatgctgttggaattaacatccctgtggttctcagccctggctgtgcatcagggtcatttgtgtgtaagtgtgtgttgggggtgggggtggcatggggggttggggaggcactgtgttggggggattggtctttaaaagcagattcttgcctgggctgtagacctggatgttcagcttcagtagatctggagtgaaagatcctagaatctgtattgacaaaaagctctgcaggtgattctggtcctcagccagggcctctttcccaaccacacccagatgctcacagttctctggacagaccgagcactttctcccctccatggcgccttagttcctgcggttctgtttgcctggagggcccctcccagctcccatttctgcctggcaagttcctacttagccttcaggatccagtccacatcctctccttggaggccattatttagctaagccccctcctcgcacttggctctcactcacgccatcccatgcatcactccgaatcatggtttgttgcgtctggtctaggtctggggatcctccatcacctgacagcttgaggacagacacgctgtcttagttattcatttctgtgtccccagggctcagccaaggacctagcacacggtagggcctctggaaatatgtgcagaatgagtaaatctgattgtgtggacgtgagcctggactcagcaaattgcaacacttttaatagcaagtcttcagacttgaggttcctattttgtcacaggccacactggatccccattcacattgacctctgaaaaccaaagccacctatttgaggcaggtccccttaccctcactcctgagggtcaattcaccagaaccatgccctgtccttgcaggggggttgggatgccttgttgggagtttgacaacttcagccaccctgagttacagagctcagcccccatctcgttgtcttcctatgtttcctgaaccctcacctgccctgcccgcctcatcccaaagtccaaatgccttatagagcacctttgctaccagccaccagcagcctcactccagactagagatgagcattcaggggcttgagcattggttcctgaacaagtgatggagtggcttctgccttgatccctcacagggagaggagaggaacctcctgggcaggggtctttatcttccctgctagatgaacatccatctgggtgaaatggagacatcccacctggtcttgttcacaacctcccctggggaggtgcctgctgtctgctcccactgctgccctggttcctgtcttgtggacttctttactgccaccccccagtcacctggcgtaagcctcagctcccctagtccatgatcacactgccaccagcgaggactctctaaaacacacagctgcccccaccactccctctcccgatgctccccagtggctgcctgtggcccttgggttcaagcccattcttctccccacagaaccagctcctccctctgcctgcctccctgggctctgttccactgcttccctcctcaagccctgggctcttgccaagctcaagttgccaggccctgactttcatcaaccctccacccctgtgttctgaaaccctgctcattctccaaggcccaactccttaaagcctttcctcccacctccaccctgaagattttacagtacaatagaatccatggtgattgtctctgggtgttaggactcaaggtgatttctctttttgctcatctgtacttacagtgttttcaataacaaatatggaatatttatgtactaaatataaaggtgtgcttagcccttccatgcattttctatttcctgccttcaagtagttctttattgtcctcatttttacagaggaggaagctgaggttcagtgaagctccatgacttgcccaacataactaagcttataagtggagagctgggatttgatccaggtctgactgtaagaaatgaactattaaattctaaatgatggggcttccaagaatcctccttgttccatggaccagaaattttttgatttactagattctgaattaaggaaataaccttctgttattagtcaggaaaggtaagtgatgctgcagtaacaaattaacctcaaaaatcttagtgccttacaaaacaaagattggtttcttgttcataccacgagttcaacactgattcacaggattcttccatgcacccccagcccctttagcttagaaagtgatgaggctatctgaatgctgacaagcgctgggtcccgcgagctgctgcttgggtccaggggtgatgctgtgacttttggagcccatgctaggatttctgcgtagatcactgaagcactctgtgtttctgttggggttttgtttgtttgcttttctctagttggtaatgttggttaagacactgactggctttggaaaagctatatagatgctgaagtttcctcggaaggaaccacacccgtctttcattttcataggtgttttcatatctggcattgaatttatatgcagtttattgagtgcagcctggttcattcatttgttcactaattcattcaatcattccctcctctaacagatctttactgggcacctcctctggctgacctgggatttgggaatcacagaaatgtggtccctgtgctcagagagctttggctgagatgaatagtctcactgtcaagtgaacagaatctaatgacctctagtaggcacctctttcaggccctgggaggtgcagccattgcccaggtagacaccaagtggggccaagctttccccttggtttattcagcatcttgtggatatattattttcttcagtgatattctctgtcatttcttctgctttactgccaagtaaatcattttgcatctcatttttcctcccttcagcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaaggcaagtccggatgcacatgcctacgtagtggccttttattgggtgattactatgtgtccagccggggccatgtatgtaacatacagaatctcatttaaccttcccctcaaccctttaagaaagggtgagaaccaccctcattttacagacaagaggaggaaattgagccacagagaagttaagtaacccagccaggagcaaacagcttgtgaatggcagagctggcatttgagctcagatagcagatcttctaacccccagatctggagcttctaactcccagattctattccttctggggtttaacagaaaagtttgtaataatccttgctctttgttgaatacctacagtgtgccaagtgtttggatattttgtctccaacaccgacagcataccgcctactcagtagcactagccactattttataggtggaaaaaccaacacttggaagagctaagtccagagtccccacccattctgacttttgccacaaactccccaactctcagaggatcagctaaactcctgtgtggcacaagtgagaaactgatggccagagaggggccagttacccagcaaggcagcagcagtccctaggagaagagctggtcccctggctgcccatccagggctctggcccctgcctcttgtccccctacctgtgcagaggagcactggtaaaagcccaggcgtcaaacactatcccccaggcactagcttggcatatgcccaagccctgagatcgcttgtggtttctgtcatttctcagaggggccgtcacttcagactgaagatgtaagtacaagatcattcctggcagcactgttcttaggaacaaaaataacccaaactgcccacagtagggattggtcggccaaattctatttcattcatacatacagccctgacactggtgatacagaagatttaatgacccagggacatgctcgtggtatattccaccaaaaaagcaaattccaaaattatgtctatgaccctaattttgaatatatgttatttatatctatttacatatagctatgtagagcgatgtgtgtgtattagatacatcacatattagacgtaatattcatcaaaatgttataagcagttatctctgagtggtaggattatggatggtttttactttttttattgtacttccgtattttattaatacaagtcttctacaataatacatatcactattctttttgcttctgccatcagttaatgagtgttattttaacaactaaatttggggagtctgtgggtcagagaaagtatagagaactggagagaaaaaattgtaggataatttaataacgtcatgacagagccaaggaggcagggtgttgctgtggaaatactgcccgctggggagagtcagacagcttggaaggaggccctgcctagccccctatttgctgtcggcctggggcaagttgctgatcagtttccaagcttcagattccttagccgtcctctgggagcatgaacaatccccgatgctgggtggatgagagggctgaatctggccgcagttgtggaagtggcttctgaattgcgaatgcttttctcaggggtggaattaggatctctcagcaaggggttaaggtgaaggggctggggcgagggctttcctagactgagaagatgaggtccacgtggggactgggctctgatcccaacgcagctcgcctgttcccgggatcagccacactccttatctagcagacaaaaggtcagttgaaagcaatggagctagccaaagtgtccttttcttcttgatgtgtagacagcccggatggtgggagaaagccctggctaagcaaagcccctaatatttgcattcagagcttccctgacaccatcgtgacccgtggaaggggccaccccacctccttcttcccaggggtcagtccttggaggacaggcaatcggctgcttgcacggcaccccctggtggtcagagcagggaagacgagagtgctcgacccgtgctggccactcttccatcacaggatgggacaggagtgggtggggaggggggcagagtcctttggaggatttggcacctcttccagagttattgtgaccatgggacctgcgtgagcacagcgtgtgtgggaagggcctggcccggggacaggctgacctggcttcagggcccttcccagtctcagtctcattcccagggttaataatactgaggtattgatgtgtggatccggcaggtcacacctgtcatggggtgatagtgggatccccaaccaggatctgcccacctgcaggaaggtggtgggaggggtcccggtgggcaggacaggtgggccagcaggagggttgctggagggagtgcatgggacaatcttggcatgggcccagccataacaggcgtgcagtcatggtagtacaacttctttttcttcttcttcttcttctttttttttttttttagacagggtcttgctctgtcacccaggctggagcacagtggcacaatcatggctcactgcagccttgacctcccaggcatgagctccctccttaggctcctgagcagctgggtctacagccacatgccacaatgcctggctatttttttttatttttagtagagatggggtctcgctatgttgccaagactggtcatgaactcctgagctcaaatgatcctcctgccttggcctcccaaaatactgggattacaggcatgagccaccatgcccggccaatgaataagttttctttgcttcaaaaatccatttgcgtttttttttttttttgagatggaatctcactctgtcacccaggctggagtgcagtggcacaatctcagcttactacaacctctgcccactgcaacctctgcctcctgggttcaagtgattctcctgccttggcctcccaagtagctggggttacaggcatgtggaatcacacctggctaatttttgtatttttagtagagatggggtttcaccatgttggccaggctggtcttgaactcctgacctcaagtgatctgcccacctcggcctcccaaagtgctgggattccgggctgctttttaaattgcaaaagaaatatatgcatgtgggaacaattaaattaatgctcagttgtataaaccagaaaaataatagtttcctcttcttacactcctatcttctggaaaatatcagtactaaacactgtggtttagccaagtatataaatatataagcacatacatatacatatacatatacatatatgtatatattatgtatgtcataatcattattacataacatgaatatgttatatatataataatgatacgatatctatactcatactttttttttctattttacacacgtaaaaccatatcaacaatgaacatttatcaattgcttactatatgccaggggctgtcctcaatgctttatttgcattaacttacttagtccttgtgacacacagtactcaaaacaaccctatgaggtaggaattattgtaattccccatttctagataaggaacttgaggcagaagttgagcgacttgcctgcaggtggtgccagagcctggaatggaaaccacacatgctttgccatgtatgttgttctgcaacttgttttttccccctcttgaccctgtgtcatggtatctgaacatctttccaagttagctggtgaagagatacctcattcttttccaagactgcaaaatgtagttattgatagcagaatgcctgcttcctgtagggtctggtgagatcctgaatgacacactggagggggttcattctgtggatggtgaccccattactgacagcggctcaggggctggggccttccttgacattgctgaagaaaaggtgagtagatggtaaatttcatttgattagtcagtagtaggcttgtttgcttatttcaaacttggtgatgattttactgagcaccagagagaaccacaagggttttggttgaatagcatcaagattgcttctgtcctcatggtacagaggaggtcagagtcccagggccacagaggctctccagggatgcacaggactggtgggggatatgcagtgcaagcttgtcctcacacttgcctgtgatgagcgagcgtccaggcctcaccaatgcaaccccgccctcctgctcagttgtgaaggcacatagctttatcagccctttgagtccccttcaagacagaatcagattaactgcaggtgtgttcatgctattgtttggtaattggcttttacacctgcaaagccagtttttgaaatgctgggctccctagggtgcaaaattaaagcataaatagttttctcacaatggcccctgctgaaaacccacaacgccagctcattccttcccttctcctgggatgaaaacttaagacagttctcacagctctctcagtcactatctggtaacagtcaattttcacagatatttaaaagtcaagcccagcataatatcaaaaattcaacaaaattacaaacacagtttccccccttctatactcaggcctactgtagactaggaaactgccaggaaagggaagcatggttaggggtttcctctctattttcttacttctctctcctccttatcctcatgatctccccatcctctagagctatttttaacatctgcaggggctggcccacctggagaaatggacacagttgtacttggctggtcaaattgtgatctgggcttttggtgtggaagatgcctgattgttggaactctctcttatgggggcttttgtggttcctgggaggtcttcctgcaggggacctaggatcaaaattccatagtttgccttgtaacttctgcccaggcttccaccccatacaggttgcccagatcttctgcgtggctctttgagtacagcccatttcagccagctccctttggagagattttatcttgtctatctccagcaaaacaactgcaggacaaatacccctcccttctccatccccctcccctcctctcccctttccctctcacctcctccttccctcctctctccttttattccctcccttcctctcctctcctctcctctccccttttctcccctcccctcctcttcccacttccctccttttctctttctccctcacctccccctcctctcctctccccttcccctctcttcctttgtccctctctcccaactctgaatctaaagggctccctcctttcaccttttgtctccctggagaaaatcagacaccagtccctgagcctcccaaattccaggaaatacatacccagctcaccaaatggtttggagtgagtagaggggaggagaagaaccgcagtacactgaaaattctttccaaaggaattcttgctctccaggcactcaaccccaaaatgagtcctgtatggtttcttacacagcctagaggtaggagatgggcaggagctggtagaacgggtgccatttccttgttttagcatggggagattacctgatgcctgtgaaattgcacttgccctttggggctttagctgacgctgagttagaaagagtctcattttaacatcctgggacctcaactttcctctaactgttttttgagacagtaattctgcaaggatttaatatattttatgaaaaaggggctctgtggtcaaatgactttgggaaatgctgcactctacattcctctttttatagattctgagaaatcctgcagcaaggaaatctttttaactttgattagcctggtgttttttgtaaccaaaagaaccacatttttgcaataaataaacaagctttgggaaatgaagatagaacatagtttgctgtcaccagccccaaagctgctctctctttccatttctcccattgctatgaaaccttcagagaatctgcctgtgcattcccaaaggaaactgagtcacagggagagagaagaagcaggaatgtctctgtctcccagcctagagaaggctgaggaggacagaggtgctgcctacacatttctgaagcatcttcatgggcaaagacattgtctaatgccttctggatgggtacatggggaggtcacagggaggcaatgggtttcagtagaagtatctagagctagaccaggctgactcaggagcagtgatttccgtgttaatggaggtgcaaaccaatactgggaatcaaacaccagacataggtgcctgggcagtctttcccatccctggatttatgaaaccatagatgtgaaagtccttgagagaaagaagctacagaaatgcaggtggctggagaaggctaggcagtctgttctcaccagccacaggcatgttgatgggagcccagagacatggtctcttgtgatgcctttgttttcagaatttagcagcaacagcagcggggctggccgaggtgcccatcagcactgctggagaagcagaggccagcagtgtgcccaccgggggaccaaccctctctatgtccacggagaacccagaggaaggggtcactccagtaagtagctcagagcgcaagctccccttcacctgtgtctggggttgtgggttgtgttgggtgggagcagtcactggctttccctatgtgtctgtgaaacacagtgacagtctcatgggggcagtctgtcggagtaagcactaaatagcattgacccattcagtggcggtgtgcagagccctacactgtgctgggcactaggcctggtttcagggatggatagtaaataggatagacgtgattcctgaagacagggtggtaagaggggctgtggtcagtggtaggtgaagcacaggatgccctgggagcactgaaaaaggggcccagagcccagactcgggggcacagaagtttcctggggaaaggatgctgaaggcgggcctgagagggtaagtagaagtcgcctagcagagggggtggaacaggtgtttcagcaaggtgggctggcaggagcaaaggcctgaagcctgaagaagggcagcatacctgtggggtcaagcgtgagccaggggtcggggagaaatggctggagaggctctaaggacacagagaagattcagcagaagtggggagtcactgaagggtaagaaacaaggaatggatgtagccagattagaattccagaaagatcactctgactactgagaggagaaagggtggggaagcaaacttggagaaagaggccgggcttgggggctgtgttggagtttgggtgagtggtggtgccagcctgccctgggatgtggccaacaatgtcagatcctcccagaagtcccagtgagcaaggggctgagaaacatccattgaatttgtccattcacggtgagtggccttggggagagcagcttcagggctatcggagcggtggaagccagatggcactgggctaggaagagagtgggacagggagtggtccacgagggtagactactgcttcaacaagaaagctgtggagtctgaggacctagacttttgtttcaacacagtgacttaagcaccagtagaagctgcactctctgattaggggacacagcttggaagggctattggtgagcacatgcccctcggggttggcagggagtggctggtggcacaccacacgggtgggatgctggggtggtctcgcagcatgagtggtgtgaggaaccaggcttccatatttctgtctgatgtctcactgtgggtttccatgtgaagtgaggtcttggtgtgcaggtgctttgaggggccctggccttctgttccttaccacagtgtggtggatcagcatcatggggcactgacgcggttcctgttgactttctattcagggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtggtaaggatcgtacagtgcccaaaggttgaggtcatggtgggagcagctcctgaccttctcagagtgtggggctcctgctcagcaaacccatgggagcctgaggcacggggatctctgaccaaatactcacttgggggtggagtttgccaaggcctgggtgagtgtggtgaagcccctggaggtcagtgagcagctgggccctggggatgggtgagttgcagaggtggggtttgtcccaaggctgcatgcaggaccctgctgcctccacccacagggggtgggagccagaatggaggagtggcgggctcctggagggcgatgggggatcaggcagcaggcggcaggccccagcaagggtcagagggcacggccaggccttcctagccctctcctcgtgcagcgcacagacactgtccagctcctgaaggcagggcacatcatcccaaggcacttggccagtctgtccctgtgctgtctctactatgggtgccctcaagttcttccagctcagctgattcaaacctgaactcctcctttccactcctcctatgttcccacctcaaatgaatgggaccatcatcctccagtcacctaatccagaattttcttctctcttccttaagttctatatcccatcaagcatcaagtcttgttgatttttctgcccaaacacatcatgaatcgccggctctgtcctcctccaatgctggcccctgtgctgagcctgccgtgtccccagcccgggcaattgctaagagccctgtctggcctcctccatcctctcacagcttgtctccagtctttcagccccacttcttggaagcttcccatcgcccttccctgcagacccagctcccatacctggcctgagagcccttgcagggtctggcctacctagccttgctgaccacctcttgggcccgtcctctctgcctctcagcagcacttcagccacactgacctttttctagtttctccatcatgcctctcttcctcatacctcttccctcatcatgcctcataccctcttctctctgctgagaacctttctcccttctctcctccttttaattctagcttatcctttagaattcagctcaaacaccacttcctcaagaagatgtcattccagactgtgaactctccccattcttgtcctcaaaaggcctcatcatcattgtagttgataatgaacttggcaaatagttcatgtctggctccctaccagaatgtaagctctgctagaacagagattactgatacaatattttgttcattgacatacttcattcctgaccaatgataggcactgaatgagtatctgctgagtgagtgaatggctggggtcatcaggacatcacagatcaacaacgccggcctttgatgtcattgcacacacttgtgcccctggtctgtctgtgctggtcaggcagccttcagccttttagcatccatgctgggagaccttgcagtgtggctgggggtggaggtgggggacatgcactgatggtgccacaggccactgggcagttatatggattctttcagtgaacaaagtggctgtctccttctccttcttcttcctcttccagttgccctttcctttctcctcctcttcttctccacctcccctccctttccctgtcttcccctttctttaatgtctaggcacttacgacagagtgggaaagccagggatcaggttctaccaagtcctagcttaatagaaactagaatttgaccagcagggttgtctgaagatagaagggctatctgtagaggtggtgaggtcctagttactggaggtgtatcagctgtaaagcaaagagtatttgaaacaagtctcagtcaattttggaagtttattttgccagggttaaggatgcacctgtgacacagcctcaggaggtcctgacaacatgtgcccaaggtggttggggcacagcttggttttgtgcattttagggagacatgagacatcaatcaatatatgtaaggtgtacattggttcggtccagaaaagcaggacaactcaaagtagggagggggcttccatgtcataggtagataagagacaaacgcttgcattctttcaagtttctgattagcctttccaaaggaagcaatcagatatgcatttatctcagtgagcagagggatgactttgagttctgtctgtcctttgtctgtaaggaatttccttaaggacaaattgtgagggaggtatgtacctttcttatcttagtagataccttttaaaggaatagcatgggaggccgttttgccctaagcaatttccattttcatttttccctttggcttagtgattttgggggtcctgagatttattttcctttcacatttccccctttttaaaatctttcagataaagcattttaaagaaaatgagtctctagtttcaggtttagttgatttctcatggctaggagggtttattcctagacaggtaggtcccatgttattaggaaagttcacttttatcaggctgtgaagtctcatgccctacaagagaaaatagcgggagggagaaaaacaacaaataaaaaaagaagaacaatcctggaaaattgatataggtcatattactctgaagtccatacatcagtaggcaggtatgaaagtggcttattatgtaaataggttgctgttattttcctctgaagtttaagttgtctagcttcagtttgcagggctttaagaaagcatggcttaattttagtgatttcaaaaatggggaaaaaatggaaaagaagaagaagaaaaaaatttgaaaacattattatggagacttgtagccagtacaaattttagaattcagtccaaactgtagaaaataataaaaattgaaaaacattaggcaagaccaaaatctaacaacaggtgttctatagtttattttaaaacataagttttctctttccagtcccattttcactaaagaaaaatcataggacaatttcatttgcaaattaagttttagtcttattatacttggcctgagtatttgcataaagtcagcaaaaatagttatttgccatataggctcctctttttttttaattgactttgctggagctttattccataaagaatctcagatttgactttaaggccttaaggacagcccatgcctgcaaatacctgtattaattgggtgaaggcctcaccttgaggtctcaagaaaacttggggctcctggacctgtcagaaagtgacattctttacttaccacaggtcaggaacctgtacagagattgtgtagacaaggtatgaggccagctttcccaagggcttttattggctctataaatcaactttggttccttaaaggagtctgtatctgatagcatgccattccagtcaaaaccatggtaaaataaccagtgtctccagctgtgctctgttacaaaagaaaacagattgttatcacacttacacaaataactatattgtaagttaagaatactcacaactaattaccaaatttttggagagatcaggtagaaatatgctccaaattttgtttatatgagtatattttactcatttttttttgaggctgagtttctctcttgtctcccaggctggaatgcagtggcatgatcttggctcactgcaacctctgcctcctggattcaagtgattctcatggctcagcctcccaagtagctgggattacaggcatgtgccaccacccctggctaatttttgtatttttagtagagatggggtttcaccatgttggtcaggctggtctcaaactcctgacctcagatgatccacctgcctcagcctcccaaagtgctgggattacaggcatgagccactgcgcctggctactcaattgttaaaagctgtaaatagctcaaaagaaaagttttcttggctccgataaacaaacaaaaaaaggatcagcaatgttttaagcaaaaagttataaaaggattttcagtcttctaaaagtccacagttaactcctgttctgcatgttattcatgaacatttcagctcttcatgggagccttggaagttttttctctattctaacattacaatcttcaaaacttgcattgaagagcacctatcagagtcctatgccgattataaaaccaccttttgaaagggataaaagcaaaacaactgtggatgacaaaagtgttgaaacagtcatagttaaagacacaattgacaaggaaacttggttacttctgtggcatacagcaattttacataataattactactgataaaatatgctaaaacatatcagaatcacaggaatttcatacaactctgagcacatactaataacacatttatgtaaatataatccaaagaaggttaaacactgtttcatatttgaaaatacttcctgtatgattttattatatcgaataagccaaatatgtctcttttggacttcaggggaataatagctcagaagaaaagctttcttggttctgaaaatcaaaaaattaatgggacctaagttagaatttgactttggaaattttgtcaaatataaaaagtataaaacacttgatatcacaaaataggatcacaggtcattgtaaaataagtcattcatttagccaaagtgatacctcaaagagttaaaaaaaaaggcaaaaatatttattctttgattgaagagattgatttctcaaacaattagccctaataaaaacaacaggaggccaattaaatttgtttttcaaaaatttttaaacaatctataaaattttaatcatcttgaccataagatataatttccataagcctttttataacctttataacctttattaaggagtgggttaatgctccaagaaaaccttgttaatctgacacaggggccaatatgctggtcttgcatcagcatgcctttgacattaatggttaatttatagagaaactaaacttattttatctctcaaaatctgcccttataatctcatgtgcccacctcttctgcagtagtctttggaccttgaggagttgaatagctttaatttttggcgctatgtctcacgaacgcagtttattttggttgacatcttctacaggatctgtaggtgaggctttaactgctgtcagtgtttaagatttagcaggacttggtgtccttcttagacccaggaatcaaagccctgtaacttaatggcacaagtactttaaaagcacatacagaaatgtagagcacctgattctgtcactgttctgggcaccactatgtaacctgccatgatccctggtggactgaacaaatgggggcaaatgtgggaataaaagacaagagacaaaagagtatatttggaagaaggggtcaggggaaacttgcctcttgtggacaagggccctgagctttacacagccctccatatttattaggcaaaagagacagtgagaaggggagtggaagaaggggtcagctgcttagtccagagtaggcttgcaagactgcattcctcaaacaacaggctctagatgttgcagtagataacctcggcacccgggagtgattgcctccagcaaaccttctgtcggcgggaacacttgtgagtttgctcacatcctgcattcatgataaacagtttgctgttcgatcatatagcctccagtggaatgctgagttggtcacgtcccatgggccttcggctcccttcacagaaagttatatggacgtaataaccttaattaaaaaaaatattctttttgttaatctgcatcttttctaagcaaacgaaaacttagtaataatgacataggaattatttagataaagtgtaagatctgtttattaggccagttacccaaaggcaaaagaaaagaccttctgcagtgcgactgctgttctctatggggaatattatattggaagaaaatactccttttagatctttaagataaaacatttttttagcatcaggccacaacatttataaccagaggaaaaaaaatcttacaggagctgaaaatgagttgaagattagttattatttcaggccttttaaaaggcgagagaaaacagaaaagagcaagatgcaataaaagtcgaactttgtgtaaaaaaattataatgccttgtaatttattaagagtaaagcaataccttaagaaaattttgtagttcaaaccaattctttagtgtataagtggttttttaaaaatcaaaacccaatctctggaaagaccattttaaataatttccctttaattgtagacaacttgctcatatgaaagctttttttttcatctgtcttcttcttatgatgtaaacagaccatttctgacatgcttggactttctagttttcctgagcatccctctttctgaaaaaaaaaaaaaaaaaagtcattttattctaggacaaaatttaccataaaagattctttcttgtataaaattatttttctttaagctttcttaccaaaattacctctttatttctataactttctttacatctctctcatttcctgattcccttcactttgttttatacataacctttaaataagctttgaatgagacaaaaattattcaccttttaaaaaacacacttttttttagaaagaatgttttcttacaatatattttttaattggaatatacccaactaatgaaatatctattatttaatttaactttagattctaaattatgacacatttgtctataagtatttatcccattacatttacctaattatttttaatactgtacctagattactgtatttatgaaaactgcaatagtcattatttaaagttatttccctgccaaccattttatagcctgtgaatttcaggtgtttatctaagtagaaccttaagattaaatatatggttattttactaaatcaagatttagctattttcattaaactaatgttcttgtcttatttatcagacagtacacaagcaaaggttatcctgttttgggctgagtttatagttttgtaacccttgtgccaaattttgacaccttatagtatttggcagggataagtatgaaattgcttgatcaataaatgcaaacaaaaatgtatgctggcaattcttaagacatttctaatattgctttaccagtaattttaaaactagcttattaaagacttaagtcgtgtgaacttgaaaagcatttgggtttatcatttaatttatgagtactctttaagccattgtcataccttgtagcgaaaaacacaacaaaatgtgtatgtacacataaacacacacatacatactcatacaaccaaaaatcctatagcttttacttcagaactctagccatgaaatattaatacaaacacattgtcctgcagaaacaataacaaaaataaatgtctggatgcaaacagtggattttatctcaggagaaatgtaacagcagacttaaagcaggcagaggcagagaagaaagcagagagatagagaacttaggaactttatagttgcagatcgacttttgggctctgaatttttcttgctgtaattgtgcatgaaaataccatatatgttcattttacaaaaatacttgcaagaagaggcaccataaaaccaacagagtgcctgaaagagggtcattctccttgtttttccttattcttagattatttgtttcccacccttttttttttttttttttttttttttgagacggagtctccctctattgcccaggctggagtgcaatggtacaatctcggctcactgcaacctccacctcctgggttcaagtgattctcctgcctcagcgtcttgagtagctgggactacaggtgcgtgccaccatgcccagctagtttttttgtatttttagtagagacaggttttcaccatgttggccaggctggtctcgaactcctgacttcatgatccctcccaaagtgctgagactacaggcatgaaccaccgtgcccggccttttttatttatttattttttattttaagggacgaactgagctgtggcctagcattttagtggagtgtgtcaaagtgtgctggttgcgggtgagactctacagtgtgtcaccactgagccatttccaccctcttacgtgtctcagtttctctctgtgtagttctagcacctccaagaggctcaaaatcaaaatgcagggtgaccagctcctatatgcacttcctgaatgaggctttttaaactaattttgttgggggttccctgtagggttgctgcatgtcatgggggggtcaaccccccaagacactcccacttgccctccagtcacccaggggcacctttcagctgggaggtgcaaaatgccctttctctttgaagctgaggaaactcattctcccatttatctgtgaaaacaatagttcaattcctcatgcaaaatgctcacactagccaattgagattaatttcaggaggaaaggcaatggagaagacaccctttagaatgtacctctgaactagaattagggtcctaaacaataacttcctaggagaaaaaaaaaaaaaaacagctaagaccacttcctgtaaattgtcctcagccacctctaactttgtactctcatccaccattatacacactaaggtcaaatcctctcccggtataaggtaatctctggtacccccaaaagccaaagaggtcaggtcttacaatacaggagagcagagcttcagacctaagaagaatctgctcatgactcttgaaactccacaaagaaaatggaacaccccaaaaaggggcgggtggtgcctttgttctgaatactttaaggggtttgagtcattggaagcctcctctaggtttttattggtactaaagatagtgaagggggaaggaggtatagggcggaagaaaagtaaacgaaagaaaaaaagtttttaagacaggaagcaaggatagcaaacgtgcatgttgtgtttttttttcccctctcttgcagctgtgagaaattttagccaattcagagaggtcttgttacccataatttagaattctcattcagatttgaccaagtcaggtagagctggtcaaatctgatgggagaaagatcagaacaacaaccaaaaaaaccctaacaacatgattactgagcactttaatagtaaggagaaattaggaacagctggttgttaatcttaacttcagctaagacaaaaccccaattcagctacttactagagataggtcttaggcagaagattgctctctaccatcctagaagcaggaaagaatttaaacttgccttccctgttagaaatgagctcaaactccagaaaggagttaggtgccttccatcatcctagaagcaggaaaacttgcattccttgttggaagcaagtaagactgcaaaaaaagaattgtacagcaaaataaactttagaacttgaccaaattttgggagatcagggattctctggaggggaggctcctaggcctcagcaaattgtcctattggtttgaaccataaagaaagctcaagctggtatcaagcaccgatatgagatttgtcaaaggtcagtggcacctccactcagaatcccttcttggttgccaaaatgtgaaccccaaatatctgagacaggtctcaggaaagttaggtagtttattttgcaaaggtcaaagacatgcccgtgacacagcctcaggagatcctgacaacatgtgcccaaggtggttggagcacagcttggttttatgcattttagggagacatgagacatcaatcagtatatataaggtgtacatttgtgctgtccagaaatgcaggacaactcaaagtggggagggggcttccatgtcataggtagataaaagacaaatgattgcattcttttgagtttctgattagcctttccaaaggaagcaatcagatatgcatttatctccgtgagcagaggggtgactttgagttccatctgtcctttgtctgcaaggaatttccttatggacaaattattagggaagtatgtagcttttttttatcttagtagctatctttttaagggctagaatgggagacagatttgccctaagtagttcccagcttgatttttttttccctttggcttattgatttggggatcctgagatttattttcctttcacaaagctaaggccagagaagtgcttagcagagatgtgctagaagggactctggggtgggtgggaggatgccctgaaaggtacgttctaatgctggagctccaggcgaaggtgtggtcctggaggagcaaaggaaagggaatcatggagcctccagttatctgaggctttagcgctttccaccccccagcctcacacccactgaaccaggggcatgggcgaaggggcacagctcctcatgccaatttcatttcagggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctgtaagtgtcatcttgtgtcctctctggctcacaggggagagacaggtctgcatcatgcgacaacagtcatccttggccttggcaggggcacctgtagcttggttatgagcacatgtctgggtgggcagctgctggagggaggcaggacacaatgctggagtgtagcagaggccacagccctgctccctcctagccttgcccaagaatttactcagagacaagtggtccacagttggcactgaggcttagaagagatgcatatttcagaaggggtgtgctgggggtaacgatgatcgtaggtaagaacgtgctttgaaactgggctggcaccacagaaacgactgttacaactccctggcagcctcatgagcgaggtgaggtggtgccttaatgctggttttgttttcagggtcctggtgatgaagaagacttggcagcagccacaacagaggagcccctcatcacagctgggggtgaagagtccggcagccctccccctgatgggccaccgctgcccctgcccacagtggctcctgaaagatggatcactccagtaagtggcatagagctgtaagatttgacttggcagaccttacaggggagagaaagaaaggccagagttgtgggaagggctggcccccagctttctcagaggtaggttttcatgttggtttgcaaatttgggcatttgaggagctttaacctgaggaaagcttgaggaaactccagatcatagagaaaaagcaagagattaaagtcaaggggacctagctttgtgtcccaaactgatctttggattgaaatgagatctaacagtcagtgttcttctggggacaaagttgacagtaagacgtggcgggtctgtagaggggatgagagcatcagtgctgtgtgtgtgttgggggtgacctccaagtccctgccaacatgagtttttatgactcttggctacaactgtgtgaccttaagcaaatccgttgatttctttggccctccgtttcctcatctgtgaaaatgagtggctgcaaggccaagtcagagaatgaatgcaggttggagaacgtttacaaagctctgtacccacacctagggttgtcaccacttaaggactataactgtgtctcttagaaataggaaacccagacctggccctcagcttgggcttgtgtgaagagggactgctcttccaatgtgaacacatttttaaaggaaaatatctccttggtgatcagcattggctcatcagttccccaaacaccacttggtcatgcacactttgaaagccaccactcaagctacagtcatgtggcccattggccacggtgcggcaggactgacctgtgaggggaggggctgtgggacgggagatcaggacagccccctgaggtcctgaatgccccttgctccggggcctcctatagcggttatcacgctgcttcctgtctctttagagttgtcttgcattcattcgttgattcactcattgactggacacatagcggctctgggccctcagtcaggacacttgtagatagagatgaatgtgacctcactcctgtccgcaacaaattcacaatcaagcggcaggaagtaagccatctgaactgacattgattaatcactctgtgctccaagtttacctgattctcttcaccacattcctcttcagtataaggtgaatgggagataagatgtggagaggtaaagtcacctgccactgttgcctgcctctgagaggtagagctgggatttgaacctgcatgctggcctgcaaagctggagctcttgagcttcacccagctgaagtcctcatccatgagagtgtggtgtggtgggaagatcctggactgggggccaggagttcgaggttctgcttccagagatgctgctgacttgttgtaggccctgggcctccttgtcatcatctataaaaggaaaaaaggtgaagaacaactctggtttttaactctggtcacgcattagagatggctgggaagcttaaaacaatgcaggtgtctgagtccagtgctagaccaagtaactgagacactggggctggggctttgggcttgcagggcatctagtgggcagccagctctggattgacccgctcatgcactgtgacttcccaaacaatgtccccctgctcttctgcacctcaccccaaggtatacacaaagcaccaagttcaaatctccctagtgatgccacatcgggcacagatagagccggttctcctgtttctttctctttttaacgttttattattgaaaacctaaaaatgtcacaaaggagcttagacaaaggagcttagaatagtataattaacccccacatacccatcgttcagtttggataattatcaacactgacaatcttgcttcatctgttccacctcctaccaccatcttttttggagagaaggggaatactggagtattcaaaaatcaaccccaaacatcctatcatttatttaactggtaaataattcaatgtgtatggctgatagagtgatctggtacctttgttttggtcatagccatagtatcacgatgcatctaacaaaatgagcaggggttccttcgtattatctaatgccctggctattttgttttaaaatacctctttccagtttgtttgactctgaatccaaacaaggtctacacattgcatttggttgatacgtctcttaagtgtctcttaatctctaattgtctcccgccttctttttcccttttgccattaatctgttgaagaaactgggtcagtttcttccttagacccttgatgttttcagctttgagaagtcagtctggtaaggctggctgtgctcatgggagtgtgagggttactgctcctgggaagctctttgtccacatatattaacaatcataagagcgcatattgctgaccagaaacttctcttctaggaattgattctagtggagatagtctgatagcctttgttgttgccgctttttaaaaaaaggctttgtttacaaggatgctaatctcagtgttgtccataatagagaaaaattgggcataatttaattagccaacaatagaagattaattgaattaaagtatattcaaacaatggaacattatgtagctaataaaattatacctgttagaaatatttaatgatgggggaaatgcttagcatataatgttaagtgaaagaagctggttgtaaacctagtatattgtgtggttaactatttaaaaatacacacatgcaaaaacactagaaggaaataccctctgtaaatgttggcagctgttgcctcaaagtggtggaactgtggaaggttgttaggtttttaatacattgtggtttaatacattttctactatggtggcttacaatttttatgatagattttttaaagctctgagaaggaagagagagagagagagacagacacagagagagttagagatagaataagagagagaaacggagacatggttgatgtctgatgaagacattcctgctaagtccccacgttagggatctgcaatgaactcagatgaatgccccgattcctgagcagagtctaaaagcacaagattgtcaagaaggcacccaccttgggatatctctaggatcagtttttttgtttctgtttttgttttcttgagacagggcctcactctcttgcccagactagagtgcagtggcgtgatctcggcttactgcaacctccgcctcttaggctcaagcgattctcctgcctcagcctgcagagtagctgggattacagacagacatgtgccgctactacccggctaatttttttgtttgcttatttgtttgtttttagtggagacaggatttcaccatgttggccatgctggtcttgaactcctgacctcagatgattcacctgcctcagcctcccaaagtgctgggattacaggcgtgagccgctgcacccgtcctctaggatcagtattggcccagcctctaggatcagtattggcagatatgtgacagagccaggcatgctatactgccatggtgactctaggtcagtttgaatctcagagtcaccatgacagtatagcttgcctggctctgctacatatctgtggccagttttcttcacttctctctgtcacagttgactcatgcatcaaatgggaatcataatcttagaacctacctcttgatttgtgaggattaaatgagttcatccatggaaaacatgacccagcacatagtacatgctcaataaattagctgtctagaattattttgcagatgaggcccagaaaggattagagctttgctcctaggggtccagtaggagtgagagcctttgtctctggattttttagtgctttggttttctgcactgtttacaaccactgtcttcagacgggagccagaagttgattagcaaagcccacactggtcacaatgatgtcattacatttctaaggactgactaatagatcttaacaaatatatggagaatgttgccctggaaatgaagtaatatatttaaaaatctgtgttgtggaacacaagtgagagagaagactgattgtcaggtgtgggtgactccaaatgccaggctcttcccactagtcatttggcaaataggtactgagagcttattatctgccggtgcaggggatggtgcagtgatcaggcagcctctctcttcatggggctcactgacttcagcccagtacaagccctagctcatgcccagctcactgaccaggaccagggaatgtcatcggaactcagcagccccatgtcccaaatatgttgtggccacgttttaaccaaatcttcttcttttaggctcaaagagaacatgtgggaatgaaaggacaggctgggcccaaaggagaaaaggtttgtgctgtgaccatcctggggaacactttggctcctgatcaagtgtcctgaacatgttatttaggtttgatttagcccactctgatcaaggggatcgcagaagcagcaagagggctaagcccaaaagaaatggacttgtaggtctgggagaatcaggaaaagggcactgggcagttctgactgagtctcttctcaccacctggtgaccgtggccaagtcccttgacctccgtgggccttggcttctctgtcgagtatcaaagggtcctatgattccacacctggctctgccacacatctgcaaccagttttcttcacttctgtgtccgggctctgggctctgcccctgattttcttcctgggaaaatgttgggcagacaagagcttttgaggaccacaggcctaggtttgcctttttgtagctgtgggatctcccgaaagttctttactatttctttgctccagtttctccatctgtaaaatggaggtggtgatgatgaccctgcggtgtgggatgacgtgaggggatgtttatagaagtgctttagctggtgtcagtcactgcgggaataacaaattcctcttaccaaaacacctattggtgataagctgttcccagggggatgtgtccacagtgaccccagtcaagagatcctgcccagggagcctgctctggccataggcagcagcttggctgcctctgggagccttctcatctccaccatgaccctggtcctctgcctgtctcacctccctctgggctgcacagaggccgttccttgcagcagatgatgctcccgtcctggggcctcctgagtgcccaccggggtgtggggaagggagggccagggctggggagggcggtgtcctcacttctctctgcctctggctacctcagtggacttcagatggagcagggctctggggtgtagcaggaggcacacagatttggggactttactgtggacatttcctctctccttttggtggatctggccatcctgtcaccttatttgtcagagaagccacttctctgggccctttttgacagccaaaacctcctgggatgccactctgtcattttctttcatctgcctcttttccaaatgtgtgcttctgtcattcgaaaagcattttctggggcactagccttgtgccaggtgctgggacctggaggtgattcaggcactgtgcctgcccttgaggggcacatggtcccagaggggcagactgtgagcaatgatgttcctgtaaaggtcacacgccctggtgagaggagcaggtgggcagggcaggcttcaggggagtccacactgggcctgagcactgagcactggtgctctagcagggcccagatcagagggtggggataaatcctggaagaagggagggtgtgtgtgatgcgtgctcatactggtcagctctttccaccacagcctgtgccctccaagtatggcacagaaacaaagggcttctgagccctggggtgggacaaggcattcccttaagctgtctctgcaaaggacaatgccatttttctttcctgtgtgatcctgattttaaagatgagcacgatttctacagaaaggtggggagatggtaggaacagagttccagccgttcactgaccattttgttctctttagggtgatgctggggaggagcttcctggccctcctgaaccttctgggcctgttggacccacggtgagattcccatccaggcttgtcacacacacaggtgtaagaccagggatgcggccaaaacagccacaggctgaggactctcctttttggcccccaaagtatcttgcagtcagaccctagggctttctgcctctactaggactctgcagtgtgcagcagcagaactgatttctatccagtttaaatcctgcaccttgagcatcccagaagttcttcaaactcaacacttcccaagctggactcattacccatgccccagacctgcttctcctcctgggttccccatctctgaggatggcaccccatctatgtggtcaccaagagagaaacatccttgagtggtcctctgccttccccagccctgcccagtgtgtccccatgtccccctgagtctagctgtgcagtgcctcctcctcctctcttgggcgatggcaccagcctcctaactggtctctccgcctccatgtcaccacttcccttcccccacacacatgttcccaccactgtgaccttcctaaacacagctgtaacccccaaacccagctcttctgggtgcctctcagggggtgctcagtacacacacattcaatgaatgaattaggccctgcctggttcctgtcttcaggagttaagtgctggaaaggtgttttgaagattccccttgttcttcagatacatttgatgccattcaagtatgcactgagggctctctgggtgctcggcctcctgctggactctgggcacccagtgtgtctcaggtttgggctggctcttgagccctagtttagaggagccgatggacccacgcacaactaagcttcgagtcaggtggtcctagcatctcactgagaccttgacagaggctagtgggagcactgtggagggagagaattctgcctggaaacggggtagggagggcttcgtgtaggaggagactgcggaactgggccttgaaggatgagttgggaattgaaaggcaggaaaggaggccgaggacatgagtgggctgcacagctgggaggcggcaagagagaagggtagctgtagaggggagtgggagaaaagtcagagagaaaacggggagcagaagttatcgggctataggatataggaaacatttccccattttggagaaaactcagtgacgtggctgtccttggagtctggcagttaaatgcaagtagtggaaatttcttctctttccaggcaggagcagaagcagagggctctggcctaggctggggctcggacgtcggctctggctctggtgacctggtgggcagtgagcagctgctgagagtgagtgtgaaggaggacacgacctggtgtctgggactgccttcaaaataaccccagagggagggacgtgggggccagggacagatgaaactggattggctgctgctggggttgccggcagtgagctcatgggggttcattctacttttccttgtgcttgtatatatgtttgaaattgttcactttgatcagttgcattgtaagtgagtacgagcctacatttatcttcaggacctcctcaccccaccttcttcctttccctggtgggcttcttgagcaggctgccctgcagcaggtgtgcccagtgcccttcacctctgccaactggctttcaatcctccctccccctcctctcaccctattcattaaagagacctgctggttttgtctctgggtggctattctacttcagcttccagaaccttcctgaaatctccttcccttatgcattccctccctgcctccctctccaggctactctttctctttggtgcctcttgctcccctggcctcctgccaaggctggagctccaccagtcctttctgaaattgccccctggggagcttctaccttctctagctgcagctggtgcctctgtccctgagagcctgtgctgaatccctggttgaaagctccacttggctgcccctctgcccactcctcatggccagggctagaagggttctggactccgtggttaaatggaatgggagccaaatgaatctcccagcctggtgggatcagccaacccagcaatgggctaaaaacactagtgcacttcagaaagagttttaaaaacaaggctacaccacaagcagttttttttgtttttttttttttttttttttgagatggagtcttgctctgtcgcccaggctggagtgcagtggcgcggtctcggctcactgcaagctccacctcccaggtttacttactccattctccggcctcagcctcccgagtagctgggactacaggtgccggccaccacgcccggctaattttttgtatttttagtagagacagggtttcaccatgttagctggggtggtcttgatctcctgaccttgtgatctgtcctgactgacctcacagttaatcagaaaactaagttcaccagagcacctctcagaattccaactaattggatctttcttgtattcagccttttgggagaaaacacgatatgatgggctcagaaagactgagattcaaatcccagttctgctactaattagctgtgtgtctgagagcccttgagtcgcatggtctcactgagccttattttccgcatctgctaagtgggatcaccaaaccctacatgtaggattgttgaaagaatttgagagattgcatgaagcacatactcagtatctcattcggtattcccccactgtttctaacagagtctttgtgtttttagggtcctccaggacccccagggccacctggcttacctgggattccaggaaaaccaggaactgatgttttcatgggaccccctggatctcctggagaggatggacctgctggtgaacctgggcccccggtgagcaactgaagtcttctccccatctctgtggctgtggggcttcctttagcaggggaggggtgtacagattgcaaaacccagcactgtccaaggttcgcgatggggagagagcagctagctgtttgtaaacagaaatcctcctcatctgaatcattgctgagattcgaaagaagcagcagccaagaaaaacatcatcctacgtattgttttgctgctttatcatagtcaatacagatggccccctacttacgaatggttcagcttaagatgtttttgactttacagtggtgcaaagtgatgcacattcagcagagactttaccttgagtacccatacagccattctgttttcactttcaacactttattataaaataggctttgtgtttgatgactttgcccaactataggctaatggaagtgttctgagtatgtttaagttaggctaggctaagctatgatgttcagtagattaggtgtattaaatgcattttggacttaagatattttcaacttgcaattggtttatcagatgtagccccattgtaagtcaagaagcgtctgtacaggagacacagattcataaagaatcttggaatcataggccatcagggctgggcctggggtaggagacccttggagaccatctggtccaaccctgtctctaacttccccatagaggaggaaatgtaatccagagagtgaaggacagttagccacaggtgcacagtcagcagtgacccagcctgggccaaggactaggttcctgccttgcacctgacatgaggccctgggcccaccagcctcacctgcctcccaaccctgccctccttttctagcaagcgtgtgtatgtgatatttagcagaaatgttgtgggttgattgtcactgatgttccccagggccctgagggacagcctggagttgatggagccaccggccttcccgggatgaaaggggagaaggtacggggaacacgggagggtcccaccacatgggagccaccaggcccacactactctctctgacccctaaacctgaccttgcctcttatgtgactgaccccctggcctcctgaaatcccctgctggccacttctgctggatgtctccatcatgggactcatcatgcccaagcctgaactcagcaccttccctgcccactcttgtctgcccctagcttcagtgaatggtgttgccatctacctggtcacctggagcgagaaatggaatcttctctaactcctccttccctccctttcctggtatgattggtcagtgccaagatggcccagtctgacctccacatctctcacttttgtctccccactgagctggactcatctcttctcattcgcacggtggccttgggctcccagttgctgtcccattctctccacccaccctccagcctcctgcccagttcaccttcctgtagcaggctctcgtcagcccctgccctggctactgagaaaagatcaagggctcaactgcctgcaggacacaccctagctctgtgcagacatctggcccttcctgattcgcacaagctgcctctgtagtgcatcccccaactcctcacacggcctcttggccagtgggctggttctgcccaaatgctctgggcacgctcttcccttctgtcctcctggcctttgcacatggttttctccctgtttgggatgtccttttccttttgtcatcctccaagacccagttcagatacatcctctggggagctctccctgactcattatgagcagaaagcacccctccttcctcccctttctatgagcatcataggaagttcccatgctattgagaacctcccttgccagtgacactaaaggtgttagcttacctgtctgctcctcacccccaccctgacatagagcatagtactgcctctctctccttagaacctagcacaagcctctattagtgtttgatgcatgaatgaaacttttttcagacaccattagtctacttttcccagagtctggcctgccttcatcctcttcattctctgtctgtaagctggtcctgcctcctgtctgcaagcctgtgctggtgctacctggggcgtgtatgtgtagggggtgctttctgcctctgcagtgttcccagcttgatgagataagccatgtctgtcaaaggaaggcaataaagacaaggtgagccctgtgctagggatgcgatcagtgggttttactggggtctagaggaggaagagagatctcagctgggatcagaagtggggccttctgtgaacctctcatggacaaagacgtggaaaatgctgactctgtagacaccaccatcatcactgaactgaatttctagtttccgtcagctctggagtatgtttattttaattggaaccataactcaattttcgtggaaagcttatttctcagaaaaagatacaattgtcaagctttatagaactcattttacatgtaccaacagttttacagaaattaaattttgcaggaagcaccacagacctacactcttcttacctgttcttcttccaggcttccccccacccacccacacacacccctcccatactctgtctcgaacttaaagatacccacacccacaactgcatacaaaacacccttgcacaggcactctgcagctgcttgaagaatcagcagtgcaaggagcagcaggcttgcctagggtgaatgttggagatcaatcacatttgtttctgaaatttgctatgcatctcaatttgttgcactgtgcacatatgaggttttctgatcaagcaaaaacagacttggaagaacttggaaatttgcatctggagagctggcaggaaactttgcacatgatatttaccttaaaaacaaaacaaaaccaaaaaagtccctaataaaccaaggtgcatattcagtatgtaaaataacaaaaaatgtgctaaaggaaatgaacagcttcagggctgtagtagatcataagatccaatgattcgtttgatctttgactccccatcaacaatatctgcccttcaacttgcatacctccagtgacaaggaactcatctcctgcccaggcagtgccttgcaccgttggatagatccacttatagggaagtctttccatttgctgtggtgaaatcagcctcctttctctttagcacagcacatagaccaatctaggcagttatctaaaatggagttttctctacaaagaataaggttcaggttatttagctggaaaaaaatgttttttatataataattattattataaaatatgagattgagatcaaaacatgatgctcattaagaattcatcaaatatcttaagtatgagctaagctatgaggacccaaaggcataagaatgatataacaggctgggtgcggtggctcacacctctaatcccagcactttgggaggctgagatgggcggatcatgaggtcaggagttcaagaccagcctgaccaacatggtggaacttcgtctctactaaaaatacaaaaattagccgggcgcagtggcacaaacctgtaatcccagctgctcgggaggctgaggtgggagaatcgcttgacccgggagccagaggttgcagtgaaccgagatcgcgccactgcacttcagcctgggtgacagggtgagactccgtctccagaaaaaattgaaaaaagattgatacaacagacttgggggaaagggtgggagggagtgagggataaaagagtacagattgggtacagtatacactgctcaggtgatgggtgcaccaaaatctcagaaatcaccactgaagaacttactcacgtaaccaaataccatctgttccccaaaaaacgtattgaaattatacaaattaaaatattttttaaatgatacctcaaaaagaatttatcaaatagattattctatgctgagttcgatgatagaaatattccttactttatttttcccaaatcaagatgatcaactaactcttaagatctttagcccaagaaggaatgggtgaggagtagcctgctttctcagcagtagaatgtttctagaaagaatgcagaagaacttgctgaagaagatggatctctgaaaaatcattcctttctgcttttgcactgcagattctgccattcagttctcggaacacacctagtattaacagttgttgttgattttctactttcagaatctaagtcattcatgttattctgcagtctcaaaaggtactgggacacctgggcaggaaagagtttgtgcttggaaattttcttcagtgtccagaattactgtggaatgctgaattgccagtaattgcctttgagtaatttcactgagctgccaaactgtcattgtaaaatcagcttctgtcttttccgttgatgtaagagaaatacaattagatcatcatcaccttccctttctccaagcaatcccaattggtctttgaacaattctctaaaccttgtataagaaagaaaagagaagtaagctgcttttgcctaggatgcagtaatgggtttagaccttctaacaacatgtttaaatgaaacactgaaatagttgcctaatttcctattttatatcttctttcattatcagaagtgtttggttcaacatctggattataggcctccataaaaccaaatagatggctgggtacagtggctcactcctgtaatcccagcactttggtaagcctaggtgggtggatcacctgaggtcaggagtttgagaccagcctggtcaacatggcgaaaccccatctctactaaaaatacaaaaaattagctgggcatggtggtgggcacctgtaatcccagctactcgggaggctgaggcaggagaatcacctgaacccgggaggccggggttgcagtgagccgagatcgtgccattgcactccagcctgggcaacaagagcaaaactccatctcaaaaaaaaaaaaaaaatcatatagaccatagtcaattgtaacagaaaagaaactggttatcagtattacaaacagcagaaggaaaaccaacagacatccacaaggcagtaagatgtgctgtctcagaagccacacaagcaaaaagaatcctcatctccattaggttctttgaggttcctgtgtgctgaaattgagtaatgtccttagaaaatccaattcaccacagtaagccaacattttgaatcaattctaaaccacgatgttgtaacagacggcactattttacctcattcctttgcaatgtttccattagtgaactgataccttcatatttcatcacttttaaaaccatacttgcagctctgctatttggaattccaagattgcatgcatgccctcactgcacaaaaattctctcactaagaaataatgtacaactccaacatcaccattttgggaataggagccttccctcagcctgttcattggagctcctccttttcaccctgcctgttcacataagttccagtaaagtggactcttctacccacaagttaatctactcgtgttccaagctgatggccatcttatctgtgagtcaatggaatggattcagatactctctttttaccatgtctaagctggataaaatcatctaagaccataaaccaaggcccatgatatcttctagaacttcctttgaaactctataagatgccctcttgattggaaaggaatgaggaaggcaactgaaacaattcagtttttcactttatggacataattttctgtaacaagatcagccggccatgcagctacaaggtttttagagggaggctactttagtttctgtttcacaacaatcctgatggtagtttgacttgttactgaaaagatgcacaagattggcactttcattaaagacagtttgcaatgggcagccagcaacaagccaatcatacccaagaggagcagacatagcaactgtagcctctgggttaggctataaaattggcatccagttattggagtcatgtttccactgcaggtggaaggtcacacttagtttctccctggtgaggctggccagcagggaggtgacagagcctagtcgctgtcacttctttcaccgagcacaccttctcctcccatctccccagaatggctggagtgtccctgctggctcctttgccacagaggcaccaactttccatgaagctgcccctggagaccttatggagggctttgctcgcagaaattccttgccactccagcctcagagcctgcctccagagcctggtgcctcacctgggagcccagaccaccctcagcccctgtgatccccattcctaggccaagaactgggtagtgtgtcccaataggaaaacactgcaagagatgggacccttcccatgccccacgcatgcccccaggtgagaggcatttgtcttcctccagcatcaggtggaaaccctcacctagcaaacccatgaacctcacccatgggagcagccagttccgtgaggaaggttatcacaactaccaagcaaacagcatgggctcgagtctgtgaaggagaaagggggagattgttgcgtgggggttgcctattgtgtgcaggcagttttgcggacacgtcatggcctcatctttctcatctatcctgagagctttgcttaggctcatactcaactagagtcccaaagtttcagagctggaaggaacctgcaaattgctttagtccctggttttctgtgccctggcagagccatgggactttgtggaagtgccttcgggctggtaggtgaggacagaacaactctacttcaagcatttattaaaattaaaattaaattgtaattataaaagtaatatatgaatatagttttcattgcctcatgtgtcctatttcctctttaattatttttgttagagtaggtcctccagtcatattttcacagactgtctgtagatggcaaactttctgagaccctggattttttaaaatgtttttattttcttatttggttgagtatagaattctgggttgaaagtcatttgcccttgatgatttgaagatgatcaccatcatcttccaacatccggtgttgtcagcacaaagtcagattcactctggttctcactctattggaggtcatctgatttttctctttggcaaatttggggatttattgttctttattcttggtgtttaaaaattcctctgcattgttactaaatgtggattattgtttctattttatttttattttttaatttatttttatttatttattattattttttgagatggagtcacgcagtggtgcgatcttggctcactgcaacctcctcctgggttcaaacgattctcctgcctcagcctcctgagtagctgggattacagatgcacaccaccacacccagctaacttatgtatttttagtagagacggggtttcaccatgttggccaggctggtctcaaactcctgaccttgtgatctgcccacctcagcctcccaaagtgctgggattacaggcctgagccaccaagcatggccaatgtgaattattttttaaatgtattctttcatttatccttcttggtactctatggactttttttggggggaggggtgccttttaatctggagacttctgtgttttttcagaaaatttaaacactgcattccttctttctctttattctctcctctgccactccaattaaaccgatgttggaacttctgattgtggcttctatctctcttactactttgtcattctgtctaggtctttttaccctcttgtgttgctttctgggagaattctgtagcttgatctctgtattaattctctctttaggtgtgtctattctgttatgcagtccttctgcagagttctgcatttcgacagttttctatttataatttccaagatctctaattggttctttatcataaccactgtttttatttcataatagcttgtctttgtgtcatggctatgttatcctaccttttctctgtgagaatgtgtgtcttatactcaatgtcctgattgaattgttttcttaactccatttccttggatgtaaattctgtagttgacttagttgtttctcacagtattgccttgcctcagatgtttgtgtttctttcttgtgtgtttacttgtgaaattgggatcctgcctgagtctgttttctgcctctgttggtgcagactgttgggaggtgggcagtagccccttctgagacatgcagggttcaggaaggggatggaaggaataagatgtgccatcaggcagggcacctcagcagctgatcttccgcgtgtagggtgcccttggacctcacagagtttcctagtcatctggggctctgccctatgtctttagcccaataaacaactgttgttttctaaaattaaggtatccatattttctccttggcaggagtgagggtgggaggggaggggagatgggcagggctggacagctagcctgctgcagaatttcaacctatctaccttctggggcccaggggccacatcatgcacctgacttccatcacagcttcacagcagacttttctccctgtggtttctcttgatggctgaggcccctgtcttcaacttccctgttttccccttggcatttctattttggatttaatgccactccccatcttatttttgagcacggctattttagaactatccattctctcatttccatggatttgatataaggaggagactgtagcccaggaacaaaaatgactggggggaaggacatagtctttgatggctggtacatcagcatctctctcaggacctcctgtgtggcatgcaattgctgacttcatctcttgcaggtgcatttgtggtttcctcagagattctccatctgggggccccctaccacagtcctctgatgtaggccactgtcctcattgctgaccactcctgaccgcccacctgctttggtcctctcctctgcttggagctcacagccgactcctttctgtgacatctgcatctaaccccccaggaaactgtagtgtggtccccactgggtgtggacatgcaacctgccctaatgcaacctcctccccaattctgtcttctggggactactccagccagctttgggtctttagatctttccacaagagagccagtcatcatcccccatatatccaaaagtctaggggatacatttcagatcatgaagccccttccctcgctttagagtgggtgaagtaccctctacctccgtcatgggaagggtggggaaggggaccactccagtccactggcagctctccaagcgaaatcttctatgatctctccctcattaatctttaacttctctggtttactcttgcagtaggtgatgagctgatggttgaaaagtgggtttcacaagctttcagcatgacctgcccaacagactggcacctattgtaatgtgtttggtttggagacaccaatctgagacagaaagagtcctattttaatatcctatttccttggagtccataattgtgcattgtcttcagaacacacctcatgacatatgcattaattggtccatgtttttgtttttgtttttttcagggagcaagagggcctaatggctcagttggtgaaaaggtaaaaaaaaaaaaaaaaaaaaaaaaaaaagaactttcttctccctcctcccctttctttgagtttactataattggactgctgggctggaatattgaacatataaatgtcatggaacagagaggaacacatctcaaaggaattgctcagagaaggcagaacagctggggatggtggggagtaaacacacttcaatgttttctccttcctcacccctccctccaaatgcattcaaatgagtgcatcagcttatctccaggtgaactgtcaattagcaagacagctgtttctgtaccattaagtggtaccgatcagagaattcatcaacctaattaacttcaaggagtgattttctgattcaggcatgcatgttgttccttccatgagtgaacccagggctagataatcagcctgccctctttcctacagggtgaccctggcaacagaggcttacctggacccccggggaaaaagggacaagctggccctcctggggtcatgggacccccagggcctcctggaccccctgggcccccaggccctggatgcacaatgggacttggattcgaggtacttttccccttttctgtggttataaaaatgatgtgtactaagggctactagaaagaccagctagctaaaccctggtctcagggcagaggctgtgcggattcccctgtgagccgccagcttccaacaccacacctggcacaagtaggtgcccaggaactggatctgaaattctcattcttgctccttccccaggataccgaaggctctggaagcacccagctattgaatgaacccaaactctccagaccaacggctgcaattgtaggtcgcctctgaaaccttcattatgagggttgtcacactgtcacactacagtgaggaagctgtgggctgcatcccggctctgccactttcaataactcaccttctctgtgcctccagcccccaactgtgcaatagggaaatgagatgctctttacagcttgtgtctttgaggaacagcatagaagttttgcagaaaacatgatgtgggaagagaacttgaaaatcatttttatctctcttcatctatttctctctctccctctgcctcttctgtctcttaccactaagcatctctactttatttcctccctccagttgccccattcaatgcacacactttgccccaggtcaaagccctgtgctcctggcaggtgcccctccctactgcctccagcccctggcaggtgttgtccatctcctgccatgaagcgatgccggctctcaggaggaccgatcccctggatttcattctctttgttaaatgggccccagagctgagcccttcagtctagcacagattcagggtcaagaggaccctcacccaatgctgggagagggccgctgattctctcactctgtggagtgttgcttccttctgactccagaaggggcatttttcgcttattcttggttcccattgcctgggacaaaataagcataaaagcttagggggagatggtgagacaagaggctagatggaggtgagcaaagtgactagaagaatatttatttttgtttatttttccagggtctcaaaggagagaaaggagaccggggacccaaggtgaggtcacagagccaaggtgggggtgggagggctttccagcctggttctgggagcattatcgctgtacagtgaatttttttctcacttcttgctgctttgaccagggagaaagggggatggatggagccagtattgtgggaccccctgggccgagagggccacctgggcacatcaaggtcttgtctaatgtgagtatcattcaggtcagagcttgtctacatattttccacctttgccaaagggaggagaaggttgtccatgacttcaaagcttctggctatgcaggaggcatgtagccagtgcctggtgttagaacttccacctgccagcacctacctgttcctcccccagttccactgttctctcacatggtgcttctagatttgtctcttctgattagcagcatttggggtcaattgaaaaaacaggctaggagcattagagatgttggggtcttgaggaagccccagataagcagtgcacactttccccagccaagtgcagagcacattgagaaataaagccaaagatgaggaggtaggcccagataccaccttgattactgatggaggttaggtggaaggccttcacccagtgggagagccacatgttcctgccaatcagacggacttgcccatgggttgccagatgtgcttcccagaggcaggcagatctgaaggaaagaagtgtggctgagctgggcatgccccttggtgcttcccaaactgcccatcaggaaggtccctccacctcaccacggagggggtacaggagccaagagaagccaaggattacacccttcatgtcacaggaaacatctttatgtgctccctttagatggctctttgatagtctattaaaactaaaactaaaaatacccattctccaaaatcccacatgggaagatgcccacacaaatggaggaaagcatcctcttcccaactctcctcaacaaggaaggcagtaacttcatccttcaaacccccatcatggtacagcaagtggcctatttacatgtctgactcctccacctgccctctggggctttttttcttctctgtatccccaccactggcctcatagtgctggtttaatcagtgtttgctgaatgaaatgtttggtgtcattgaattctctattcctatgataaatactctggcataagcactcatgggcatgcactctgcatcaggtccatgctaggctctgtgggtataaagataagtaaggccaggcacagtggctcacacctgtaatctcagcactttgagaggccgaggcaggaggactgcttgagcccaagagcttaagaccagcctgggcaacatagcaagaccctgtctctgatattaaaaaagtttctattttaaaaaattaaaaataaagataagtaagacagagttcctgtcttcaaggagcctccagtgaggtcaggagaagggctgtaacagagctgtaactgacaggcaaatgaacataaagaggggaacaagggagaaaagactgtttgggttatgaggaatcaaggaagacttcctagaggaagtatctttgagcagggattggaaagctgagaaggattttaccaggtaggcacggaggacagaacttccaaagctctagtgtcagggatgccctgagccaaagcagagggtaggacaatgtggtgtgctccaggtcgagggagctgactggcagaggatagtgcacatgggtgtgtgtagagaatgatggaaattggagagaaggctggaatgtgggctgggaccagatcgcatgcatttaatattaagacatcacatcatgaaaaatcctggccctttagagagaaataacatcatgctggtagaccacagaaagacaagccccaaataactggaaaaaggatgactaaagttagaagaaaaaaaaaacacgatttttaaaaatcaaatatgtgtaagggtgtggggaaaaaggtaatctcatgtgcttctggtggaagtgtaaattggcccctttggatggctctttggcagtcttttaaagctaaaaatattcatattccaaaattccacatggaaagatctccacacaatatggccgagtgaaaaaagcaagttgaggagtaatacagcctgatgccatttatgtaaaataaccacatggacaaacacacacaccccaacactgtgctttctgtgggtgcatataatatgtatatgtttaaactctaaaaagagaagacattcgtatattgtgtgatttaaaaattaagtaaaggaggaaagtgcgaaggcagctcagagctgttttataagaagggggagggagagctgtgtttggcagtgggctgagggcgttctcagtgtctgcggtgttccgctatgctgggtgactttaattaaagctttgctgccaggaacaaggcagaacacatgccatcctttgtcctcattgtctgatttttctcttttcagtccttgatcaatatcacccatggattcatgaatttctcggacattcctgagctggtggggcctccggttggtatctacagctgccccagaatgtggcttttacccagacgcccctgttgaaacaaagtcgggttactttggaatccttttagctcctgaagcgtagagctagaatatatcaaagtagaatggaaagaaagctttgcattttttgaaaagttgctttcacattaatttgatcatgtggaaagttgtctccaaagcagtggaagcttccagtcctgtgcaccggcaatatgtgtcatggaaattagagaatgctaagtaacaaacagatgacatctgttgcacacttttggcctgcttttatttacattatcttatttcatagtataggaagagcctggagacacctttccttgtgctcaagggaaacgaggaagaaatggactcattctagtctttatagccccattttagaactctggaaattatctgtgtgttaatttccagatctctaaaatgggattataatgtatataagaaatacacattatttttggccagaagtggtggctcacgcctgtaatcccaacactttgggaggctgaggcaggcagatcatgagatcaggagtttgagaccagcctggccaacatgttgaaaccctgtctctactaaaaatacaaaaattagctgggcatggtggcatgtgcctgtaatcctagctacttgggaggctgaggcacgagaatcacttgaacctgggaggcggaggttgcagtgagccaagatcgcactactgcaccccaggctgggtgacaaagtgagactctatctcaaaacaaacaaacaaaaaaaaccaaaatatacattatttctgcaagttggcagagttgactcatggcacaatggccctaagatgaaggaagcttcctcctacagcctgtagaataaatactcattgcatctcccagcatctgctggtcagcacaggagaaaggaaggagctctggccttaggagccttgaggttgcagccccatcttctccacacaccactctgagcccctaattctcttctctgatgacacctcaccagcctttgaggcaacttgtaagaagtgagggatgtgaaactgcttagcacactgtgacgctctgtgcaagtcattgtggagacaggtttatgccttcacagctgtgcaatgccgatgtccctgcctctcctgcagatccccatgaggttgccctgaatcccattcatccagatccaggggaaaatctagtgctgccccaagattcctgcaaatatctgcagactcttctggcaccaggtttctcccctgctgagtgacctcattgtgagccatcttcctgtctcctctgtactgcatccatttgatttctatgaaaaccaataatccaaaatacctcaataatgaaaccctagagcaaaccagctaacaagtgaaagtttcttcccaaggggtctttgttttccccaagctattggaggtttctgatattaggtgggtggatactgaagcaaaacacagagagactaaaaccagagattgggcatccctgtcctcacagtccctgggccttgtctgcctgcattaccatgcctccaccccttctctctcttccttgctttctttccagtcactgtcctccccttggcaaatccagaccctcacagggccccttcttccctaatgctgtgtcaatccgtcttcccagctgtgggaacatgctgaggcctttggaaggggctgggagggagggggtcctgctgactctggaaatgccgctcctaatccagcgtgctctatctttggtgtgtcacaggggccggacgggttgcctgggctgccaggatttccagtaagtaccaccctcgctgtcttctatctgtgccccgtggctgcgatcattctgttccttccacctagaatggcatttcctccatctatgcatgactgagctccaggggcatcttgttcattaactttttcttgatatttttgatagatatggggttttgccatgttgcccaggctggtctggaactcctgagctcaagaaatccatctgcgtcagcctcccaaagtgctgggattacaagcatgagcccctgagcctggctgattttctgaactttttacattttctaaaggcacatatcatatgataacactaaaaatagtgctaactagacgttaaaaaacaaaagagagaatggcaaccatgaccacgattgtgaccatgactctgaccatgattcttggttagcagaagaaaaggccaaacccctaagctccagccccggcttggctgctccaagacctggggcacatttcagagcacactttcctctaaatgagtggtcctgtgttcctgagggagtcccaggctctgcaggagagcctccaggacctccactgcagggagtaaggagggggccaaataggcacattccaggccactgaccttcaataagggaagcttcactggacatatttgtatatattaggctttcatttaagactttatttgggggaaaaaaaaggaaggaaaagagtttcactgctaaacaataataacaaatagttgaaagccactgctgtaatgggtaattcactctttcatccagacaagacaggaacttgtgaaaagttaaaatagcaataaagtgttgaaatgcctttttgaggcagatgtggctgtgtgagtcattgtcacaggcattcagtgtctgttggagttgagaagaggttgcctctggctgcatgtgtggatttggctctgcagaggggtgggtgggcattcctatggggggggtggcatgagtgctggtgcagaagcaatggaggagtgcagagaggctgcgggaagggagtcaacctgatggtgtgggagatgagatgttgatgcctggctgggatgggctggggtgccaggctaaggtacctgggtcccatctcataggtagtggggagccagagaaggggtgggagtcgtggaaggggatagtggaggaggcgggctgcagggtggcctggaggagccgtggggcaagcagatgcagcaggcccagataataggctggatcagtagtgcccagttggaggaaaccaatgttcaaaaaagtgtgaagcctcaaggcctcttaacactcagtgctatcttctttctgccagaccacagtttctggaccacttaaggttaagaaaatgtcataggtaatcatgacttccacctacctgggggatggcagtgtgtattctactgttgagaaaaaatatatttctgattggtttatgcattttaatcttaacgaacaaccaaatactatataacaattccttccagggtcctagaggaccaaaaggtgacactggtttacctggctttccaggactaaaaggagaacaggtaagaggggcccaggtatctgagtgagattgggcgctggaatttgctaaacgtttcagattggctgaaaatagctattaacttttctcttctttgagatacaattcacatgccataaaattcacccctttaaattgtacaattcagtgatttttggtgggctcataaggttgtacaacctcatgaaccactctgtaattctagaacattttcatcataccagaaagaaaccccatacttattagcggtcactctccagctgttaacttttttaatctccaggttctctatgagacgagaaggtacgaagtgggtagtgaaattgatttttaccataatttggaaagagaactcaactcaacactcctttgttctcacacacactgtgctttgtctaaccacctgctgggcatcccccttagaacatgcactgcctgaggacaggcatcctgccagcttcttttccatagctccaatactaatatggggcctggtatacaaatggtactgaatacacttgttggacgaaagcatgtataattaatgagtagaacaaatgttaatatttataaattataaattgagcattctgcagttgaacaacagtcttggtccaaagtctctggaataaatacttagcacacagaacacttcctgagaactcccagggtaccaaacctattgttgtgcttgtattcttttgtgtttgcctcttagaattaactttccagttggtttttatagataagggggagagtgacgtccataaacagattaatatattcactcgtccatgtatatactcatccatctttcgtccactgacccgtgtggtgtgccaggcagtttcctgtgctaggcgtagggatatagaaataagatgaggaagagatatgcaaagagctaacagagcacatgcttacagctggaatggagctctgtgcaaagccagtgggagcactgtgcaaccccctgagcctgccatggggagtcaaggagggtgggtgtgctctgtgggatgggggaactcctctcgttcttctctccccccatcattctataatataatggtctccaaggaggagagggcctccaatatctagtgggccactgctccagggcatggagggctcggtatgctgggtgaaggtttggcatcacgtggggatgtgtcttgggatgcttttcctgccacaggcctgtggagatggaccagggctggccagctcaggcttgggaggaggcccagggaagcaagagcacctcttgctttaaacactctgtttaaacactctgtttcctatgtggtaaggtcagatggatctagagggacggacatgacatccccgccctaacctcctgccaccttgaatgactggtccaggcagccgggcagttctgctctggccattgcagtgaacgtgctttctctcactctgcctctaatgcttttgtgcttgcttcttctccctgctggcgtgctcaggactacctttcctcatcagtggagtggtaagatctaaataccaggtgtgggcttagggggatggaagaaagaggctgctctgcttgctttgatgctactgtcctagctactcccagccccattgaaaagagacttctgtgtggctcagccctgctccccaggggccagcattgaagtttagggccaaagcctcagagtcagatagaaggtttctgcacccagtcttgttctcttgacaatcatcttctcagcagcctctagcatagtagatgtctctgctgaggacaggattggggtcaggatcctgtgttcttgccaccagtctacccatcactcattcctaatgtctgggatagctttgcctaactaagtaagtgtttgcacaggagcttagagtttggaggcaacgttgcatatggagacataaggcctccatgttgacagaggcctctagtttttataccgtcatctctttcctaatttcaggtgttttaacaagaataagtattcttggtgggaacagatctcaggttgagttgctaggaaagcaagctgtcaaatacattgggagccagagcttccttgagggcaccatgtggcaggagatagacaggaccacactggggctggatcctggagggttgagagtgaggatgcaaatctgttatcagtgggagcctgaaggggcatggaagacaggactgtcctgtgccttaggacggtaactctgatggtgcatagagggaatggctgagagaacattcattcatttaggaggctgttgcaatactctagtacgaggtaattttggagcagtggggtttcaagtaggatgaaggcaagagaaataaatcatggctgcaggactcagaggtctctgtacaaggtggcaaggaggagtctctgtacaaaactctctggacaaggtggcaaggaggagtcctgacttcattgagatgttctctgaattgcagggcgagaagggagagccgggtgccatcctgacagaggacattcctctggaaaggctgatggggaaaaaggtaattatgtcaccagaccctgcaggcacatatctgccccagctttgcatctttgtttctgtcccaaacagtgacaagtatatatcttcctgttttagggtgaacctggaatgcatggagccccaggaccaatggtaagtcagagcgtctctcagctggatctgggctggggtttgaagcatttttcatactttgatttggttagatttagttgtcccggttatgaaaattcaaagatgtggcaaagatgtgcaaaatgtgcatatactagggtaaggctgactacaattaaataaacttttcagtgatttaacacaatagcagcttatttctcgctcttgcaaattccactgtggttgttctcagcttggcatctctcctccaagaagtgactcagggatccaggatgcttccattctgtgattctgccatcttgtggattcaaggtcgcacaggagctagcaggctgaagttggggagggggaagagattgtgaaagataataaacatcacttctggcacattctgtaagccaaaacccagacgcttgtggcctcaaaatgtagtttagctgtgtgtccaggaaggagaggtgcacttgcagttataccacagaacttgccagctaaagatgaccaatttcccaggaaaccctcaaaggaaccccacaaaacctctctgggatttttgattctggttgtgaatatgccactcatttgctgtgagaccttgtgcaagccctcttctctctctgggctcctgttttcccatctgcacattgaagagactgaattagtactaaatgatattagggcccttctggccttacggctctgggaatccataacccatctgggcttctgagcagctcttgccatttctctcaagggcgaaccctaaacttacttccctgtgtagaacattctctatgggtcagactgtactgatgcttcacataggtcatctcatttcatcttcacaaccccaagaagtgactctcagaatccccattttatagatgaggaaactaaggcccaaggaggttaagtaacctgcccatgtgacacagcttgtaagtggcagagtggggatttgaggccagccagtcaggctttaggtccagtctcttctcagatgaacctcactgcctctaatgaacatttgaaacattgaacatttgaaacattttgggctagagaattgtatacaggtttgtttggttgaagttggatctcaggtgtggggagaaaggacctcacatttctgtaacagacttgtatccttgaagaatggcctgtaactttcgaggtgaatccttcaaaagaccttctgaggcctttggtccctgaagttaagaagagtggacacccaaagtcaggtagctaagacagactgagagattcttgtattaactactggttaaccacctactaacctccaatactgtggaaaatacaaatagttagtggtgggggtcagcaggctgctgcagatgccatggcggtggttcctactgaagcccagcttggacacagcttgccaaacacaggcagtaagtggcaccttcttctaatttgcatgaaggtgctgtgtgggctagctgtggccctagtgaccagtgtagcttataacgccttctcaaattcactggtgtcctgttacacaaagtgtagaccatgcaccagcatcactgacatcacttgggagcttcttagaactgtagaacctcaggccccacccaagacatactggatctgcatttttaacaagatccaggtgattcttaacacacattgatgtttgggaagtgtattagtccattctcacgctgctatgaagaaataccaagactagataatttacaaagaaaagaggtttaattgactcctagttccgcatggctaggaggccttaggaaacttacaattgtggtgggaggcatctcatcacagggcagcaggagagagaataagtgccagcaggggaaatgccagacacttacaaaaccatcagagctagggagaactcattcactgttatgagaacagcatggggaaatctgcctccatgattcgattacctcccaccacgtccctcccatgacatgcgggggttgtggaattacaattcaagaagagatttgggtgggcacacaaagccaaaccatatcaggaagtgttgcactagaacataccaaccaagtggcctgtgccctgtcaaccccatctgtctttgcttttctttccctaagagtaatacagactgggtactttacgtactgaccctgtttcaactcagtttttgtttgtcatttttcagagcatggctatgtatgtttatggtaggatgaaaagggacttggagtgccccaggcttaaatcagtcattcttctgggagacacagcagacccagctacagggttggaaaggcgcagactgagggtagaatttgttctaggaagacatacatcatcagtggtgttgtctgtcaaccaagtagtttacatcccagacattagaaggcaggagggttcctgaaggttgcaacagaacagtggttctagaagcctgtggtcctggaaagccagcactgaaatagggtccatggtctggaactcagctggatgactggggtgtcagaccaagactctggttcctaggggcaggttagagcaaggaaggaaccaaatcctagagtgggttatcaggccaggctggcctgaggggcgaggcagggctgcgttattcagaatgggggatgcgataagccctgggacataagacctagggcagaggtccatgttctgggctggcccagcacctggctaccagggagctgaggccctgagctactgacctcttgctccttagttaaccctgactgcgaggggctgggtccagagtctggggtgggttggagcctgcaggaaagcaggggatggtgtgggttgagcaggtgcttctagctgagagcggagaggctggagacaaggaggccgcaggcaggggcttctacctggctccctgccctccttcctcctgtcagtggatcatcgtcaccactgcctgcaaaagcgggcttgcactcctcatttccctgaaccaagactttctgttcttttctaatctggcatttgttttgcctctaggggcccaaaggaccaccaggacataaaggagaatttggccttcccgggcgacctgtaggtatcagtgttcattggacaggctggagggggaggacacgtgggccaggctggtctgtgggcggagggtttactgaggtgtctgctgtgggttccagggtcgcccaggactgaatggcctcaagggtaccaaaggagatccaggggtcattatgcaggtgagtcaccctggggatggagccggaggttggtgtccagagagggtgagagagtgtggggtccacagagcagggcctgtggactgaatgttcaggaatgttgttcttcttccttcactgccactgccaaaggtcctcccacccagccctgtccttcagctccctctcaggagggtcctgccacctaaaacaccttagtggaaaatagactttcttgtgtaggacccagagggagtaggggagaaagggatctggtcatgctcagaaaatgtggttccaaatcccagggcctctaactctagggtaatgtcacctctcccctcctttacacagtcccagggatcactcacatcactaggggctcagtgagtgctggaagtcagtatcaaaggcagatcagctacttaggtggggcctcccaggttggcaaacactgggcagcagcagggaccctggtctagaagaaaaaagccaatgtttattcagcagctgctgtgtaccagacactgtgcaaagtgattttgttttgttttgttttgttttgttttattattattatactttaagttctagggtacatgtgcacaacatgcaggtttgttacatatgtatacatgtgccattttggtgtgctgcacccattaactcgtcatttagcattaggtatatcttctaatgctatccctcccccctccccccaccccacaacagtccccggagtgtgatgtttcccttcctgtgtccatgtgttttaaggagagtttctcatttagtcttggtgataactattgcatgagatactatgcagggatcttgttttacataagaggataccagggcctctagaagtcaaggcacccacccaaggtgacccagctaataatccccaaaccaagatgtaaacacagctctaagtctattgctgcttctgtttgtgccacactgcttttgctttgtatgcccagaaatccagaaatactattttcctgaagcattaggggttgagtctcactcaccaagcccactggaaccggcaggcaaaccagacactgacgccttcatttagagtgatcaatacactttctgcatgaactaaactcttcatgcctgccctcagagcctcacctctcctgctgcaagctcctgcctctaggcttagaggagaaactgttgcatggtactaaggccaagctggcttcactttgaaaatgactgtgctatctaacaagagttttgcatttatgcttgcatttctgagacacatttcctctggcaatatatcacatgagggacccccacagtccattcccacccgtatactgggaatgcactgataggggagccttaggctcagtatcaactgggtgtcagaatctgagttgcaatctcagttctgctgtaagttgctgtgtggtcttgagcaggtcacctcccctctctgggcctcattagctgcatgtgttaaccagagacaatacttgttgccctgccatcttccctatggtttgttgtgaagatacagtgaggccagggacatagaagtgctctgtggctccctgagcaacctgagagagaagttggttggcttcagcagaccctcctttccttcctctggaggaagtgtcctgtggctgcccctgcattcacaacaacctgaactaatggaatggcctttttttcttccttcagggcccacctggcttacctggccctccaggcccccctgggccacctggagctgtgattaacatcaaaggagtaagttggcacgcagtgggaagaccttcccaattggcctaagctggagtcaggtgtcctgttgacctcacctctcttgttctcattacccacaggccattttcccaatacccgtccgaccacactgcaaaatgccagtaagtagcaatcactgccttaaagagcaggctttggcatggatagcaacttggagaaaaagatcagtctttgtcttgggccctttctatcctcaaatgtcctctctgatgtcttctgtcccctaagtgtagaccctcaagtgactagaagcttttagataacaggtcgtggcaatgaaatatactggatcttctaagggtgcacacacggtgaggtgcttcttttcatacaatctaaaaagcagtgtcttttgttattgcgaccacattagcttcatgcttggagtagtataaaactgggaaaaatagacccgttagaaaacatagattagaaaacaatccatgccaacccatgatctttgcattgagaactttgtaactaactatgctgccctttcccagtgatcacatcactgcaccgcacacaacactgacaggcagggctgatctctcccattttatgataatgaaacaaactgtgactcagagaagctcactggcttgtccaaggtcatgggacttgactgagctgggatcataactcaggtctcctaaccaccaggcagcaggtgcagacactgggatgctgaggggtcaggcacttgcccggccccccagccattgagcagctctgtccctgattttttacccacaggaagagagtca

SEQ ID NO: 1457 - DNA, 2726 bp, Homo sapiens
ggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaaggcaaggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccagtaag

SEQ ID NO: 1458 - protein, 533 aa, Homo sapiens
  VARIANT (1)...(533): Xaa = Any Amino Acid
ASSSTAAPNKARSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPVX

SEQ ID NO: 1459 - DNA, 126192 bp, Mus musculus
  misc_feature (1)...(126192): n = A,T,C or G
tcatacactctagcaccccccatacactctagcacccctcatgcactctagcaccccccatacactctagcacccctcatacactctagcaccccccatacactctagcacccctcatacactctagcacccctcatacactctagcaccccctagaccctaaggccacgaagcctcctataattagagcagaactgcacacaaaagggttggaggagtggctggaatttctggtgaaagctcagaccttgtccagttcctcaaataccaacaatccagaggcccaatcaggatagtctcctgcagcaggcatgagggatgacaatggaggctgattggctcagaggaccctgtgctttgaaactaccttacaagtcctgggaggtctataccagaccttagagacctgacctccagagttccattatccaaacccatcagcctttcacacacaccctgccccagctcaaccttgctccgtgcatggttatcagactgatcagcatgtaagtatctgtcaatgatactgtcatagtcagggtttctattcctgcacaaaacatcatggccaagaagcaagttggggaggaaagggtttcttcagcttgcacttccacattgcagttcatcaccaaaggaagtcaggactggaactcacacagggcaggaacttggaagcaggagctgatgcagagactacgaagggtgctgcctactggcttgcttcccctggcttgctcaacttgctttcttatagaacccaaggctaccaacccagggatggcaccacccacaatggaccctcccactcttgatcactaattgagaaaatgccttacagctggatctcatggcggcatttcctcaagggaggctcctttctctgtgataactccagcttgtgtcaagatgacacatgaatgcagccggttcaaacactaaagcctttagcttgtccattatgaaagacattggtagcgggcattctaaaccacagaaagttagaaagaggtgtgcagaggtcctgttccccacatgaagcctgtctctgggaccagaccccactggagcttgctgccctccccctccttcctgcataccatgaaaagtcttcagggaagatccaaagcggtttctccaaaatggaagcagctactagagtcaacctcctcttccctcgcagcagtatcgtctatcatgaatccaggcattaaaataaagtaataatgttacagtgttagaatttccatcttcagctgaaagttaattgctgttatcctgaaggcaagagatgcagactcaaagccctccaagggcaaatagcattctgccatcttctgaggctgacattagctgcgctctctttagcatgaaaccatccatcatgcaaaagaacagggtgagtttttttttttcatgaaaccggctaagattgcatctgccagggtgggtctgtggagacatgcatcaaggaggccttgcatatgaattctcaccacaggccagagatgattcgataatttttgtaaaacagaatttaaatttttgctcttgtccatattttttataatagtcagcagaaaacggatttgaattctgccagaaaggaatggcttggcatttgaacggagcccagtggcacacattagcacaggaagctcattagaccctggggggcggggggaggggggatagtcagagtccctccgaagggcttcatctctgggatccaggaaatgttaatttttttttaaagcatccacatttcaacccagagggcaattgttcccttcacagatatgcagtgtaggaaacaaatagaaagtgtatactaatgtttgcccagccaaagcacaaagttagaagtcaaaatttgctctactaagagctgagagaagctttgtgcttcatttcggctgttggtgttaaactccaggttagtcaagggagtcggtacaaagggttagatgaccttaggaggcagcctaacagacgagccttcccggtcagtgcacctgaggccacccagtgcctatccgcctgtctgtggggtgtctgcaggctggattgagagtgacccctacagctgggcaactttgacagaagagatagccatgagtgaagtgggcaggccttatccttcagctgagttgtttactgccaatagaggttcctggagaagaaggggttccccttcagagcagcttattttaggaccccaagttccagcctcatatgtagactgtaggccctgcatatgaactcaacccttatccttaaaacaggtctttgggtctgtacctagattcacagggagataactgtacgactgcctgctttagggtactctagagactcagaactgatagaccgaacatgtattgtgaaatggctaatgaatcgttgcacctcgcattgctctgttctctaaagcagggcttcttaggctctctccatttgcaacccctttttccctaagaaatcatgtcacaatcccagatgtatacgcaaataaaacagatatacttgccaaacatcaactcgtaagaaatcataatgtgactcatggagcaggcagagagattttccttccctgcctgtcaggctccttagagttacagtccctgaatctccagacatggtctatgattgatggggctactgtcctgtacccagtatattcttatacatccctcagccatagcctgctcactacccaaaggcctccacacagggtcctcaagaagaataacacacacacacacatacacacacatgcatgcatacacacaaatgcacacacacacacacctgtgcacatacattcacatacacatgtacacacatatgcacatacagacacacatgcacacatgtgtacacacatgtgcatacacatgcacatacatatgcacatacagacacacatgtgcacatacacacgcatgcatgcatgcacacacacatgtacatgcacatacaccttcatgcacatatgcacatacatgcacatacacatgcacacacatatgcacatacagatacacacatgcacacacacacatgtacaaacacacatactaccactaccaccaccaccaccaccaccaccatcaccaccctgtaatccagatctatatatggtggtttgagcaatgaactgggacaggaggattaccacagatcatgggcaggcagggctacagaatgagactctatttcaaaataaaaagtaaaaagtgggacagggagactaggagagatggctcagccaggaagtgcgtgcttgcaagcacaaggcccgtgttcagtgtccagagtctatatataggggccagacatggtcatgcacacttgtaatcccagctgaggaagaaatgacaagtgggtccctgggctcgatggccagcctatgctatggagttataaagaggtgagacaagctgtctaggaagaagatgtggatgacaaacccgaggagcaacagtgtgccatggttctctggcctacacacatacctgtggagacacataaacacacacatgcatgtgcacacataaacacatatacatgtacacacacaaacacacatacatgtacgcacacgagcacacacaaagtaaaaagaaggctggggaaatattttaaatggtagggtgtttgcctggacttcacaggtcctaggctcaacatccagtcttgaataaaacatctgagaaagcaattcttatcaagacttcctctggcagagacccacagcctcacaggaggtggatagagaactcaaattgaagatctccattgggcccctccccttggaacttggagaaccccttggaagaagggaggaatgattgtaggatccagaagagccaagaactccaagagaacccatcccatagaatcaactcagcagggctcagaggggctcccgagactgaagcagtggtagcagaacctgcatggtctgccctaggtcctttgcatgtatgttatggttgtaggcttggtcttcctctgggacccctaacagtgagagcagcagagctgtctctgactcttttgcctgctctgggaccctttttccttttcctgggttgcctaacccagccctgatatgagattttcagcctcttcatactgcaacttgttatgctatgtttggttgatatccctcagaggcctgctcttttctgaagagaaacggaggacagcagatctgggaaagcggggaagtgagtgggtggggactgggaagaggggagggaggggaaactgtggtagaggtgtattgtatgagaggataaaagaaaaaaatatgggaaagggaagacagcttttgcacaactccaaccacattgtgttaccatggagacaaaggtcacagttactcagtgtgtggctattgctacatcttgcttattttagtaactttgtggacagagagtctagtttcttaacccaagttgaatattctgcttgtcgtacaaccagttttatatatgagcattcatcccgggaaacaggaatattatgcagaaaagctaaacaatatctgggtgttcttcactgccaccagatcctttgagggtgacagagatagaggcaaaaactctcaaggtccttggcttggggtatagttcagtcagagagctcttgtctagcagatgtgaggcctagacagcttccccgccactctgtgcatacatgctcacacacattctactgggtaccatttgagttgcatagtctagttgtgtgcttataattagtgtagacgtgttttataaaatgcgcccatgtaacctggacccactctcctccaaactgctggtgcaacctgcttcatccctcggtgtgacataagtggcctgaattgacacacctgtcctctagggggcgcctgagcccaacaggctgggtttcctgtctctgtaacttaggtaatatttccactgccagcctggagttcttctgaactcatctgtttgtaaaggacatggataactgccaggcaaatgagcaagcctcaccaccgcttcccagtcacatggcctgggccgtggaaagagcccagccgcgtggtaaggaagcacttgtctctacactgcaaacggaaagcctgtggctcagagaggagcagccgttcccttgcctcgcagtcacacagctcagctaccctgacatggctcacaagggtgaaactgtccccagatgcacagataggacagggaacatcaggccaggaaggcaagagtcccttattcaagcaggttgctgttagttccacagcctaattgggtttaggagatttaatgggtgggtcagctgcccttccccaaagttagcattctgtctaaaccccaccccacaattacctggcaacagctaggtgtgcctgacccacagttacctagcaacagccaggtgtgcctgatccacagttacctggcaacagccaggtgtgcctgacccactataaaggggctgcttgccccctcctccctctcttgctctattgttctcttgcttctctcttgccctcttgggctcttcccttccccattcccttccccctttctccatgtggccatggccagtctctactcctctgctctctccctctctctgcctctactaccctcttaactcccctccctatgccctgaataaacgctattctatactataccctcgtgtggctggtccctcaggggggagggatgccttggcatgggcccatagaacatattcttttcctctttatctttttataaacacatcacccagtcttctccaaagagcttctctcgggcctccagattacgaagggctacaggggtggcccttctttggtactgaattaaagatgatggtcacacacctacacaggacgtcttctgccaagcatgagatgaccaggagccagtcaggctgccatgagttcagagctgtcccacccatgtgggatttgggatttggaaagatcttgtctccagctcccgacccttccagggccactgaacaggcctgtgtgaggcctctgcctggcacctaggcactgctctgaacccactggctgatcctaagtgcgccttgctggtccctaggctcaggctcctcctctgagtaacagcttcaatgcaggcattgagtgagtgaattccacaaagtgctaggtctctggcaggtgttggttaagtatctgctgtgacaagattgctttactgcggttctctggggcttggtggctggctggtccctttgacctacctgtttccaacaagctccccaagtgctctgttccctttcctccacctgaccactccccacgctgggcagtgctcctcagggctctggagctctgcctggtagcacaggccttttctctaggtgggcacacccttccctgtttgccagagtgcttcctgttcctccagagaggcaggtaccttgtttccatgttggtttttgttgttgctgtttgttgttgtttgttgttgttgatttgttctgttttactaaataagtccgtaaatgagtggcaggaatcatgaaatgcttgacaatcaagattgacatttaataaactgcttccttctctgtggttatctacacagaccgcaacaacccctcttcaatattctgccatgccccactgtttggtttaatcgtcccaccacctcttccagccacctcaacacacagcacacccgaacttgatggactgaagaaacaaccaatgagctgtgctcacagcctctgtaggtcagggcttgggagcacagtgagcagatggcttgtttctgctccgtgctgtctgagctcagctgggaggactcagaagagggtgaccccaaggcagacttcctgaaaggcttgtcccctctcacagctggaagcatctcacgcagctgtcaggcacagggtgtgcacgtggctaccccacggtctgtctgggctgcctcaaacctggtggtcaggttccaaacataacagctcttctgagaaaggacaagcttggtggcattgctgtgatccagcctccgacatgcagggtctttgcaaggaggatgtagctcagtggtggagtgtttgtctcaagtgcagagacttgcatgatgatggaagaaattagaaagccttggcaaggttcaagggaggagacatatgctgcacccccacagcctgagtgccaagtcacacaggaagacaacagagtgagataggagatggtgttaggcctactgcaggaaacaaattaccatatcaactctaacttaaagtctgcttgtgagtgctaagaggcccaggggacttcagaggcttgctgaaaaccaccaaacatagttagatatcacacaaaaatttaaaaaaaaaattggaatagaagttaccaacccctgtagaaagcatgaacacagagactagtcagtgaatttcatatattggtcatcgagagccttccggtttttgttttgtcgacggaattgtgaagctatagttaaatggaaatagtgtgttttacaacttataaaacaataacagattgatggtggtaactggtatgaactggtttctctcatccagacacctctgccctaattttacacgaagtgcagcaacagggggtctggtgagcttgtacttggagctgtagatctttgttcgcatcaggttttcctcaggctgtactttctgtaagtcactcacctaatttcctcacagtctgtgaacaggaccagtcacactcagttgttcgctagagcactcagtgagacaacagaccagccccaagtcggttctatatacttcatgaagacctcaagaaaacggcaaatcacagaccaggggtgaaagcgaaatccagccctttcacaatcaaaatagaattataaatgtaattctgaaaggaaaaccggaaaactcaaatatgagcaccctcagaagtatttagatcaattttcttctatgtacatgtgttcggcatatacatatatgtgcacatattgaaatttgcacatggaagccagaagagtgcatcaggcctcctcctcttcccccctccccccctcctctaatgcttcccacttgattcccttgagactgagtctcactgaaccagaagctcactgttttgttttaactaagctggctggccagagaactctggagatccacccgacgccccgttctccaggtacctgtgatcacactaggccttgacatgatcagggaggcctcagactcaggctctcaagtttgcacacccagcaaactctccccagctttaatctgcatcttaacctaccatgatgcgtttggagtcccgactccgtaagcatgtgctaagcacgggttgcacacagaagcctatgcagcctgctgaggtgtgagctgttgacagactgtgtaaccaccctaccctctggtggctcgaggttttgtgggaggagaagataactgcactgtgcaccatggctccttaaaaataccaaagacaacaggaggcttgtcaaaaggtgacgttcagtttcacccaaagggctgaatcgcagccatcttgctaggggtaagagttgactccacagtgagacttgcttcacctcccctggtccctgggtcttgtgtttttttctttaaccagcagcgcagtaagctgctaagccatgaatggcccttcaaatactcaccaatggccctactagatagcctgctccacactcgcatctttctctgaaagtctctttggagtttgagtgtctggtctcctgtctacagatgcattgtatgcccacaaaccccatgcaggcgacatttcgtaaatcctttgccaatggtctaacagggcagccatgcctgccaccctgtgagaattctgctgtttctagaaatcagcagaaaccttggagggcggtaggggtttgttctcaatgtagctaggcagctctctgaagcccagattcattgacatctgcaggggagggatgctgggacacatctggttgctgacctgaagttctgatgcatggattgagttagggacctagcgttccaacatcctctaatgtcctgggtaccaagggtgacctgagcagctgtgagcattggatgtcactgtcctgagtgactctcttgcttaaaacaagtttacagtcgctccatcttaggttggactagcacctttttcttgtctttttatccttacttccaaatcccagaacctacatccctacacacacacacacacacacacacacggttcctaggtaaggaccagttagatgtatctagactgctgtggaaatatttgccttaggaagactggcaattggacagagtcacttgattctccaccttctccaccttccaaaggatgtgaaactccctgggagtcagctctgagtccgcctgtactctgctcacctttgtatgcatggtaggtgtccccggcttgtctgaataatcccctggtatggtttatctcatgaactggagacttagtgcgatccccatccactagtccctcccacacacccagagccaggctaatggagtcaaaagatccatgtgatagcaaggaacttgtgtccaaagaagcagcgtctacacagaggattcctgagtgacagaacggggaagcttccttgctggagtccggagcctactacttcgtgacaacaggcgtcctaggccctccagccagcacctgtggtctcagctccagcttcagtcccagaacacagagatccacctcaggcctagtcggggacaggttccagggctcaagttatccggtggttctgggcgatgccatttagacctctcttgccaggtcctgctcttcagattcctgaagcaataaagtccagagagcagcggtgcgggagcgtagggcggtgacgagcaaagccccgccccaccgctccgagggctgccctgccccctgggtccccgcgtgtcccccgccctcccagtggcgcgcgtttacctgctttcaagcactgggaggcggggcgggagcggggtgcgcgcccgtccccggagcagccgctgtcagtcaccgccgctgcgcgccagggaggaccagcctctggctcaggcggcctgagcttcacgaccccggaacatagtatccgcgccccagcgacccctagcccagcgttgggtcccatccgccgggatcccgggatcctgggcccctcttggcctccgagcagcagccagcaccggtaagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggcagtcctcgtgttctgatatggtttgttgtaaactctggtttttagggcttgtatgaaccgcgcgtacccggtttgggattttgaggtggtagtccagatccatgtttggaacgcggagcaaagcttggacaagggtttggttctccgaggttctccttgctgtttgctagctagacagctgccgatccacacaacatacgagagtggatctctgtgttggggaaactcttggaactggattgtgggagacaaacatcaggcagacatcatctttgcctacacacacacacacacacacacacacacacacacacacacacctagaacgactttttcagagaaagtgagttctcatttaagacctgtggtttgggagagtccgtctcgctaagttcaaagggccacccacccgctcactccccatggctctccccaatagagcttacctgccaacacctctggggtgggtgtgagcactcggggtcggggacaaggccatcccaggccaaagcacctgagaaccagaggcctgtagtgctctctcagacaactgtacaggtgcacaccagtccaggttggggtagccatccccagctagattctcagaaacccgaaagagaagatatgttttaaaataatcatgaatgtgagatgcaactcctacggatttaatgttctgaaacgactgctttttatcaacttgagatttaaaaaacaaaaaacctagtatgctcaaatccattttgtaaatccatttaatgcctgtttagatgtggagtgttggttctttgtggaaatggtgtgtgtgtgtgtgtgtgatttttttttttaagaaaaaaaaaagatgtgtgaatacggaaaaagaacctagccctgtctttcaaggatgttccagtttagactgattctggagtgctgaagctcattttctttcctcttccggttctttgtgattttaatctttagattacatttatttacatgtgtgtgtgtgtgtgtgtgtgtgtgtgtgtgtgaatatgtgtgcaggtcagaggatgacttgtaaagagtaagctttctttccacaatgtgggtttgtgggttgcaggggatcaaattcaggtcgttagccttggtggcaagtgatttacccactgacccatctcacaaacccctctccaggttcttccaaacaaagtcagcagctgcctccccaggagcaggtggcggtggctgacctcgcactaaacagcaggctccctgctgagagctgttaactactgcatttacagcttaacggccttgggagagctccctccttcctcccccctccccttcattacattagttgcctctcaggcacttggagactgaagagccacctggccccatttgaccccctcatggccacttgaaggtgcccccttcagatagagatatggctctgtggttaaagacaccttactgctctcggagaggatgtagttcagttcccagcacccacatcagttggctcacacctgcttacaactccagctcccaggaatccagcatcatcttctgtgactctgaggacatcagcgctcacaacatgcacgtaccctcatacatacatacatacatacatacatacatacattaccaaaaacaaaaatgtaagcccaccaccagtgaatgaccatgcctattaaagcatccagtctctgtctccaggtgacctgacacccaaccttgttgttatcccttccttggcttccattgctgtcattaaagaagaaaagtaggtgtccctgtgattcagcattacgttgaaaagccatggctttgcagagaggggctcttgctagtccttttgagtgcactaagggaagtctgcgagggagtaacacactggaaaagtccctgcgcctaccaggcagaaacgaagaactgctagaacattctcccaggaaggttctaactctttgtggaaatctgtgctgggaagactgtaaacaagaaacaaagtcagtagggcaggccagttagccacccaatctgatcctttcggaggcagtggctccaacacatgggagccctctacacttaggacagactgacaaagaggtagctggactccctgaggcacatccaggctgctgagctttcttttctgactttttctgctggctactcagaacacattgcatattctgaagccatcaggacgtctccccactcaggagatttaaagatgtggttctgtggttctgaaggttgtttggttttggactttgtaagcaaaaccgagaagttctaggggcagtattataaaaatgagaggcggggggagggagacagaaagaaaaggaaggaaaagaaaagaaagtcagtgggctgtgatatacctcagttggtagagcgcttgcttagcgtgcatcaggtcctgggttcgatgcccagcagtctgttaccccaacacttggaaaatgaagccaggaaggttagagttcaaggtcaacctctgccacatagagagtttcaggccagcgaacaacatgaggcatgagacccggcgccaataaacataaaataaaaagatgtctgaagaatggaatcaacagagtgagcgcaacatctgggacatgtgacactagatgtgtgactagacatctctaaggtctgagagatcagccccatacttaataaagtatgaaaagaactcaacccacagctactcaggggggaaagctaaagcggtgataagatacagtttcacattcctcatgccagtgaggagtctcaggtcctgactgcgccaagtgtgaaggaggatgtggagaaaggagactcgcattattgattagcgagagatcaacgttttactgaatgacctaggaaagctgatgttggatatgcccaaggcaggctcgaactcttggatctcctgaaggatatccagaatggagccccaaccccaaccctaacctttggaatgatgcataacactgtgtatatttagttgagacaatctgttaattttttctgtttggggataatagcagccctatggtgactgcaagacatcacatagagagttggagctggagtgagtggctctggctgtagcgctcagatggatggtgagttggccacaactccctgggctacatagtgagactctgtcagagatgaggggaggagaagagaaggtagaatgaagggagacagacagacagacagacagagacagagagatagaggggaaggaagtaagaagggaggggagaagggaaaagataacaatacagagctcactcatgcatacaaccctcaccttgtctccccagtgataacatcttccaaagtacagcacagaacacaaccacgcacttagctgtgacaccaactcagactgcaggctccaccagtttccacaccagcatccctatgcctgtctctgagtctgtgcatctagctgtgtcagtgtctctgtgtgtctcatgcctatgtctctgtgtgtttgtgtctgtgtgctttgtgactgtctatctgtcaggatatatgtgatgtcactgtgtagaacatctgactgctagcaacatcaaggatgaaccccagggccctctctgtgtggtgcctcacgctattcttcctaggtgcaggcaggcaacttcctctgttcccctccctcagggcaggctgccaggatgctgttcctccatttctctggtgctgtcatctctgtacaaacacatcgatgtggcacgtcctggggtcggcatttttctgcagttcgagttccgccagcacacaggtgcctgagcgctcgctcatgccgtggtttattctgtgtggttgctgtggccttcgtggtgcagaagctctgcctgccatccagcctccttgaaagactgcttgggtcctttcagcattctgaatcattctgagttattgcacacaaaactgctatgaacatccaccgtctgcttgtgtgaacgtcgttttcatacctctgggacaaacgcccaagagtgcggtcgctgaagctcatggtgacctgtttaattttataaggaatgggcatctcatttccaggatgctgtgacactacattccactcagcactgtcagagagaatggacctcacacacattcaggagagtcactggtttggggttttgtttgctattctgacatacaaatgggacagtccatggtggttttggcagtgtcagagatgaagtgtacgcatctgccactcacaactccttcagcaaaaaggctacttgtttcttcccctcacgattaaatccgatgggttgtttctaacactggctcgtttctgacagtttcaccaatgttttctcctcctccaggggactgctcagagagaaagttgcctctaatcaggacaagcattttggggaattccttctccctttggtggttggcagggtggggatttttgctcctttgttttgtttctgatgtaaagtcgtaaggcttattcacctagcagagtatggtggcatcttccttgaagcccggcacttgggatgcagaagcagaggatgtctgtgaattccaagcctgccagaggtacatagtgagaccttgtctccaaacaaacagaaaggaaagagaaaacagaagctggtggttccctacctgtctcaggcctagggaccctcctgcttctctttttctgtttcgttgacgggctttagtttctcctttcattcacactttagcttgcgatccatttttagtaacttttgtgtcaagtatgaagtttaagctgaggctttttgctattgtgcctttcgggtttaatgaaagaatattgggaaacataagccaggctgggtagtacatggctttaatcctactagttaggaggcagagacaggtggatctctctaagttacaggctaacctcttcttcataatcaagttccaggctagccagggctgcgcagtgaagccttgtctcagaaggaaaataaaagacaaacaaacgatgaagaaactgcttttgtttccttatcttgtctttggctagactcctgagtgctgtactgagtaggattgtcaggactggcctgaggacagcattctgtttcctttgattcattatttgtataaacagaaagtgtctaccccacagctgtgcacatccctctgccttacgtagggtgaggctacttggtgctctcgttcacactgcatagcagccctgcaagtgtgtggcccacctttgggagtgccaagcgacgaagcctatctagagacttttctgtgggatttgtttcccacctgctcttctgacctggaaacctgaaggtcgagaagtcaacacacacacacacacacacacacacacacacacacacacacattgggtcatcttccctccatatcaggggctgtattgtcatcctcaactctgagtatagcccctgctctgattacatccctgtcttctgatgaagaagggaccaacctgcccgcattgtgtttcttcccttgtgttgtctatagcctgcacacctttccctgaaaagtcttactaagtgcattgccctcagctttgtccctggcacattcttacacagtcctggagactgggctgggaatgcagtcttcgaacctctggactaactcaaaaaaggaaatgtacagacatggccctcgcgtctagctctgttcagcaggtctgaacaattccacgtgcacacaaacccatctcagtgtcattaagacaccctctgtgtatccctatcaagtggaatgtttgtagacgtgttgatggagagattgataaagtttatgctaacaatgtatgtgtatttttgacattcatttctgagtctctacccacacttagtcatatttcctacccatatgctgctgctgtgtctcgtgaggcatgctgtgggtaatcacatccctcgattcttcatgtgcttgaggtctacgtagagttgcgaggtaaaattacagagatgcactgagggtttccatctgtccagcagaggcacaggtcagctatcttctggacaccagagacggtgcagtgatctcaggctgcattgagggaaagtagatggagttcttgccttcgagggattgtggttttcttaagaaacttagaaggtcatgaatacgtttcctaacataaagtacctgctgacctccctgcagtgtgttcagaccaaccccacagggcctctgaagcagaaggactgcactggcttctcaggggccaaggctgctggcttagccacaggaccagccctcagtagacaccaactgatgataaactgtaggcacatgccctctcccctccatttactctccaggtctgttagcctcccagagtcccttggtgagcatcctcaagctcaggctgagacacctagttcattcctggcagacctggggtggcttcacttccctgctgcatttgaacggtggctctcatgcgatggaaatgtagctcagttggtgcagtgtttgccttaaatatgtgagattctattctcagtactgcagatattgtatggtgctacaggtctgtatcccagacctcagagatggaggcaggaggatcagaagttcaagaccatactctgtaactggcaacgacaaggccagccctgtatacaagatacatttgcccccaaaggacgagagattcaaccatctccctgcgccccacacacaccccattctggaatagtcaatgtattttagtcactgcaccatgtaccacaacagatctctggtgtgtgctgcataaacacgtggctttgctacagtatctggtttcaccctacatcgaatgcccagcaaaagcctgactatacagaaatcagatgtttaaacctgctttctgcctctagaagccagataaagggttggggcatggtttaaagtgttgcctgaaaagaccaggcccattaaatcaatgattaaaaaattcacagtggaggggaaaaaaatgttgttgtctttggttttgtggtggtgatggtagttgtgtgtgttgttgctgttttgttttgttttgttttgttttgttttgttttgtttttgagattggctctcatgtagtctaggttgacctcaaacccatttcggaggaacaggaatggtcttgacctcctgattctcttacctccaactctcaagtgctgggactataggcaagtgtaaccattctcttgtgtgcatgtttgcgtgtgtgcacgtgggtggtgggtagaaacagcatgtgtgtgggaatggggtgtacatgcattgtgtataggagggaaaggtgtgggggaggggttcttggggtgcctggggagggatggggagcagtactgctggttgtttttatttagtggtctgatgacataatagccttggggtgtcctgaagtatagtgtgaatgctcgctgaaactggaatacacaccctatttcggaaacaggcctgatgcatgcaccccatcatacgtcgctgtacgtggcagtgtttgaagcactgagctctaaaggggagatggtgggtcttaattacattatcatcttcatgtgtccagacctattgctgcagagagaaggatttaaagcagatgctaaaagccaggcctgtttgcttccaaactgcttgttgggagctgttatagatggggaggtagaacacagaaatgcagagatcatgataaggcctgcaagcaagattagatagataaataaatgacagagagagacaataggtagagagatagatgatacatagatagatagatagatagatagatagtatagatatagataattcatacatacatgcatgcatatatatacacatatacatacatacatacatacatacatacatacataccatagcagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagcacatgctcctggtctgggtaagagaaagtgactttagaatttcatttgcacttcttttcactcactggatgaagtacctgctgtatactatcacaattcagggtgctgaggacacctcaatgcataaagctaggacccactttgctgtcgtcccaatgaggtgacaagagagcaaaggcccggggtattatcatggagcagtagcacccagggtctggcgcggtaacacttgaggctgggtgtttgcaaggacctgtggtggcagaatctggcttggagaacttgctgagccttttagaacatccaaagtcgaatgaagcaagtctagaggcttcctgggacgcctgggtcttccctgcccttccttacgggacgggctgagctccagggcagcaggtacatgttctttctgctggcgcttcacctccctgctttcttggctgcctctggccctgatcacttggcagacactgtgacattgactgtcgttgtctctcaccttggacttggtgtccagcattgtgaatccggtgtcagcagctgacacggagcagacaactttgctgacacctcctcaggagatgctgtgcttctaaagatacccctgtccctgagcgctcgcatcaagttcacacctatcccgacagaaatcagagcacagcgtaggcgatgggagctgagccttcaggccgtgccccttaggaacagaacaggacacagcacggcctgcgtaaaaggcacattttgtcctttaaagctcactcttttcatggacgtgaggagcccagcacccgactttccatctcccccacacctggagcactttggtagctaaagaagactaaacatgagtggttggcacacgtcatctcagcacttgtgatgtggaggcaagagatcagcggttcaaggccaccctcagctatttagctagttcaaggccagacagggttaatgggccatatggagtccttttcaaaagtacaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacaactaagcaagcactcatgcacatggaatcgattttaaaagaccaacaacaaaaaaaaccctatttccttatctgttgacgtcttgtgatatccccccaccccgtgaaggaatgcagaagattgtcggtcgtgttacaatgaggcgtggaccgcaggcagaagcgacttctctaacttgctgtctcctttccttagtctcagactggcatccatgcagacccctctttctgtaacaccaagccccctgctgagtctgtgcacttgaacaaaagctctgaaggcagccttctgcacaggagtcaccagcagggcccaaggaggccacaggacacttctgcccagctctgccactcagtgtcagcaaacctcacacacatgtccatgcccaaagcacataggttacgtaagaaagagcctttccagaagttcagataatccagcttgtgataagcgaggccaaggtggggtccacccagagtcttctgcaacatgtctcactgtccctttaaaggtcattgccgcttgcagtattctgttggctggtgtgtagtgtgtgtgtgtgtgtgcatgcatatgtgtttgtgtgtgtacatacgtatgtgtgtgcatgcatatgtgtttgtgtgtgtacatacatatgtgtgtgcatgcatatgtgtttgtgtgtgtaatgcatatgtgtttgtgtgtgtgcatgcatatgtgtttgtgtgtatgtgcatgcatgtgtgtgtatgcatgtgtgtgtgcgtgggggggggcaaaggtcatcgagtgtgtttctccatctctgtcttctcatgtttggagacagagtccctctgagaacatgaagctcactgccccagcaggactggctagccggcaagcaccagggagcactctcatctttgcctacccaccattgggatcacaggtttgcagcaccacacgtagctatttcagtggattctgggactccacactcagactctcacgcttgtgcaggaagccctttacccactgagctgtctccccagcccgctctcagaagtctttatcattctgtcatatcttaggaagactagctcactaataaattgcatgcctttgtgaaaaggaagggctcttaggagacgggctaagccatctctcagaggtcaccgtgggttgacggcttctgattgcattcctttgcctgattatgatctgaaaggctctggaaagttccagagagtcctagaaggaagttattcagtaaaaatgctacctgtgcctgtaagaacatggcacccatcaggagatgggctccaggccaggactctcatgagactctggtgacgtcacagcacggcatagaccaacaactccgggatgctgtcatcttggtacagagaagataagtttgtgttcatcatggcccaaactctaggtcacctgaggtcacctgcaaattgtgaccagtgcatgaggcagcatatggctcccttcataagtcatgctaagcccctgggagtcacagtggggaggctgagctggaagagggcaaataccacagacaaacatagttctgttggttgtcactggtactccatgcccagggtgtgtgtgtgtgtgtgtgtgtgtgtgtgtgtgtgtgtgtcttctgtaattagcccaatgtgcttcagtcattaccagacttgtcatagcaatggtgtgactacccaccgtttggggagggagatgcccgaagataaagttggggctgacatggaagggagatgccaaaccagggccttattcatgtctctgtgcctgcattcattaccagcactccatggcaccaccaggaaatagagtgtgtcgcctgggcctctacagataaggagaaacaggcgccaagtccccagagcacatcaaggaaggtgggacccaaagggtgctgccctagcatgtctgttcctagagcctcgggtgtttcctctccagtaccatcccaaccggggtggggcagctgtacagcgcatgcttgggatacaaagcatacctgtgacccggcttcacggaagccagcggggtgggacattgcttcctcatgaccagttcagacaaacatgacttaggaaccagcagcgatggcaggggaagggtgcataactgcagatacctccctcggtgagtcgtccttcccaggagtcaggcccccaggggtgtgctgcctcagcctgtctggtctcacagacccagcagcttcctggtgaccctgttattttctcctggagagctcaatatcttcccataaaagctgcagaagttgagtgtcctttgtagatagacaaatacagagatctcaagctggagtctgtggagtgaagcgtgtgcttgcctcacagtcatagaagcctgagttctgtctccaaagcccatgggtgtgtggtgtgcacttgtgatggcagccctgaggaggtggagacaggcagatccttagggttcactgaagagtcagaccactctgatccctgagcccgaagtcctagggagagacccagtctctaaaaccaaggtggagagtgcctgaggcatgatggctgaagttgacctctgaccccccacgcagagatgcatgaacgtgcacacacgcgcttgaacatgtacacacactcctgcctgttgcatgtgtgcacatacacacacatagccctgtagctgacccagcctgagctggaggggactcctgtgcagtctctaatgagctccacactgggaagggtgtcctgagagcaagctggcagcctcaggaccagacgtctgctgattcactctggtgatagctcgccagaatcagccaatgctcttaagtgaccaactcaaggaatggaagggagtcaggtttccacagactccattttcctgcagttctggaacattcctccaaagtgaatttcaacaaccttcagacagtgctctgtgctgtagacatgcttaggcctcacaagtctcgaaaagacaggcttgcaatcaggcagatgaatgtgtccctgactccaaagcagaaatccccaggtccggaagaaaagacctagaaaagaagccattactgagacatatactcagctgggaggatgtaggcagaggatggaagagagccacataggaagcagctcaggcccatgtgcacacacacagacacacacacagacacacacacacacacacacacacgcacgcatacacacacacacacacacaaagacacacacacacacagagagagagagagagagagagagagagagagagagagtctgagtctgagtctgcacaggacggtgggagagagctagaaccagccagagaggtagggaggggacctgccctgtctgctgtttcccagtgataagcagtgtcacattctgctatggaggagaccccagtccaaagagccagaggcagggtaggtaaggaggaagactcagggagagaggagccaattgttcctaacaaggtggaagtgttgggacaggaacacaaggctacttagcccttaatgagtgcgggttcctgactctcacacaacagaggtgtggtgtgtgtacctgactggatggggatgctcatgagccaacagccagctgctacttcttggttaaagtcagtttaccttctgaagttccccctcctgccactgtgaaccagcccatcgtgtgtgtgtgtgtgtgtgtgtgtgtgtgtgtgtgtgtgctcgtatgtgtgcacacgtgtgtgtacatgtgggtatagtatatctgtgagtgtatgtccatgtgttctgagtgtatatagattatgcctgtgtaagtctgtgtgtatatgtatgaaggcatgtctttgtgtgtgtatatgtgagtgtgtacctgtgtatacgtgcatgcatgtatgaatgtatgtctatgtgcatccatatgtgtgactgtatgccttgtgtgtgcatgcctgcatacacgtgctgtttagctgccatcttggtgatgccgcttgctagctgtgtctgagctctaagcacaggctgttacaagaatgttggcaacggagcaatgatttcatgcgtgctgacaaaagagagtgaggcagaggagagggaggagacacagagagaggcaaagatggagcgagacaggctcagagaagacaccaagggctaagcctggccactcagagtctgtccccttgagatcttttatatcatgcatgtcccctgatctattgggtttcttccctgtctttctttaaaagtcaaggaagcagagtcacccactgctcccatgtgaggccatctgtgtccacattcagggtggggtttatttcatctgcaggagaacccagcatgttaaatgcggcacctgagaaactaccccacttagtccaggtcataatgtcagtctgtggtcctgggggctcttgggggcatgaataggagtctctgtaagaggctgtgggcctgctgaacctgatacacaggaagagttcctgctgcagagtctagcaggaaacctcctgtcctgcaaagggaagatgctagacttgtgaaatgttccctcttcagctcacattcccttagtcattcctgggacttcagtcttcattttcaagtaaactctacccaggttcttgtttggtttggtttggtttggtttggtttggtttggtttggtttggtttggtttggtttggtttggtttggtttttttgggtcgttttgttgttgttgtttttgttttgttttgtttttgtttgattggggtttggtttgtttgtttgtttgtttgtttgtttttgagacagggtttttctgtgtagccctggctgtcctggaactccctctgtagaccaggctgactttgaactcagaaatctgcctgcctctgcctcccaagtgctgggattaaaggcgtgtgccaccactgcccagccaggttttctttaagaagcctctgactcatgcagtctatactatcctttccttctttggaattcttccagatcggatgtctgcctcctcccaaacactacagcatccccatgtgtgtcacagttccaccactgacgctaaacggcctctaagaacatatggtctagggatagaaagcagagccactgggcagtggagatatctaaatctacaaagaaaggctggcaaccatgaacggctagtgataaagctcatgggctggctgttgagaatcaggtttcaaggacttgaaaaggcagagagaggaacccctttagagagattttaagcttttgccaatgtttactccccctttcctcagtcgcagatactgggatagttttagaaaaatctgtctcagtcagcaggctttgggattgagtatcctgtgcgtgttacagtccacaaatacagaaagacttgtttacttggtgactcattgaggcacagaacaaatgcttcctaagtgtttgctgaaagcagaaagccccttgccaggacatgaccacatgaaactgcaaggcatcctgggaaatggtctccacctgggctgctgtgttggcagataaccacaggtgtgattctctgtcttaaagaataaggaaagggtgggggctgggaagaaggtcctctccatgcatatatagcaagagctattattctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccacccatcttcttttatacacccttgccactacaccggcagtgatgcacaaacccctcaaaagtcacttccaagttttgagcctgacataagtagaaagaccatcgctccctcactctcctgagcatcacttcctgagccatgcactgggaaggggctggcagggctactgctgtaaagtttctcagtttcaaaggtttacggaaacgtgagggataaagcatactgtggcaaaaaataatccccgtagctccatggaaacgcctattttaggaccgcttccttgaacatgaactcaggaaaaaaaagaaaaacacattttgcaatcaacagcgtgtcatttaatgagagagagagagagagagagagagagagagagagagagccaaaagcacttgaaatctgtgaaatagtacagctgccatttatgtccagtgacgcacaagacacctatttccttcggcatgtgcaagtacaccctacacatgctaaagccacgagccctgattagcagcggacacagcagtacacatgagcagctcctggccattgtgtacttgatatctggacagcaactgtggtcactctttcacctgagtggcttctgggaggaggggaaggtggcatggatgccagtctgctataagtatgcctcagtgaggttcccatagagtccactttgccactatgattgtgttcatctcagagctttgaagagaaagaacacaaacccaaatcatggccaaattaactaaggcaggcaattaattcatgcaagtttgttattcgtgtatacaggctatcttactctaaaggcagagttcaagagatcaacactggaaatgagtaagataagaggttttatagttcatgagtacggggcttccaagtgggatatttggcaggtaaataggtggggttacaggagcagagcaagttggttataacaaggtggccataacaaggtagtcataagaacccttgggaacaaggacataactgtttcctggaagcggcagtacagaaccattggtagctaaggttacaggtggggtatagcccaatccttgagaaacagagatttactcattaagaggaataaacttagcttccctttaatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacccccatatcagttaagccaggctgtggggccactgagagggagacctgtgcccaggcatcaacatctcttctttccccctgcttcttcctcacttccccttcctcttccccttcctcttccaccattgttgctgttgctgctgctgttgcttttagggcttcagggttttcccttttgttttgtacttttgaaaaggactccatatggcccattaaccctgtctggccttgaactagctaaatagctgagggtggccttgaaccgctgatctcttgcctccacatcacaagtgctgagatgacgtgtgccaaccactcatgtttagtcttctttagctaccaaagtgctccaggtgtgggggagatggaaagtcgggtgctgggctcctcacgtccatgaaaagagtgagctttaaaggacaaaatgtgccttttacgcaggccgtgctgtgtcctgttctgttcctactttaagaatccaagtgacttggacgcctccttttgtttcgtttcctgggattgactgaggagcgagctctggagtgctcacatgtttaaatgaccctaaaatgatttcctggaagaatcaggtcacggactgaacaagtgtcactctacggaaggattggttaatcacgtggccagaacttgctttgatgggaatggctttggccaaatccctcagctctgcgcaccttttggaaaagaatagtatgtgtttgctgctgagactggggctaggaaatgaaaatgagaacttgcttgtctttattcaactttatcttccctgcaaattctgcacattccttggatagttgtataagaaacaacatccctctggcctcagccacccgtgatggccagcctctccaggaggagtcatgaacatctgtccatcaccttccacttggaaaattctacagaacatttctgatacctcagcttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagttagacagttgtcattctgttttctcgatctttcccctgagagcccaggaacaatatttgttggcaactttggatgtgtctcttaaactctcagggactactgtggatcatgggatttttgctgtggtcaaagccctccagaagtattggcttcgcagctgacaccttctcttctcttctagctcttgaacaccccattgggtcgccatgggaaaccactctggaaagagagaattatctgctgagaaggccagtaaggtaaggcttggctgaggcctactctccagccccggggcttagttcagttaaagtcgaagtggagctttaacaaggacagttcctgaatggctgggtggagactgggtccttgctgttgttattagacattgttgtaatttactcaggaggatcacctctcagtgggtccatccatcatggcctggaagcaagtgaagaaggagagggatggctcggcacacggtgggggtgggagggaaagaaagagggagatagggaagaggaagaggccccacctgtgatccactggactcatcctagactcagtattctcgggagagcagacactgtagggggtccctttgctctctcgaaagcatttatcattcagcattccttatttgtaatagtattcccaaacttcactatctccttaacctctctgttgaagctgtgaaccccattcataaatcagtaacaaacctcattccccgagttagcgcacctccctgctttgtagagcaaggccctgactttgggtttcgaagctgaacctgagtcttaggtgtggtcaaagggtggcaagcaggtgggctgcttcctctgcccagtgctggcagacctccgcctgctgaggtcagctgtgggaaatgtaggtagattccgggtctttccctcatgggatgggcaacatgtctcctggttcccacccagggtcttactctgccctgtctgtacctctcagagtcccccagtagtccacgtgaagatgcacagctgtgatatgcaaggctccttcctctaccacatatcccacacttataggacccaggattttccccagaatttgggtcatcccctctaccttcagagcctcacactgcccatgacgcacaggttgatgacagcccagccataggctggtaggttattggttttcagttctgtcccttccccataccttctacagcttgtcacacatgtttggaacatacagagtgaatcaatcaatcaatcaatcaatcaataaatattaaaatttagaaacatcccctcccttgtgcacaccagcttcctctccttggtgggtttctctgctcagtctttcctggtgaggtctgaccggtgatgccactgttatattctaagtgtctccacactcagcatcttcacatgaaccctacgcgaccacagagtactattgcctaaatttttgtccactctccgtcagtgaagaatcatttctgatcattaggagatacagccctagttacgttttaaaattgtgattaaaaacaatatgaccaaaacaacttacggaagccagggttcacttgggttatggttcgagagggatacgaatccaacatggtagggaagtgtggctgtaggcagcaggcatgtcagcaggaagtggatggtgaaagcccacgtcttgaacaaaagcacggagcagagaatgaaccggaaatggtgttggtcctttaaactctcaaagcctgcctccagtgacacctcctccagtgacataattcctccagcaaggccacatctaaccctatccaaacaaacagcaccaccaactggggaccaagggttcaatgccagtaccttgggggcatggttgttctcattcaaactaccacataccagtggatcagctttctgagccccacccctatcccactaccacctaactcatggaggaagaaaaactgctcaaattctttttatgtccaacataaaaaactgtgcctaccactatggacaaaagatgatgtgtgactgccacacagaagcacttttcaaaagtctgctgtccctttgctgcagcctggagagcatttattttatttattttttttatttattacatattttcctcaatgacatttccaatgctatcccaaaagtcccccataccctccccccaacttccctacccacccattctcatttttttttggccctggcattcccctgtactggggcatataaagtttgtgtgtccgatgggcctctctttccagtgatggccaactaggccatcttttgatacatatgtagctagagtcaagagctccgggggttagttcataatgttgttgcacctacagggttgcagatctctttagctccttggttactttcgctagctcctccattgggagccctgtgctccatccaatagctgactgtgagcatccacttatgtgtttgctaggcccctgcctagtctcaggacacatgctccactatgttcatagcagccttatttataatagccagaagctggaaagaacccagatgcccctcaacagaggaatggatacagaaaatgtggtacatttacacaatggagtactactcagctattaaaaagaatgaatttatgaaattcctaggcaaatggatggacctggagggcatcatcctgagcgaggtaacccaatcacaaaggaactcacacaatatgtactcactgataagtggatactagcccaaaacttagtatacccaagatataagatacaatttgccaaatgcatgaaactctagaagaatgaagaccaaagtgtggacactgtgccccttcttagaattgggaacaaaacacccatggaaggagttacagagacaaagtttggagctgcaacaaaaggatggaccatctagagactaccatatctagggatccaccccataatcagcttccaaacgctgacagcactgcatacactagcaagattttgctgaaaggacccagatatagctgtctcttgtgagcatttattttataacaacaaacagtaaagcctctttgactctggctgagattcaattttctacatcagccaggaagacaaccacacacaactttctagctcgtccctcacaggggggtgagaagctgggtgcttcacctgcaagtgttaggacttcacctgcaagtgtgaagccaggttatccagcttctcagccacgggtttataaacgtgtaaatgaccagccaatattgagtggagtggaggtgactcactaccctaacacagtgaaattaagctgatgatggctttgtggctgtggttgtctgtaatgctggagcctggcaggtttacacactgtgaggactatgctttggccaaggctgcttgattagcatctactctcaccaaaatcgaaactgttcacacagcgcccagccctcccacctctcagagagactgatttgaaaccccagcttcaaaaagcctccgtctccttcctgttgtctacactgtaaaacaacacagtgacagttaatgcttcttgctgtcaaaggaagatggcagctcccacatgaaaacctttcctggaccactgttctctgaaaactttcttttaaagctctgatgatttaaaagccacagagctttaaaactgtagtttccatatgtaaacgctctttccccactaaacgtgggctttttgttgctcttgagaacccaagggaaagatcctttgcttcagggccctgaactgtactctggggctagggagggccccgcggggagaatttgcccccattcattatccacccactgatctggagccacaaactgggactggcccagggaactgcaggctcctttctcccttgaggaattcccctcctcctacactgaggtacaggggcaacctagcgagccttccctgtctctccttacaacttctgccacacagctgaatgcagacagccttctcagtttgactctgaatgtccacaaagtagaggagacgccctcaattctgtgtcttcaaggcttgagcaccccacccactacagcaggaccctcaggtgcctggcagataaagcctggttagcattcttctgttacagggaggcccttctctctgacacttcagagagttggctttgttggtcaagaagcatccctggttgccaggcagtggtggtgcatgcctttaatcccagcatttgggagacaggagcaggcagatttctgagttcaaggccagcctggtctacagaggtcaaagagaaaccctgtctcgaaaaacaaaacaaaacaaaacaaaacaaaacaaaacaaaacaaaacaaaagagtccctggcctcttctctatgcaccatgctcaagttaccaggcaaggttttcacagagggaaacagtctaagaatgtcatcaccatcgtcttctcctgctgaggaagacttctaggaagtggcggacggtcaagtgtgccatgctgtaatactggcagtccttagctggccctgtgctagggaatccaggtcctgccagccagctgaagaggatggtgctggagtcccaaaggggaagagaggccactagttgggggtgggggaactgggctcctgagtcatgatgccgtctcatagactgggtatcagttcctccaagtacttttcctactttcagagagagggaagtccccatcttctggggctccttctcggtcataaacagctgtccctcactaatttgcaagattttttaccaatctgtccattctacgctcagtgtccatctgtgctatcacaatttggaaaaccagggaaggaaatgacttcaactgccctaggtagttcaggtgatgcactgaagtatctgactgatgtttagagaaccacactcatgacagcttctgggggtgagggagaaattgcttccaggagctaaaagcagcccctgccagtgatggatgccctgtgcccagccgtcctgggtgttaagactttgagcccttccactggggattgccatagttagtagagttcatgaaggtttcaagccactgactccttgggaggacgcacattctcagaacggtgggcattggtctcttcccccccgaccttagtttgctctttggagcttttgtgatagccatgcctcccactgatggcccagtgagtgtccaagacccaccaagtggcttcaaatgcagcacgggtgctaatgtgcacctctttggggcagccaggccttctctggactgacccggaggtggccatgctgaaactcaatagagaagcccagccctctgggactatttttattctcacaggtcacaggatggatgtctggggcctagcagtccatagggtgggtcttctgtcaggctgtgtaggctgcatcttctccatgtgtcctcccatggtcctctgtatgtagctatgtctaacttcccctcctcgtattgaagcaaggcccacgctaagagctgaaacttaactgatggtgcccatctttgaagggcccatctttcaatagttattttctgaggtgctgggagttaatatttcagtggatggatttgggaatagacaattcaggtctcaacataagtactacttgataagccctggtaaccactgggtagtagagagattagcaaaaagcacactctaggtctagcttggcacttggcttcagcatctgagccttcatccgggaagctatcaattcctcctgttagacagatgccaccgcacagcctaatttatcatcctgtctctctgcaaaaagacccaaccacagtgtaggctctaccatacaagacacctcaagcactggcctaacccacagggcctgcaggctcctacatattatcttcttgacatcccctggctagacatggaacttgtcattcctaagtggctatcttccttcaaagtccagatatctaccgtggctttggattagtgcactcatgcattttttttcatgtacccacagtgtcttcttaaacacccagggaatgcttggcactgctgcactcaggtgaaaatctcagctcatgtcaccagctgcttagatgacattgggctacagccaccttgggaccatgaagttatactctgaatggaagaacagtgacacaggggtcctcactctctaacaaggtccagtgaaggtcactgcattcagaggtgtaacaggaatgcaagaaggcactggtgctgctcagctcttatcaagttgacaggccagagaatcacctgaggagaagggacctcagctgaggaattgccttggtcagataggcctgtgagagattgtcttgactaatgggtgatatgggaggacccagtccactgtgggcggcaccatccactaggcagatgatcctgggctgtatagcaaagctaggtgtacacaaactagtaagcaatctagcaaatagtgtttctccatggcttctgcttcagtttcttcttgagttccttctctgacttccatcagtcatgggttgtcacctggaagtcaatctgcagcaagctgttttctcatcccccttgcaatatggccagaaggttcgatcacatcagcagaaggcaaacagagtgctgcagagtgggaccacagagcaaggccaaaggagccttgggccttagagaagagatgaggcacctttgtggatctgagggttgggcagagaccagaactttctgaggcctgggccaagtgtcttaaaatattggaaaagaaaagaaaagaaaagaaaagaagagaagagaagagaagagaagagaagagaagagaagagaagagaagagaaaagaaaaggagaggttttggtgctcacaacagcaacctttcccacaaacctcttcagagcactggagtccttggagtctgtgactcatctaacatctcccccgtaccagcttcctagacagggagagcccatgtccttaaagatcctggctctgtagttcatcatgacactgtcatagaggattctgggaacctggatccattttaaggattgctgttattgaggtggctagcatcttcacaccctggaatctctatttttttccatagtgccaggtagagggagtgcttatccctcagtacatactgctgaggagacagcctgaagggcatctatccccacagctcagccgcacctcggaggggcctggagacatgaataccattgttttttatagcccagaccagcatcttgcaaagaagaggggtcaccctgtgaagtgcagtgggcagattcatcactagagacagtcaatagataaaggggggtgtgagaaagaggccatgggccaggtaagacagcatgctatccttcagccacctacctctgccttcaagagaggagcccgctgcttagccacactgagcatagccctccgaagccgatggcaccgttatcagagctcagggtattctctctcaacagttcaccagttttgctctgttggtgagaagtcactggaaagttctggaatagttctggcctctgtctgggtccaccctcagccttctttgtggcctcccttcccacccacctgaaagactgggtttcatgccattctggaactttccttggacattaaaatcctctcatattggccttcgggcgaagaagtttttggtcctttccctggggtaaccccacctttagcaaataatccgcataatttaatccttgtcacaaccctgctagctctccctcattgagaccgatattaaagagacattctgagaaatgagacacttagtttgcaaatataggcagagttgtcagaagcaacacaaagcttgccactgagatgaaagaaacagtgtttccctctgacagggaaaatctgtttccatgagaacgctggcatcccagctgtaaggggtgtgcgactgctcccggggcctctctgcttgcagcttctcgctgttcagaggatgtgctgccagatctatagcttttcagtaagctgttccttccctcaagcctgcctctggaataagaagtggtgagactggtgagactctaaccagcttggctcaccctgctctgcccagcctgctctccacacacacacacacacacacacacacacacacacacacacacacacacacacgttccactcaggcagagcagccatgctgtcaacagccccgggtcatgctggtgtctaggcatgctggatggccaaccaaacactatagccaagctgtctggagtcttccaggaggtgctgtgcctcaccactccctgtcaggtggctactggtgacaccagatgacacagtgctaggagggtggggactctccatcctcagtgctcagaggacactgggaaaggagtcagaacttacaggctttgttcttctttcctgcttacaccctcgctcttcccctaccacagaacaggggcaggaaaagtgcccagacgatgcccacacactcacctgaagacacccacagcatggtgagaagactatgcttggtagacaccagtttcgatggggaattttacctttccatttgacggcagtgtgtgggtgggggcttatgccctgtgtgggcagaatagggatcgagccactgtgtgggcaaggttagagccatgcatgtggaacctccatcttttaggtaactcacctaaacactgtgttttgagaactcaggcaattccaagttaccacaaaatggatgagagctttggggctagaaggcacagattaggtgacacacatgtggaagtgccaggcagtgcccacagggttcctggtaaacaccttcttggttgtgttgagtcacaaatgtttttcctctgtggtgaattcagagcaaaaggcttttcccacagcttcatgttcaaagaatgaccacagggtggattctggtgtcctttgcaggtgttctgcttatctgacagctggggaacacagacacctttgtaaactaagggtggccacaggtctcagctatgaagtgtaattattaacaacaggctgtgtaattagnnnnnnnnnnnnnnnnnnnnattatagccaagctgtcaggagtgttccagaaggtgctgtgccacaccacaccctgtcaggtagctataggtgacaccagaaggcacagtgtgaggagggcagggactctccgtcttcacgctttctctctgagctctccctgtagactccatgctcagcagagtcaggtgtgtgagtcttgggatgacatcaaaatccggaagagttctgagctccagcttgggcctggggccttagagggttgaaggctgagaaaaccccagggcactcagagcccagggaagataacatctgttgtttcactcaccttataggatatggctggctggctggctggctggctggctggctggctggctggctggctgcttttgtctagctgataatgtggttggttttgtttgattggttggttggttggttgattggttgattggttaaatgattggttggttggatggttggttggttggttgatcggttaattggttggttggttggatggttagatggatggttggttggttggttaattggttggctgattcattagttttgggtcgttgatttgttttatttctttggttacttgtctcagtagctgacaaatttttgttgattggttggttggctaattggttggtttagagttgattttcattagtttattggctaattgatatcataaagttttttattattgttgttagaaactaacacagtttgtaagcacctgtcacaaaacttccagggcacagcagttgttgaatacaaatagtctgtttggcactggatgctaagtgtgaatgccatagacttagcagcagtgtaaaacagaaacaactggatgtgctccagcgtcctctgtgccctcctgggtcctccccactggggagccttggggaacagaagaatgtagctgatatccaagaacccaggacccaaagctctgagggttccccatgctcaccggcaggagccccgagaagaggcagacatggacgccagaaatacagcagtcatcagagatggaacgcccacccagatggggccgggtgtctggtgccttatgaagcagggcaatgaaggtagagagcattaagtctatgaggaactgatgtaaaaaatcgttacccattcaaactcgggttcacacctgactgacagcaggactgcaagacagacagagcaggcgtccatttagaccacttggtgacttcccagaatgccaccatgccagttcaggaaggtgggcggggcttggccttctgtcatggcggaatatgcactgcccccttcaaatgccacagggtcagaagggtgtggctgaatgcaagctgtttccatggcaactgtcctgctcccctgtccctttgcttgtgaacctcacttattgtcctatgtcaagaaagcccagaaataccaccgatgactggactgttgaggccgtgtttacttcagactctgaaagtgtagaatgtgtccttcctaaggtggtttctatcctcagcagcctgctttgtaaagctttacccttggactcaagagggacttttgaaagatgaattttattatttttaaatgtgtgtgtgtttgtgtgtgtgtgtgtgtgtgtgtgtgtgtgtgtgcgcgcgcacacgagtacatgagtgcgggtgccacagatgtcagaggtcttggatcccctggagctggagtcacaggcagttatgagcctcctgatgtaggggctgggaactgacctttgatcattcccaagagcggagcacaccctcaagtcctgagccattctctttccagtttcagaagcaagagttttaatgtggcaggatgcacttgtggaaaagggtctctcatttataaatattgtatatgtaatggagatgatggtgagaagtcacatgcgttctggacatatgtgatggtgtgaatgtctgtgtttatgtgtggagcatgtgtctgcctgtgtgtgtgaatgatctgaactacatgtgtgtatgtgtgtgtgtttgtgatgtgtgctatgtgtttatgtacatgctgtatgcatatgtgtgtatatgtgtatgctgtatgtgcatgtatatgcaaacatgagtgctatgtatgtatgctatgtgtgtgtatgtgtgtgtgtgtgtgtgtgtgtgtgtatgtgtgtgtgtgcgcgcgctatgttgctgtgattccccctcacagacgccagccctgaaccatcacactctgcagggaaggcttcttatactcagttcacagttctgcatctgggtggctcaaacctgcctccctattgcaatctgatacctctgctaatctaagaatcaagcttttaagatgtaatcatcatcagttgcggagaaagttcaactttatgcttctgcctctggtacttggaacagagtcctcattatttaatgtctcctaattatactccgtaagccctgagcaaccacacacaccttagtaaataaacaaggccggccccaagtgtgcaaacagcctgtggtgatataggatccctgccacatagattattcaccctgtacctgttcataactgtactgagcacgtgactgagaacctctcaggtgaatgggggtagggcaaagccgagctagggagtgttgagaggccatttcctctctggcaatccccatgagcagagaaaagagctactctgagctctctctcccctagcctggtgctgagctctcgttcccgaagcttcttgttgcttgctccctggcctttgccctgtgctgggggcctctgcctacactaagtagcagaattccataatataaaatacaatggtctcactctgggttcttccagggtgggaagagatgacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcacacactcagtggtatagacagggcacagttcctcatcctgccccaactccaccaggagaaggtcctgtcatggctccaggttgcacttttagcctttgccatttactttcatcactcaagactccgtttgttttgtttaattaccagaaggtcacagtgaccgggagagcaattgcatttacactttttagataacatgaattaaagcaattggaggtggagttcgatgcgttcgaagtagattatttcgtgtgtttccaaaggaaatctggcatggggctcttggttctccggagagagtgctgcttttgaggaggtcttccgaaacccgtgagttcttctccttccatgctggaatccacagtacctcaccactctgaggaaggacagcccagccccgccctcccagtcaacacctcaacgttcacaagacagccactgagcacgcagcacctaggatcaaaccccatggaaggaactgagtgcaacatcttttaaggtccggcttaaaagcctcgttccacaactagctcagaagaacccatgtgtgtgcttcctgggtcggtgtcatatgacctgtgcacaggggtagaaagctctagaaggtttttggacctttacaacttggatcttctggtaaccacgttgtggtttgatttctatcaccacgtgtaaagcaagaggcatctggagcacaggcgccttccacggagtgcatttttgcaaagaactccacactcagatgctgtcgagggaggagctggccttaattgatcttggtgattggcagctccatgctgtgcgcaggatattctccacccacagtccatccttcccaaagctcaagtgattgactgtgccctggattgtgtggacctgaggccagccagctgtgttataccccagccctcccagcaagcttaagaaggcttgctactccccatgacttgccctgaggcccaggaccacaaagagatggctttgaaggatgccctgctgagatagaatggaagatccatttcacaacctgggtgtggttctttgaggcaaaagggcagagtgcagccgcaatgacaaaacccagggagtttctctctggctccgtctttaatctcattgcactgatgagttctttctgtgtctttctgatctttcctgagctgctttgattgtcatctagcaacggtgcctacctcgactgtaccgggtttgcccacgtgagctgcttgctctgcaagatccgggaagattctgcatattgaagatccacatatattcagggagacatctgcactcttgatatgttagtgttttgttttaaacagagataggccttatctcaagcacaggacttgacttaaagccgttaagtgggggaccgctaagaaacataggggaatgttcctattgaataggaagataaccaaaacagttacgtattacacaaaacctaaagcatttgccttccaaaagatagcaaaggtttctgtcaccttattctgttgctaaaaggtgcctcctttttaattaaatcaatattcttctgtaacctactttgttagttaccattctgggttatgtaagggcatcggcacgcaagtatataaaatgctttgagccccctgtcctctggtgtgtcaccaaccctcttctgttcatccgcttcacttcctagacagttttgttttgtgccatccctatagctctgtgtatctacataaaattgtgtatctacataaaatatagggcccacgagagagagaatgtgtgtggtgtttggttttctgaggctgactcgattcacttagtgatgagtttgtcttaggctcctgttagtcatgaaactcactgggcactaaactgcagttgacagcaccgggctgagcagacacatccctctctcttccaccctcctgaagggaccatcctgctcacttactggaccagctggggtgtagcaggagcaaccaggaataaacagcaaggtatctgcgctcctaaaatagaagccagtttgtccagttgcgtaacagacctcaatgagcagtttcagtgccactctgagtaatgtttatcctgctgtgacttcccaaagccggtgcttaaacaaaatcccctagcacatttctttgcattcattatttaaagacctctgcactcttaatcacatcccaaagagatctcccgaccgctgtactgtcaagctaaggtattacaggactaagctaaggaggtgttgccactggaaagtggcttcagagatgcgtgagaccagactgctgcacacagtgcaccaaagctctcacttggggcaaacctgcaaacagtttaatgggtgtggggacatttttcctctaatcttctttttctagtgctagggcgtggaacctggtgcctctcatgctagacaagagctcatcagtgagctgtactccagctctataaggtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctctctctttatcagctctctctccttcccttcttccatctctccctcctctctctcctgactaaagttccattgcttagatatcttatgttctaattacatgctcataggttgatgggtatatagaatgcttcctccgtgaagttattataaataatgcttccatggatatttacatacaggtgtttaggataaacttgtatttcatttctctcaagaatacacctaggaatacagtatataattcattgttcacctgtgtttaactttctgagaaattgccagaactttccacagcagctgtaccattcaagcagatgcagaactggtctgaggatcccctattacatcctacagccagttccgattggaccgtttgatgtgtgctgcatttatatccaagggtcccatcacatgtgcccagggctggttctgagggccccatatgaaatgcccaccagctgggcctagggatgcagtttcacccacactcacagccttcctagtgtgtgagatgggggtctcactgtggctttgatgtgcatggtggagaggtaaggatattgaacatctttcatagtctactggtcagcttctctgagaaaacgccctccaccatctttttaaattagactttgtgtttgttgttgacctatggaagttgttactctataaatacttgatacataccagataaaagatttccaaggacttttcccattatatgcactttcttttactttcttgtgtacggtgtgcatgtgtgtgatgtatgtgtgtatgtgtgtgtatatgtttgtgtgtgaatgtgaatgtgtgtatatgtgtgtgtgtatgtgagtgtttgtgtgtacatgtatatgaggggtgtgtgtgtatgtgaatgtgtgtatatgtgtgtgtatgtgagtgtttgtgtgtacatgtatatgaggggtgtgtgtgtgtatgtgtgtgtgtgtatgtgagtgtttgtgtgtacatgtatatgaggggtgtgtgtgtgtgtgtgtaagggtgccgtgacatacaagtggaagtcagggggatgttttcagggtgcaggcctccctttccaccctggaacccagaaatcagactcctgttggctgagccccactagctcactactcaccacccccagccagttcccttggtgcccatcctaactcaaagtagagtcagaaaaaggacagaatctgctttagagaaaataaaacctggtctggtggtacaagcttgtgacgcgggcatttgtggagctgtgagcagcaagagttgcaggtcaccctcagccctacatggcctttgaggtcagcctggaatacatgggaccctgtcaagaaagaaagaagggggcggtgaacaggaatattttcaaacttttatttattcatttatttatttttgtagttttttgactagcacacacaggaccttttcttgtgctgattcttcagcagtttaacgactttggccccattgtcaccagatttaaatttaaaaatagacaggaatctttccatcacatagtaacccagcaggcgcgcgcatatccgctgcaaacgtgggctgtggaaggtgctgcccttgtctgtgtcacatggggctcaaggagcagcggaggcccagaggtgccttcgaggacactggagagagaatgtggaccgtgtacgtgaaggagaaaggcagagggcaagaaaggccacattccactggacctccatgtgtcccggaagtgagggagggcccagcttccagtctccgatcccaggcgctgagaatggacattaaagtgtgttcaccacagtggagacaaatgtggccttaggctgcgtgccctgctgtgccatcattactgacacctccgttcctggatttgtcataggctcacctgaagggctcagctgcccttcaacctgagggccccagggtggcagctctttgatgacgtctcttctcagctgagcagtactaggtcattgtcatttgtctgtgatgtcttgcctggtcactttggacacctctctgctgattcccgcactgaagccgggactgggtgctgggaatggcaggttttctccagggctgtgtagtgtgtgacctccttgggcattgagtcccaaatctgtggctctgccggtttcagcgacggccctgggcctctgactcacgggcagactcaccgagtctcctttctgggaaaactgtggcagggtgccctggcatggcccaggttccacagccccgtggctgagcacatgtcagagtccctagctctcagccacagggaagaccaggagccaagaggtctgacatgaggtttgtgcttgagggctacagcccacccctagttccagtccgggtaccaagtgacgactggagtagagataacaggatctgacaagcagaacctactcgacaaaaggaggaggggagggaaagaggaatgagtgccacaccatgcttacccagggccagcagatggtccctgcttatatacttgccagaggacagcatccacatcgccttatcccagatgtcgagaggaggggtgcaaagctcataagctctgacagatagtcttcttatattttaaagtttattcttccccttcccccgctctcctgaaaattcttttttctttttcttttttgacacttaggtctatttgtacactgtttacagacaggatctcgtgtagccctgaactggctgcatgtttagccattaaacatctgacccctccccccgcccgcctttacctcctcggtctgagattacagcaccacactcatctgtgtggggctgtggatcaaacacactgcttcatgcaagggaggcaagcgctctaccgactgagctaaatttccagccctcttgtttctgaagtggtgttgccaaggcatgtagccaagctaggcttgtctgctggctagctgtgtggtcctctgtccagacaccagggtctctaagtgcatgcccctgccttgaatgccagatctgcgttgggtattaggcatagatgcttcagggtagccaaggtcttgggcgtcctctatggaggggaggagctaacttctgtctataacctgttccttaatgatccattaggttttaaagagattttaaaactctcaaactccattcttacatgtgctttctgagttaggtggtctgtggccatgattcagagcacagctctgttctcctaagtggtctctgagtgagtcagaacactgtaacatcttcctctcccagagcctcttctgttacctcccagaactttatacagtacatattaaggtatcttctgaccattcgcatccccaatgcttgtcaccaccagaccattaatcctcccgaaatgccaggtaaaccacctgccgcttgtgagtgagtagacccagaaacgctgttggtgagtagatgcatgaatgtatgtacacaggtatgtgtttctatgtgcacacctacgcagtatgctaatggctatgtccactagatgaatgactgaatggcaggtgaccctcctctgggatggtgtgtcacccaggtgcctggacactgattacttcggagcacatacatcactaggtgcctggtcctgagtcacaccaggattcctcctccactgcattcagcctaaatctggctcggcagctccagtctggggtctcaagaaggcccgccacgggcatcaggtctgaggaagacaaagaagaaggtggggatgaagctgggagccctcgggcctcttctctcaggcctcatgcaaggctccctgacattggaaaggtcaaaggccacaggagtttctctttcctgtttatctcagagatgaggtggattgctggctcctgataagttagaatcatagaaattccttggtgctgaagtcactgctttcctctctccgccatctttggctgtgtgggccagcatttgtctgaggagaaagggtgagaaaaggaaggggggaaaaaagaaaaaaaaaaataaaggacactgaggtacaagaggttaagtccatgcctaaggtaacaaagataacaaagatgtgtctaagtcgttgtacacctaggctaggaccgggggcttgttatctcaatggctgcctgcctgccgctccacctcccacagaccccatgcgaagaaagaaaaatgaaactgtgtatccgacctgggctaaagggtcttaggaacggagggactgaccaatggtgcagactagtatggaggcacaggtgctgtgccctggtggccgatgacaaccacacagggacctgggtgctgagtctgggaagggtggcagcctattctcttggctgcagtttccctgcccagaggtgctgcggctgtgagaagccacccagagttggcgtacaaccagttatgactaaaatcaccatctggaaatgaccagcagggtctccaggcagcccagggactcactttctgaggactgcagggagacaggagttggggcaggattcagtgctacaccagcaccaggctgggtctgaattccatatgctctctgaatatggcacattaaaattaaccagtgaggtgattgcacgcacataaggaaacagaacactagctgctccctacatttgtgaattaactatacggtaagcatttaaactcaaacacaaaagctcagaagccacgcaaggtagtgtacttctatgatctgccgcttagggggcagaggtgggaggggccgcaagctcaagacttgcctggcaagttccagtccagccagagctgaagagtgaaactttgtctcaaagtaatttcaagtatcgcaaagtaatggtggtgtctgcttgtaatctctgtgctagagacgtggcgacaggcgatccgcagggcttgctgatcagcccagttagcttaatcagcaagcttccagccagggagagattctgtctcagagagcgaggtggatgcttcctgagggcctcatgtacacccatgcaaacacattttttaaaaaaagtaaaataaaataaattaaaacataactatgctttattttcagccgaagcccaaagagcaggcaggaaatgtccccttgctcccatcacagagtgccctggggaataccaggcacctagtggggggcagccagccctcccacagtgggctattccttccctcacaggaacacaatgttgaggtttggtattttgctacttattgtaatactaaatactagcccctaaagtctgggctcctcaccaatgaggaactcctcatcaagggatgctatgtaaccttgcttcttaatttaaaactattggttgaataaacatacctacagcctatgactgggcagaagagaggtaggcggggtgtcagttcctaggcttggggtctgaggcaggacctccaccagaagagaagagagagaaggaggagagaggagaagatggcatggggtagatgaatcttgaaaacatggccatgaaggctgcccagtcaaagtaagagcagcccaggtggggcatggcaagccctaccccagtgtgattgatgaggaagtaggcactgagagctttgagggtagatattgtggccagctctggtgctttaaaggctcatcataaatataaaggtttgtgtcttttctctgggaactgaatggtctaaggtggggtagaagcccctgactgagattaactgttaccacaacaaagcatcactgggtgttagtgttggttttgtccccagagtcctgattggcttctgaatagcctcagtttgaattcaaaggaatatggtcctatgtcaagtctgcctctgtaagccctctgaaatctaagagtgacccgacaggcagcctgtcttgtctgcttgcaggcaggaattgcttggctactatattctactcaggctgacactgaaaccctttcctgtgaaagcgtctgcagggatggagccagagcacatgtgagtgctacggcagagcaaaggagtcccggagctgagccccagcgcccactgaagacactgtatccaaatgtatctgaatgtgtctaactgtgtttgtttgtgtgttttttttttcaggatggagagattcaccgaggagaggctggaaagaagagaagcgtgggcaagctttctcagacggcctcagaggacagtgatgtgtttggtatgtagcagctaaaaggggaaaggcccccatcatgtttggcctgtgagcccacgcattcttactggggaagttgtatttcagaggcctgggtccatccatgtttttgtggggtttgttattgttgcttctggttttgttttgtttggtcctgtgtgtttccggatgtgaacacaagcttgcacgtggcacagtgcctgtggagaagccaaaggacatcctgagtgtgagtctttacctcgtgccttatatgaaacaaggtatcttgttcactactgcttacaccaggctaattcatctatgaacttccagagagcagtctccacctccgtctccttcccttggcacaggaattacagatgtgcactgctgcacttggttctacatggattctagggagccaaactcatgactcacgtgtgtagccagtcattctacccactgggctatctctctgtcttcatttgtaaacacgcctgggcaggggtgtggcaatcactgccctccgggagaccctctctcgcgtgacctagggccctgttccattttgtgttcatttttgctccctgtagccctcgggttcctcgaagtctccctccctccatgccagtgtgtgggaacaccagcgagccccacattgttgaaagcacgctgatgggggagcaagcctgccaaagcctgtgtacttgggctgcctggagacagtgactcagctgttgttggaataactgtggtctatgaaacactccgttctgctgcctcatgggcacacacctccctccctgcacacgggttttgcttcttcctatcagagcacccacatctgattttttgaggagtgcagttatctaacgccctaggggcactgctgtgtcttgtcctcccttcgggagacgtgagaacggaagtgtaactgggagcctgccttcgtggtaagaacccactgtcccaaaaggacacagcagccaggccctgccactgcagggatcatggcccaggtcactcaaagccagtgcccttagccacactccctaacccccacttacccatgcaaaggtctctcttcacactttaccccactaggcagcaacatctaccctgctgtcttgttattgttcgtgcttattaatttgtttcttcaaaatgtctttcttttgtgctttgtccttcctgagcagatatctgggctgaaaagcctctgagatcaatgtgacccccaggactgaaaaccatgaccagggtctggaagtacagtggctggcaggccagtgggggaggggctctccggtttctttggctgtgtccatttccacaggaattttccgagggcatttctgtctttaggaagtggggtgttcattttttttttcctggtgctggtattttatttctttgtgtacattaggccatgaattcatatggaatgggctccaacagctcaggctcttttccgttagtcctcacaaagtgtgcttctctgggtggtgcaggctggcgcttcagctgcacccaggtgcccttctctttggcttcctttttcttctggtcattctccttcacccgcttcaggaagctgtctctgctctttgagtgcttgatgtgctcaatccacacattgatcctcttggccagaatttttcccttaacctgcttgttgacaatgatgcccacggcatgctgggtgacattgtagactcgtccggttttgccgtggtagcacttatggggcattcctttttgaacagtgcccattcccttgatgtctacaatatcacccttcttgtagattcgcatgtatgtggccaaaggaacaacgccatgtttcctaaaaggcctagagaacatgtaccgggtgcctctcctctttccctttgtgtttgtcattttggcgagttactggaagatggctgtggcgccattttttttagtggtggaggggaaagtaaaagatagtagttgtggctgcctgacagcaaggtacacagtttaaagtattcagggcaaggcatggcacagagcctgatgcctgcctgtactgtgtttaggatggtacggagtctgctgagaccctttacttgtgttttctaagtatgtccatagaagtaacacacatctatatacacagaggagtatcgggtaccaaagggaaggcataatatatacgctcagatttgcgttttctttaagcaagtgtcatctttagtattagttatgatattttgttatgctagaggttgaattcaggagttgaacacatgtttaagtgactgctctaccaccgagctgtggcactagtcccaattaaccgatttttaatttacttataatgatagcagcccttgtgtaacattgtgcatatgcgtatatgtgtgtgtacacacatacaaaatgtatgtaatgcacaaaccatgtcttacaagaggcctctgtgagcatcctcctctgatagtataaacactctgattcctgaagctgtctcccctgaagccaccttcaccctgactgaaggtagaacaatgcagaagttgcgggtctctccacaacatggtggctagtgcttgttcctgaggtctgggacacagatatactcgcgcccgtggcatgaaggcacctcagagctcttgcagtgtagacgcagtaggatccgagtcaccctcacacatgcacaactcatactggtgctggtgagtcagagcccaggggtgtgtaaggaacctgctacctgcagatgtcctaggctcactcaaccctgagtcagggaggctgggccccaaggactccccagcaatccacagcagcagcccaaagatccggtgagctgccgaagccctgcccttgatcttaataacctggcctcctggccctctctgggatttacatgggttccaggctaaagacgaaaagtgacacacgaagaaagagaactccagtgatcctggctgacttttctgttttggttggttggtttagtttggttggggcttttttggttttgttgctgttttattgttgtcattggtggtggtggtggtggtagtggtggtggtggtggtggtggtggtggtggtggtgtgtgtgtgtatatatgcagaggtgtaggtcagaggagggcaatttttggaagctgaatctctttcccaacgtgtgggtcccaggaattgaattcaggttgctgggcttcgtattaactgtaatcctgagccatccctccagcctgaacatggaccatagacctaggaaatatatcagagaattctttataaactgatactggttcagacgtggttccagatgaaaccagccccctccgcttcataagggcttctctggtcgtccagggggctcatagcattccagaaaagcaagcccccttgacaaattcactgcattttgtgaatatggagtcaactgcagccctactgtggtcatctctaaactctcagatatcgtttcatttctgtgtcagaggacaggcgaaggatgtcgaaagtagtgagacctgtctcctgtagccagcacgttcttacaggatgcacataccctaggatattggacatcacggggtcggaagagaaatactattaccattaaaacaatgctcttggatgggatgaactggacagctggagagaagtttgtaggcagggttgactgggcacaagtgctacctctgatggctctaagtcccaagctaatgcaaggaacgaactcacttcctcagtgcctcttccagtccagaggcaatcctgcatgcaagctttgagaccttacgttaacgggtaaaataccactgaaaggttgcctcggtctcaggggagtgtctcatcaggcacagtgttaagtctctccattctcttcctctgtcggcactgtggttacacctcaggcctggttgcctggatacacaggaggaaggaaatgttgccgcacggtagcctagggaaccatggtgaccccattgaccccattttgaggaaccagagtatttttcagctggccaggttttaaactttgttgagccacacacccacactgcacaaaccatcctgccatttgaaggctgtggaggagaaaggcaacaggccccacccgtttccttcagagctctcaaaacagggtggctcccgggcaggtcctcctaaagatgagcaactctagtaatatataccatccaccagaagagggcgccactgctctgcacgagtgtccggttccttctagacagtccaggattgagacacactgcttgatgtatgcgcaagctgcggaggtttgacaggtggtccaggcaaggatggctgaatagcagggtcacctcttccttccactgctgtcctagttcatgtgtctgtcaggcgcacaggtgaggccaaatcttatggaaagttaccagaaggtacaggtgatggagacggacctgcaggtgttcagtgttggtggaaaacatgttcatcagaaatgtttgcatgcacttgtctctgttgcccacggcttgagtgggtctaaggcggcacacaggaagcaatagattaaccaaagacaatgaggtctagatcacataaagatgcagctatgacaaccgtgattgctgtggtggggtttaagtgtgagatgtggccaacgacatggcaagtcagatgtcttgtgtcacacgggatgtggcagagctgtgcgatttttgcctcctgcttctttggctcctcggatgtgaggaggggggcaggacagaacctctgtgaatggtaaagtgtccacaggtgcacagtcaggagtgtgtggctatgtcagctcctgattttatttatttctttatttaggtttctggcatttttagtttttattaattttatgcatatggtcattcgcctgcatgcatatatgtgcaccatgtgtatgcctggcgcctgaggagatcagaagaggacctaggatgccctggaactgcagttatggatggttgtgagccaccatgtaggtgctgggaaccaaacctcaggccctctacaagagcaacaagcactcttaaccactaagccatcttcccagccctgtttattttgggttttgagacaagatcttcctctgttgctcaggataaccaagaactcactacaatcctccgtcctcatcctcccgagagctatgcttcctggtgtgtcccatacagttacagccatccctatagttacaaagggttttacacagccattttaaaggatgcaaagttgcgtttaacaaattctaagaattttctagctcacatttttattagagatgacagttacatggtggtcatgaaccacaaactgtcctgttgactggcttctttatttgggataaccttctgtcaaagcctcagccgtctgtcaacagacctgatccgacccaaagacggagagttggacagacaaagctggaccttgctgaggcaggacttggatgggtatggcatagggatgcaggctcccatgccagaataaaacccagagttagggaggcagtgctcccagaagctgaagccttctcagtccctgtccaactagaggtgggtggcaggtcccaggcaaaggacaagagaaggttgcctacaagctgagaagcatcatctggttcacttgccagcttacactttacgctgttcccgttcacttcctgtcagaggtgcccacttccatcctaacagcaagggcgtcagtgagagagagattaggcaatctggttgccatggacacccttgtaatcctgatactcaggaggcggaggcagtgagaaccctgcttacagacaagcacatcacaaacccagagctcagccatgtttgggcatgttgcaggtccgtcagcatttctgctgccctccactacccatagttggggacacatgcccatcttgcatggttcatgggctagagaagaactaaacagcagttgcagcaagtatagtcactggcatcccagaacgtcctatagagttgtcatctatgacaaacgctgtgaacatttgcagccttgagtcttgcagatactatggctggaaaacaggtggttttttttgctattgttgcctttcaagtagcagatgagcattctgttgttgagaggccacctcagcaagaggaggtgcagaagccaggaagcctttgcaaagagagatgggaagaaaaggactgtgccatcaccaagtacctgaccaagtacctcccttccaagagaagacaagcctctggctgaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaagtctctctctagctgacagagccaggctgttcttacacatttagcatccattcctgagagagggagtccctaggtgctccccagagcaccctcaccccaagccatcctaattgactcagctgtttaatttgccttattagtgaggacaaattgagctgggtttgcaggtgtgaaatctttcttgcatgcgtgtgggcccctcccgcctcctgccctactctgggctctttatctgggcccttgatcatgtgttattttaaccaacttctaagtggagtcttggtgtcggagtgaacttgcccagaactcaccaagaccagagaacatactctgtatgtaggattttcagtctttattttttttctctatatttttaaaataaatactgtgctgtgtttatttcattactttacaaaggtatacttaattactagatcagaggatttaaattaattggtgggttaaaggatatactccaactatctgacagactattttaggttctggcctgtttaaccactgaagttttataaggctccaacagtccagactaatactcgtttgaaaacagctcactctccgaagtagtcaaatttgagagcatagaactccagccctctggaagcattaaagacccagaaatagccggtttctggcgtaatcacgttttcctggtgcccagcaccagggtctcatcagagtgacctgctccaggggacctcctgtgagaaccctgtctccgccacacattgtctgcgctcctaggtgttcctcagaaaaccctctgtgaccttttaacccttacaccctgcatggtctgtctccagctcaagctgtagccacttgtagccactgaagctccaccacaggaagtggcctgtgtctaggtgcctgatcttgtgtcagcgcacctctagagggcactgtacaagcaggctaacctcctcctcaacaccagcatccatccatgaggggagcccctgcaagtctcagctcagtgttccttcttcgtgacccaccctgaactgagacacaacctgtcaggactcctcaatccgagaggctcaggaccccagatgctcctgtgttccagctcagagggcagaacagagtgtctggtaagacagacagtggaagggtggtccatcagctggaggagctacctccaagcatggtggcatccatcactttcttcctggtcctctgaccagaagtgtcagacagtcctgttattagacgcgttctcacgaccggccaggaagaacacaacaaccagaatcttctacggcaaagctttattgcttatatctttatcgggccagagtgtaagaagcaagagagggaagcaagagagcgcaagaagcaagagagagaaaacgaaaaccccttccctcttttaaagagaacaaccattgcctagggcgcatcactccctgattggctgcagcccatggccgagctgacgttcacgggaaaaacagagtacaagtggtcgtaaatacccttggctcatgcgcagattatttgtttaccaacttagaacacaggatgtcagcgccatcttgtgacggcgaatgtgggggcggcttcccacagttccccctttttcttttaataagagcaaataggccacccatattaatgagagtggagatagaggtcaaatccccagtgtgtaggtaaaggagccatgtacaggattagctcttaggctcacaggcttttacccagagcaaccctgacctgctcccgtgtcgttttgcctgggggaagggaactaggacactgaaccttcatgaaagatgacatgtcctcccctagaataggctcatatatgccgcagagcnnnnnnnnnnnnnnnnnnnnccctcccctcccctcccctcccttctcttctcttctcttctcttctcttctcttctcttctcttctctgagacagggtttttctgtagccttggccctggctaacctagaacttgctatgtcgacaaggctggcctcaatctcacagaaatccgcctgcctgtgcctcccgcgtgctgggattaaagcatgtgccacgatgccatgcctgccctaggagaagctttttcaatactaagagcaggataggacggcccagctctgctccctgctccctgcttccctctgatacctcctctctcaaacatcgcctcccttgggcacagcctctgcggacttctgaaatccaccaacttcctcattctgtatctcttagggcctaggctgtcgtgtgtgcatctgtggtgtgtacacgtatgttgagtgcaaaccagtgcacacacacacgtgggtttggcatgtacctatctatgggtgtgtgcatgtgtgcagcatgtgcacacagatgtgtgtgtatgtgtgtgtgtatgtgtgtgtgcgcgtgtgagcaccctagagagccccaccttagaaatgcccccaagtcactttgggtcagcagagccacaataggacagggagcagttgtgagaacaaagagggatacagtctcccaagcacaaatagcagatgtgatgggctgtggccagttgggtagcaatgtgtggtgcctgcagcccaggaatgctgagagccttccctgcacaaggcccatcccagacatcttgtacccagcaccagggtcctcttgagtatgttaagtaccttgggtgtgatcgtaattcagaaacacctgagtttggtcttcaacagtaaacagggccgtttcacattgcctctcctttgtctgaagagttggtatgtcctgtaagctcacactctttcagttaacccttcagcttatacaaatgcactgtgtgggccattgccagcgtgagagcgggggatgtcgcccatttccaagggaggatcgttaagggaatgagtgtctcttctctcagggccacgttcacatcaacatctcacacgtaagaaataatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcattgtacatggctctggctttcataaaaacaatttctttcaaacacgctgttctctttgaccacactcatccccatccccatcccccctctcctattgctttcctcactggcctccttcgtctccccagtccctcttgtactttcacgtcattcatattatatggagagatggatgggtagatggatgggcagatagatagatacatagatagatacagaggtagatagttacataatacatactgagatacatacatagatacagaggtagatacagagatagatacagagatagatacatacatacataatacatactgagatacatatatacagagaaacatagataaaaatattcaatagataaatagatacatacatacatacatacatagtctaaaattgagaaaaacattcaatatctgtcttgtctgcttttttagtaatatgatcgtcaattatacccattttctagcaagcaacataatttcattctctttaatacctaaaattccattgtgcatatatagcatgttttctttcatcaatcatctgtcaatgggcacctaggctgctcccataactcagctattagaaatagtgaggcagtaagcatcatcacataagctcatctgtggtacattacacatacacacacacacacacacacacactcacacacacacacacacatccacacacacatacattcatacacactctctcacacacacacacacacacctctaggggtggcatttctgagtcttggcagctctacatccagtttgtaaggaccccccccaccacacacacacacacacacacacacacacactggtttccatagtgacggaactggctttcatccccaccaccacacaccacagcccaagcttctctacctcagcagtcaacatcaggtttgttgttgtttatattcttgatgctggctggtctagcgaagcacttttgatctgcatttctctgatgactaaggatgttgaacattttttatgtttgttggctattcgaacttcattttgggaaaccactagagaaaatagtttggtataaacataagcaacgcctttgtggctctcagctccgtgaggttctgccctgcttccctccttccctgcctctcctcattccctcctgggtttcggagctattccacctcccctgggcccttctaaggctctccagtgaccctgggggtgggaattaaatatgagttatgtcagagcacgggctaagatgatcacacattcatcttctgattcagaaataattgtcattaatttaacttataaaattaaaatgaaaatcaactgcatctttaagaatacctcacttgccaagtgactgtatggatggatgtctctgtctctctctctgtctctctctctctctccccccagtaccccccacagttagctcagtctgacatagggccccttatgtagataggatgactttgaacttctgatcctcttgccttcagctccaagtactaggacttcaggagtgtgccaccacgtgtggttgatgtagtgttggggatcacactcaggggggcttcatgcatggtgggcaaacactgtaccaactaggctacaccccaaagctacaaagtttgaacaatgtcaatggcttctcctcttggcatcttacactagaaatcatgagtgtgtattccagggtggtgttggcctccagctactgacattctgtgtagtggttgacattacctacaggcacaaaggccactgtcccgtgcctggagacactgaacagggagggtatcgccatcagctgtcttgttcagctctgccacgggagcacaagcacagcagacagccctaggactaaacagctgtgactggtccaatccgcttctgtttataagtgctggaaactgtgcgccccatgctttttacaggtcgcaaatgctcttttacttgtttagtcattgaagaaggcagagtacattcttagcttgtaagctcagcaaacagaggtccgggccaggtgtggtgcaggacagggtacacctgtcaccggggagtccggtgcccttgctgactgacctaatgacaagtgacggggaggggctgccctgttgctgtcttccttctactaggtgctttgtcgacaggacagatgcttcagcccctggaaagagcttgttctagcaaattctccaccaatacaatggttcagggagaggggaggtgagtattttctggcacaaaatatcaaagctgtgtttggagtcatgcatgtgtaaggccaggtacaagaggttaaggacggaaggccgttgaagcagagttgaggcttacttacactgcagagtgagttcaaagacagcctggacaaatgaatgaaatataatataataaaatacagtacagtacagtctggtacggcagcaatgaagcccagtgtttgagcgcttgcctctcctcatgcttcaggccccaggtcttatctccaacactgggtgtagtgagagttctgggattttgatttctttaaaaatcacagaaacagtataagaatgttgctttcattttagtcccaggtgtggggctgcttcagattgtccgcagcagctgactgcactgcgattcgcctcgtgctctagcggaggcagggttttgccaacagcagatagtgtctgtgactgtgtgacatctggaattctgggaactttccagagagtatataaatgctagggccctgagaggcgttggtggtggttggtggtcgttcaaggggagttggatgtggtttgttagtagtcctgctcaaagaagaaacaagatatctagtgatggaggtcaaactggagggagaaaggatgggagaaagaagaacccacaatgtagcaaagaccagctacaactggattttaaaggataagcattagaggccatggcattctgcagggattcctgagctgtgcacatccagtggcgctgccctaacacctgtttattctaggcctcttgctgtcagatattctttctcagaaacttgctgtagacctaggtgtacctctgttagctcagagtcgatggatccgtgacctgacagatcttggcttcttgccttacctcactggggcctggagtttggacctgtttgctatcggtgcctgtctcaggaggatccagccccaagggtctacaaagcaggctcagggtctacttacagtggtaaaggcaatagcatttccttcttctggtggccctgctccctcatttcctattgtatcagagctgtttcctaatgaagacatccatgctgggtgtctgtcactgacagaagcacttgttgaaataccctgcagaaaacaacttcttatgacagtggtcatcttatttgctcagtatttagtgagcatctacttactatttgcacaccactccagtaagagaggggaacaaacttctaaaggactcggggtagtgatgtgtgtgagcgagcagacaaaacacagaccctgagggtgcccataggacaggcctcataggtcggatgagtgaagtcaaacaaacaacaccggagtctgaggaagagaagacaaccacgtgcacggttccatctcactgaagctgtggctccatgccgcctgtcctcagctgatcatcacctgggagaacaatgcccagacagataaacaagggaaatgagtccttggactcagagtcccctgcacctcagaacctctgaggggcctggggatgcagaatcatcttcctaccacttagccagagagcaggaaggaagatggttgaggcaggttcaaggcttccttgcactgcagagtgagttcaaagccagcctgaacaaattaatgaactacagtaatacaatgtagtacagtacagaactacacaggaaagattagcttctcactacacgcagtggcccagcattgcaggaagtggagcagggaatgctgggagagcaaggacatgggaggcgtggggcacagccatggaaggcagcagatatagaagcagaagtcccctgaagcctgatgtgagatggagaggcctgagcaaggaagagcccatgtcccacggagaaggacttaacaggagggagcagggaaaggttaagaagggagagccagcatgcatgctggcatggcactcagaggagacctgctgaggctccctgtccccagcatcgtttcagtgggaggcagatgactgacatcagtggtgataaggagtgacaaggaaggaagggtgacaaggcccatcccatgggctctgtcagtggaaactgggagactgttggtcaggaacctcttagctccctggagctctcagcagggcccacaagtcgcaggcacgcagtcaggacagcactgagttgcaagtccagattcatatgctcacaagccacagcctcccaggagtctggagggctgaatggagtgagtcctggtcaccttcaacttctggtgttgctgacaacacatggcgtccctggacttatggttgcagttgatgttgcctagggtccgtagtggtcccttctttgtgcatgagtttctttcatctcacaaggaaatacccatttgactggcatccatccgaatccagtgaaagttcctctttacctaataacatcttctcagaccctatttccaaagtcacattgaccggtggacaagcatggttctgggggtgctgtcaccctagggtagcactgtatgtcccaatgaaggtgggggaacagaggtatacactggatctgttgacttccttgaaggaagtcgaatgatgcacagtcatgggggaagtgggtgcctggagcctgacaaaagaagtctcttcagtccaccataaaagacagttgaagaaggatgtggactgggattgtacttttatttatggtgacagtgactaccgggatagtggtggtgggtcttaagtaggacatggaagacaaaaggacctttggagcctagggatgggggttgggattgtgccatctcagaccggatgctatcctggggccacacaatccaggcctcagtctttctgtgggactgaaagccagaacttttggtagattttggagatgtaaaagtaatgacacttgaagaggcaaagaaaaagaagatgtaaaagtgtggccaggtggtgggccaagcagtgtgtgtgtgtgtgtgcatggattaggtggtaggctagcgaatggatgcatggggagatagataatggatggaggataggtagatgatagatagatagatagatagatagatagacagacagacagtggatggatgggaaagatagataatggatgaataataggcagataatagatagatagatagatagatagatagatagatagatagatagatagacagtggatggatggatgggaaagatagataatggatgaataataggcagataatagatagatagatagatagatagatagatagatagatagatagacagacagacagacagacagtggatggatggatgggaaagatagataatggatgaataataggcagataatagatagatagatagatagatagatagatagatagatagatagacagacagacagacagtggatgggtggatgggaaagatagataatggatgaataataggcagataatagatagatagatagatagatagatagatagatagatagatagatgatagtggtggatggatggatggatggatggattggattggatggatggatggatggatggatgggcagatagatggacannnnnnnnnnnnnnnnnnnnnnnnnnnnnnnnnnnnnnnnnnnnnnnnnnnnnnnnnnnngacagatgggtggagtggataagtggtagatggggtaaatacatatcaaggataagaatttttatgaccaaatgctctaatgacttatcaaaacaagactatgaggaagccctggatactcaggcaattttgcagatgaggtcgccaagccttaaagacatgaaatcacttgttgtaggtagtggagctgagaactcagccctggcttattccaggcccctggctcatatgttcatattcagttgaattttctcctggtgtgtgctgtgaactggctctgtaaaatgctgacaagatctgggaatcaccttcagctgtgggctacctgggacgtagcttttgctgttgggggggtggcgggggacactgctctgtatctgcggattagtacagagctgctgtgtcacccatattaggagaaactgtgtgactatggggctccgttttaccactcatgtctacactggctgcagtagggtagctggatggtggctctgaccctccttgggcaaagcaacctcttactcagcaagactcaggctggccaagtatgtgggtaggctgggagaaatacactccagcgcttgcctgaggctctcccgttattgtgacccctttctcgatgtgggagggtccctgagtgagctatttagagtacataaaaactatatgttccgagcacacaaaagaggcattcggtgtgtggtgggtgggttgacaagattcgtttgtggaagtccttgaagctatcgccgcgggcagcctggccggcagccacatgcctttcatagatgcagaatttctgtcatagcaagtccacaggctacaccatgggcctttttgtttcctgtgccctcccaggtgaccccaagcccaggctgccagcggcagaagtattccatgaacaaggaaggtcctctctagccgggcccacacgcccagattccatagctcctctgcaggcctaggctgcctctcaagtaggtcaagtggttaagggcctataggggtccccactcccctcttctccaggtaggagccaggttagatctggggcatctgtgtgcctgcagcttgccccaaaccacatacctcatggtttccatcaatggctgggtgccacttaaccctgacctggccccagacctcctccttcatctggtgacagtatccgggagtccagcaaaagccctgctgcccaggtctgctgtatccatattccaaggggatagaccctgcaggtccctacccctgtaaatcacctgccagcctcgcagccggcaccctcgcacccacccacgcttaatggatatggagacattgagccacgcgtcttcttggctagagagctctgagcagcctctcccgagctggccagactggcagtctacagattatccgcttatctgtacagctgctgcaactaaaattcccacagattggagcaaacaattgagctttagagggaccccagaggaagttgtcctggcttccctcacatcgttggagtcctgtatcctccacattagtgtcctgtatcctaacacacacacacagacagacagacagacagacagacagatagatagagacaggacaggacagacagacagacagacatgtgtgtatgttttcctggggccacaataacagtgtctggtgttttgaaagcagctaaaatcttagctaacttttctttgcctgagtaccatctctacctcccaagtattcctcacctataaagaaaattcaaaagacctcaagaagaccccagggattacttccactgcagccaagtggccaggcgcaaggacgggcttggggaggggctggggtgcagattctcattgttcttcctatgctgaggcagagggtcaggtaagaggaggctggcaacaggcctgtatgctaatgcgcaccacacagtagggatctttagcgtgtcacctgaccaaaatcacgaaaggaaggcgcatgctgtaaaccacgagttcagaaaccaaatctcaagtggatagtgacacagtctccgtgttacagatttcgcaggaaatgtctccctaatcttagttagcaagtaggaactggtctgaacagttagttctaaagcagcatgctcgggcatgtttagatagctggctgtaatttgaccatacttcctgaagtggtcctagctagatgccaaaatcactccaactgtcccatggaatccagctgttgattgtgaccctgtgatgatcataaccagatgaagcagccctcgttgggcaaaggcggtgggctccaaaggcagctgatcctgtccaaggtctaccatgtggtatcccatacccacattgcctacgatttaggtttccttcacctgtgcttgtgcacggagccatggagcagaatctgcctttccagaagtggagggggaaggagaatgcacaccccccgcctacgtccccggcttctaaactcatcctctgggaacccagaaccccatgtttgtgtttacactttttcacctcccacatttccttagagcgagagtccagactgtcggccctgagaagatatctggaaggacgtttggggtgtctgagaaagcaaacagttgtgggttgtggttttgatggatgtgacagatggagcagatgaagcactcactaagcccctgactcaccgaagacaacagtgttatcttaggatgaccgtgagtgagacagaccctcatgctgaactgcagccgacgctcgaggaccttagacattccagatgagactggtggccctcccgtcccgtttgcaagtacagcatggtgttgcacatttcaactcagtgacttaccaaggacactttgtgggcaggaggacaaggtcagccccagaggtgacccctatgggcctctggagacccccagaaggagcatatagctgtgtgaagatgtctgctctctgttactcccatgttctgctttgcatataacatgccacctcccacatgcaggctgaggacttgtcaaactccagcaccatgcaatggtttgttttccatgaagctctggtgctgaattcattatcttggtacttgggagccctcatgaatgattatatctactaagccttctgcgtagccacaaaggattacgtaattgatgttgatttacatagctgattgtgttggttacaaaattggtgttgatttctaaagcagacccagtcaatggtgagtttagcgagtttcaaccttttgagagaaattcacacttcaaaaggacccgttggctggagatgatggtgtgaatctgtaatcccagattccttagaatcataaattctaagctacagctacatagagaaactttgtctcaaaaataaaggacttggagttggggaaatggctttatagataagatgctggttatggcttgaattcagaagcccagagcgcatagaaagcctgacataatagcataacataatctgaaacagagtgtaagggccccgtggagggatggagggtgaggaccggagaatcccccaaagcctgctaacctggtgtagaaagcagtcagcaaaagaccctgtctcaaggtagaaggtgagagccaccatccaagattctcttcatacacacgcccagagacatgctatgcctgacaaacacccacacacatcataaacacccacacaaagctttttaacataagaataataataaaatagtaataataatagtcagaggagcagtgagaagtgaccctgaactgctcactgagcacaaagaagtcacctccagacaagcatggctgtctgaagacatgatgggtaggctggccacagtgagctttggtgcgaactcttacgtgtggtccatgtggtaccctgttgaggaacaagaggaaaagcaggtggggagcctgtcctctgtgtggaggatacagaggagaggagaggagaggacccaggagctgccagcctagtgctgacatagccctcgatcactcagtaagttggtacatggtggactcctgtgctaagtcctgagggatacatcaataggtcgaaaactctgacacagggtgtgggagtgggatgcaaagaacaggaggagaaatggggaggagggagaagaggatgaagaaagggtagagggagaaatagaagagaaggaagaagagaaggaagagatccgtggctgtcatcacacggaaaagactctgaagaagagttaacggacacaatagaaccctgaacatggagataactggacagaaagccaaggacacatagaagatgggctactgtgatgtttagctggtcaactcagcaaaagatgagcctcctggagtcatggccccagagatctttaaatggtaaaaaccacctcagatgtcagggccctgtgcgcttctgtgctccgagagctacttaaagtccctggcatccctggatgcctcagaagagagagttcttcccttttacccctctgacggccaggctgtcttctgacctacgctttctaggccttagctgtagactgaagtttttttaagaaatattctctgtgcccattttggtaagatgagttgtgggtgtgtcactaaggatgacacagatcctttctgtaaatgaggtctgaatggaaggcctccgggcttaacttgaccaaggcagcattcctgtgtgcatcccaccgcagggcaggccgtgggtggcagatttagactccttaccacacttcttgcaggaagggaggagccactttggagacacagaggcctctctgtatctcacaaataactgtattcaaaggacacaaagcccaactgttgtaaaaatattagtattcagatgcgcttgtgttttgttaatgcatttaattcctcacagtatagctgttgtcttctctcctcatctgcgttcgtttctgacagctacagaatttatagcgcaactccagaaccaggctcctaggcgctcctgcccggcctccacctgtaagtcagcactgtatccctgcaaactccacctttccacagcacctcagagtgccacgtgtgcctttccagcactgtacagtgacagggtcctgctgagcccagccagtggccatgaggaacagtgccagcaaacatctccgcccactcagtcttgccctttccttaggcaccctgaactgagtggccctatttccacattgcccgtcatgatggcacacatcacccaatagaggcctggaggagaccacagccatcctggctcccagagttggggttgcctagtcccttgtcaccagcaaatatttatactgcaagattaatttgcggtgcagctttggaataagactgtgcttacccactttaccgacagtcgtcaaggtcgtttgtgggtcagtttaaagacctacacggttttgatgagtttggaagcctctgttaatatgcacacaccaagggcacggcctgccttgggcctcaaatcagccattccagagccagcggcctggcatccatgtgaacacacacggtatctgaccagaggagcccatgtgagccccggcagctgtggagtaccaggtcatttcagcttaccctagaaaccttggaacaataacacactgagaaataagacagccaactggagtcggaggtcttctggggtttccaaccaggagacgttttatatatgttcccttttttttttttttttttttctccatcacctgggacattggaagcaggaagccagcacagtgtctggccacaccctggccacagtgtcaccctggtcctgtaagcagctatagctatagtcgtgtatggcagctccttctgtgtgagcatgtgacacaaagcagatggggaagcatgaaggctgaaccacacttctcatggtgttctgtctaccactgtgagtgcacacatgcgagtctgaccctcaccaagtctataagtgcctggtatgagtcatgtgccacatatgctggccccaaagaacagctgctgaacgccaacaggagagccctccaacaagactgtctcattacccaccaagattttgacaagtgtgaatcctgagaagcagagataccccagccaggtgacccctgctgcagacttgtcctggttaccagcaccaagattttaaggatcgtgaatggcaagagagtagcttctcacgaggtgtaactcttccggaattgtttaaaaacacaggatgtcccagatcactttctgcggtgcttagttttcttgtggctcagactaaatacccagcccagggaacttaaggaggagaggggtttattctgggccacacttggaaggtacagtcatagtaagagaagctagctgtaagagcaagtctgctggtcataccacactcacagtcgggaagcagagagagagacagagagacagagaaagggagacagacagacggagacagagacacaaagagagggggaccctgcttggcttcctctctccagtgtatttattccaggcccctggctgatgaaaccttgccactcacatcccagggtgcatcttccctctgcagttaacctcatctagaaactacacacaggcccacaggcttatctcctggatgatactaacagtctcctaggtgatactaattgtctcctaggtgattctacttgtgcgcctagtcgtctcctaggtgattctagtcatctcctgggtgattctagttgtctcctaggtgattctagtcgtctcctaggtgattctagtcatctcctgggtgattctagtcgtctcctaggtgactgcaccttgataatgaacttcagccatcacatctcaacacaaacaaagaccctcacggggactgttcagagtgaaaccttattgatcttcccattagtatgtccatatgatccagcttacagaagttattcatcaaggctgtgggtccctcgccaggcccgaggccatctatctctggaagtcctgctggccagctgggccctgtgaggtgaatggagagacagctgacaggctcttgtgcacctccttgagaggtagtcagtgcacacacagggtgcctgggatgaacaccttctttgggggcatctggaatctctaccctcaccaggcagaaagtctgagggacagcccctctccctgatactccaaggacaaaacaccaagttgtgacttagcaaatggcattggacatatgtggctgcgggtttgctattggatgggatatagccccccacacacacacaaccgtggtcacatctgcttcttgatgggttgggctccatccttatggtgatgtgccagggctgccagtggagttttccaggtcctgtgggcagttctgataagccatggaaacaggggtgctcacgatgctctgacagttatcagaaaacatcttaaagggaagtgtctgccacagccaccttggtttcacctcttccttctctcagcctccccagagtataaacctggacagtccgtgggactgcctgtcccctcatcctgacccaggcaccatgtcctgtgaggagggtctctagggactgaaatcttgagctacccaaatctcttcgctcatccactcttaggatcttccctggaccagccctcttgcaacttgggccgacctctgccctttccaaaaccaacagacaatgacccccattctgccttccatccctctgcctgctggattccatgtcccaggacagtgcggctcaggacctggagctccttcctgcttaagccgtgtctgctctgtcagtctttcctctggctctagtctgtccatctgcagggataacctcccaagggccctcttgttggctgttcaccttccgtctgtcttcatagcctcctgatgagagagcgcgcacacacaggctacctgactgatgtgttgctgcactgtggggtccagtgacacagctgtggaggtcaggaacccagaattaagctgtctgggagccacaagtttcaagagtccatgctatggctcctacatgcaggtggtgccagcagcattccttggtgtcctgtggctgtggttgcatctctgactctcctccacctatcacattccttctccagtaccaggcctctgtgtctcagttttcctctctcacaagatccctagcttcaggattgcacccacctccactagccatgagcccgtcctcactggatcacgtctgcaaagactctatttccagttaaagtcacagacacgggcatagagagggggataggatatgaaaatatcagttgggggaggggcattcaattcttagctcacattttcttcatccaatttcccccactagaatgtaagctttgagagaaaagggaccagatcttattcctcaccgtggctttaacacttagagaaaatgcatcccctctaatcaataagtcatcgacagtgggtagatggaggaacggcagtgcgtagtaggatgcgtgcaagcatagtctcgtgcatgggtgcatagatcgctgggcaggtggacaaggtgggggtggataaagaagtgggtagatgattgatgttaggtaaatatcactgggtggacagatgggtggtaggtggatggatggttagaatagtcagaagagggatggattgataaggtgaacagatgataaatgggtgatagactggaagggttgtcaaaagaggataagggaagtgtgagctagccgtatttctaaggtcagtaatagagttgggagaagaggttaagttacatccatttaaacctcacacgaagctgagagggaatggacttgctgccgttggtgaggaaagcgttgcatttcccgtgtgcttggttgtgaagtgctcaggtcccacatgaagcagtcaggttactgcggcttacagaggagccagatccaaatgccccgagtaagcacgtccccgagccagaggcctccagcggaatccgggagagggattgctcagtgccctgcttccctggactgtaagctgcagaaagatgtgggaagtcctgttctccactgagaacactaaaagcaccttttgtcaaacgaccgcttcacatctggggcttgtgcactggtggccttttaaaccagagacaacccacaagatacctaacctgcggggctctctggtacagtgagcaactcaggaaatgctttggcttgattgctgtgggctctcaggccatcgccctctggagtggttcttttaatgagaacctgaagattggcccctgagccatgtataccaagcaagctcaatccaggttagctccctctggttggggcaagctaacgtgctccttgggccccgcgcgtaactgtgcgttttataggagacagctagttcaagaccccaggaagaaagcggctttgtccccctctaggcctcgtacaggcccacattcatatctcattgttgttgcaggggaggcagatgcgatccagaacaatgggacctcggctgaggacacggcggtgacagactccaagcacacagcagacccaaagaataactggcaaggcgcccacccagctgacccagggaaccgcccccacttgatccgcctcttttcccgagatgccccgggaagggaggacaacaccttcaaagacaggccctcagagtccgacgagcttcagaccatccaagaagaccccacagcagcttccggaggcctggatgtgatggcatcacagaagagaccctcacagcgatccaagtacctggccacagcaagtaccatggaccatgccaggcatggcttcctcccaaggcacagagacacgggcatccttgactccatcgggcgcttctttagcggtgacaggggtgcgcccaagcggggctctggcaaggtgagctccgagccgtagagaagctgtgggtttaaatgcggaaaggaaggagaggtgggcaggtggaactgggccagtcaccatcgcagagcaaccgtgtccctgtgtctgagatactagccctgatcggacagtgctgatggcctgggggattgggcgtggagtgggcgtggtcgccacttagccaatttctacttgttttgctccctttgtccttctcacacgggactgcgattgggtgtcactcaggaatgcaatgccttctgcatcctaacttgaggcacccaggatgtagcattgagcctatgggttcttaggtatacatgccctatgcctggggcttcagcagatcctgcctctgcgcagtgcttccgggtttcgaacctcagctgtgctcattctctgctgggtacaggctgctaattgcttgccgctgtgaaacaatggtccaattgaggcgaggaggtctgccgactgacctctgcacctccagcaaactttcctctttgtcctatgtagtttggtgggggtgaatgaatgaatggtgttcatgacaaaaaaaaaatgtgtgattccgttaatttaaatataacttgtgtttcatgatgtttcaaaagcaaatgccctgtgttaaaatgtatcagaagataaaattgtgcagatggtctagtttccaagggcaacatctggggtgggttactcatgagcccgtggttcagggtttgtctgtcaggtggctgccaccttgtaagtgtatggcatttttccatctctctgttggatagctgagcaactcttgggagagatatggatgggccattaaaacaagcccaggtctttgagtaccctctcagcctgggcaacttttctgcctgtaagttgtgtctgttgtcaaaactctggcgaacgcaagaggcttttgactgagatgtagggcagaggcccctccacggctctagggccattggcagtgcagttttgaaaatgctgtagtctccagccacacctttgagcgtggggatggttgtgaaatgctgtacctaatgacggctctcctgccccgtggccaccagagccccttggtgtctcagcagcagtctggccctcgccttggatgtcagcgctacttgtcattaacactggatatgtctcacttgctaacagaattcaagctgccccagattcctgcagtctgtacttagcggtatcgccttcagcctgatccatcaatcttgtttccagggccgatttacattgtagtggcttccaagcactcatctcgagggaggcgcttgagatctggaggatcctgactgccccctgaggtccatctgtgtagccaagcccacacatgcacacagccgcacccagtccaggcagccgaaggaacaggacctaaactgggcaggaaagatgaagtagccagaaggcacagggtctagaaccagttttgtggccatggttcaagttgaaaaaccatagcgtgttcatgtgttgttccatggctctcccagagtggacagatgtgcctttccctccatcgactgccttcaaatcacattcttttccaattcttaaaagaagaaattcaaaactcaaaagcagtccaaatattatatatatgcatgtgtatatatatatatatatatgcatgtgtatatatatatgaaattttttaaataattgggattttttgaaacttaatgtgttgatttttttacaccattgctgtgctttttgaatatgaaggattatttaaatgaacaaccttcgtaccaaaaaagtcccttggcatttgcacgtgtggtccttatggtctcgttgtttattagttttttaaattagcatgcagaatagagttatggcatttccatacagagtttttgttgctgttcccctctgccctcctgaagcttattccaagcataggcaaaggtaccttccgctgctggaagctccctgccccggcacacagcaggggtcaggtcatggtgttcaagcctctttgattgaaggtccttggttgtttaacactggccggtggaggcttaactcactctacacccagctataaatcagtcatcatagaagcagttaggggcagttactgctatgagctgtcaggagtatttgtttctgtttgtattttaatgtttatagatggggaggagcagggcttgttttcctatactgcaaaggtccttaagaaagtcccaaaggctggagagatggctcagtggttaagagcactgactgctcttccagaggtcctgagttcaattcccagcaaccacaaccatctctgaagaaagttgcaaagaatagagtccaaaggctagctagcatcacttgtggcaaaagccagcacccttgatgtcattctaagatgtgcatctaacacacctgcagggtgccacctggagatgcagctatgtgacccacccgtgtggaaaaggatccccaaatagaacctgggagactctgagccccctccctcaccctgcagtgggacttctggtcatgttgtctcctgcatcctccctccccgggcacgtggtgcctccgtgccatgcagagccaccacccccagctcccagaatgtggggacaacacccagcctttgtgcgttttctgggctggcattcaaaggcagcccatgaagaatgctctgagaaggcatattcttccaaggtctttttgctgtgcgcatgctccttgggaagttcatttactgtgcacatgttccttgggaagaaagggaggctgtgctgtggcctctaaggaacgggtttcccagcctgtagaatgcccaggccttatgaggctgtgaggttatggctttggggtaaagaataaagacacctgctccgagcccattaactctcgcccagtcccaggacagtccccaggccaccagccagcgtctcagaacacaaatcataggaaggttcctcttcctacccagagcaagtagcatccgacggaggacctaagctgatcatgtagtgtcacatccagacaacacaggtgccacaagaaaacatcttccagtctcccaggagggggaggggcacgctcttcacccgtatctgtttgcctctatttattttacctgagatctcggtttctaacccgttagagccagcatttcagtcagtcttcagatggccgctccgcctctaattttgacaggatgggtttaagatgcttccggccactaagtcctgggtgatcttgtaaattagctagaacatcttttttcctgatactgtcccatggcatcctaagttgtgttagatgcatctccgttctgcagttagttttgtcttcactgttaccgtggcaacggaaggctccagataaacttgccatccatcctgtgaaaggtgacattaaaggtcacatgaaggacacagtggaagtgcccaagaagtactcccagggttccagtctagtgccaccgtcattgtcattgccttcagataagagagaactcagggatccgggcagaagcaaagagaactagggacccacacaccactccctgcctccagtccacttgccaagagtttcccagagactctctggagagagtcagcccgggatggacacactaacatctgtgtccaagttcacacttttgagatttctcgtgtgaatcagagtagcctcacttggtcagttctgggtccctggtctctgactctgcctttctgctgcctcggccggtcggcacagccatccactgacactggaataggaatgtgatgggcgtcgcaccctctgtaaatgtgggaatgtttgtaacttgtgtttgtatctaatgtcgatccccttaggtggttgtactataattcatttttgttgtaaacttcagcctaagataaatgtacatctgcttttgtatgcactcattaaacattgtaacagaccaaagatggtgtactaattgcacatggactttttaagttgtatttttattttcctaatggcaccgtgtgactggcgtttccgtggctttgagaaacacctacaggtaagtctggcactcaagttcttgccacttctgaaatggcacagtcctgagtcctctgtctctaccacagactcaaggtggtctctcatcacggcagtgtagcatctaacttttccccttcccataggcatggtccttgtgtgtgcttaagtatccagtggatgctaagggatgtgtgagccggcacaaaggaaccgacccagggctcccagcaaatagttactgagtatctcgctcgtctgttgctgtgataaaaatcctgagtaaagcagcttgctgaaggaagagatgtttcaactagcacttcccccagacaacacatctcagcctcccgcgggagccggaggcagctggtgacactgcagtccagacagaatcagggacttctcttttgtattcagaacagaaccccagcccagcgaacctcaatagggtggatcttatcacctcaatcttatcaagaaaaccccttataaacccagaggcgtgtctctttggtgattctagattgtatcaggtcagcaagctgtattagccatcacaagcaccagggccacccacgctgggctccccagggagggtgtgttcaaagggcgacaagtctcctcccgctgagctgagaggcaggcagactcctcttcagggtgaccgctggaggaagctagaaggcctagaaggaagacaagtgagagataaaactaaaactgagtgaattcgaatgtggttgtgtagcatctccgccttttaaacccactcctctttaaggggtttatttcctgatcattggcgctcctttccagggaggtggggtggcgaaggttagccagctggtgacaagcagttctgactggttgacggaaagtacagcttgacctctaaagaacagatcagcgaggggaaacagtccctttttgagctcatggtgaaagtcactgaggtgccaagatattagcttagtacttaagaatgactggacattcccatcgaaccatggcttaatgttttatcttaagattgttttttgttgtttctctgttgtgtcttttgccacagtctctattttgtttatttgtttacaaatagaaaaagcagagagcagcagctcagatagccggaagtgtcccaagggaacccctaaaggtggctcagcgcctgtgtatctccctaaggggtgttcttgccccgcccctgtcaccccttccaacctgcaggtcggcctcaggctggggcacccgcttttcagttagtgagtgggaaccattgtacttctgtcaccttagacccttgtgaacctgcacagccatgagaacgcttgcaattctttatctaaccctgtgtgggagtggtgacatcagggtacagatcacacttctgtaagtgtcactaggtcatactttcttagaaccatgattttgctccaccctgtatgtagatgtcaggcctggcagggctgtggaggagctcacagggaccagcgttcatggagaaagtcgtccccgtgggtcacaaaggtgactgaagttgcacctttatcttttgcataaatgtgtagcctgggcttgctcaggcaccctcactggctcagttgctccttcatcttctgtgtagcccaggcttgcccagtcaccctccctggctcagttgagggatctctcttcacggggacagccacgtctgcctgaggaggtttgctctaacaggaatactcagttgctccctctctcagctcccggtacaggagacttaagccaccaggatttcttgctagtatagaagatgcctctcttacatgggtgaggactcttggctatgagacagactgctgagcacgggtcacctctgactttccactctcacccctgcggtgttgactttcagtggtacttctagaggaactagtgagccacgccatagtcaccttgcagaacactctgcccacggttaagaaggccattcatcggtaacaaaacaagagtctggaacatcctggagggatggactctcttggctgaccactataagctacctgttctctctccctcaccccaccccgttcttccctcgcccctccctgttcttctcttgccacacccctgttctctcaccgctcctccctctttcttctcttgcccatccctgttcttcattcgctcctccccatatctatcatctatcatatcttcctatctatcaatcatctatctatctatctatctatctatctatctatctatctatctatctatctatcacctctctacctctctaactctgtatctatctatctctatcgatcacctatctgtgtatctatccctatctccccctcctcctatctctgcctcatggttgtgtctgaagatgggatttctcagcgactgccccagcaccatgctccccaccatgatggccactgattcaccctttgagctatgagccccaaataacctctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctcccaatactctgtagaagccttgagaaggtgagcgtgtgccacccactgctgattcctacttggaaatccagcacaaaagccaccacatttgccagtaaggaaaaggcctgcaaataaaagccagagtaaatcgaaattattccattgcagttccatagtaggtctccaaatgcctccacagcaccagacaagaaagcatttctttgcctgctgggggtcggctacactgatcctagagatgtgcggaggactgtggggctggctctgcaggcagtgcccacacgggactcacccggcccactctgtcctcctcggcaggtaccctggctaaagcagagccggagccctctgccctctcatgcccgcagccgtcctgggctgtgccacatgtacaaggtaagtggcggctgctggcccaccagcctagggttacctggtgtgagatgttctcagcactgtgggcctttgagagggtcattaggacaggcaactctttcaggggctcactgtgtcttgggggttcaacatgtctgtagggtatctgtgagtccaaaccaagataggaaagaaagccccgaatcaagacaacaaagaagaaatttctaaacaaaacccacataggaggtagggagcctgtctgcggtgtgaaagtttcgaaggacaggacagagctgtcaggtcaccataacgggaacaagctgtaggcttgcgatgtggccttctgtgataccatgcatgtggaaaagccaccaagtggataggccaggaaggaccaggctcgccagggcattgcctgcccaggttccctgcctgctttgacagcaagctcctacagatgtcaagcactccagctgtcagcttgatttaactcaaatagcaagtgtccttaagtccagtccacagacatctgtccctctgagtgtgtcatagataacatggttgggatctgcccccacttctcaggatggaaaccaccacattaactgactgtggatgaagctggggagggcagagacgaggggacccttcagtcaagcacagttgggactgctcctaatacaagatgaatgtcaccacacagatcctgtctctcagtgactgtgtcacacagaggcacaacccgaggtgaaaggttaaaaaactaagacgtagaaccattctccgtgctccacggagcacctaacaggaagaaggatgctgagggatcaggggaccacacaaatcttctgcaaggtattaaaagggagtcacagcaatcaaggcgggcagcaggaagggtgcccataaccataggctttggaattcctgggtcagacacttgcacgggaactcagcttgaggtaggtgacctggggggggcaagcagcgggtgcttgaggaggttatggtcccatgccttgccatagcgtcgtgaagaatggggagcattctcactggcttctaagatggccagcctggggccagggctgagaaggcaacagaggaaagcaaggttagtctagcctggggccgtggcagatgtgtgactgcagacatgggcagtactgggagccctggggggcattgcgatgtctcttaagtgactgactggaagccccatgcagggtgtgtgttatggcagaccactgctcagttttctctgtgtacttccccggagtagtttctgaggatgccctgtgcctccagcattcatctttcctgggacctgctgggacctgctgggacctgctgggacctgctgggtcctgctgggtcctgcatccacttggctttcctgaaccgggaaacatcttgggcaacagcaccggcccagcaagcacctggccccaggccccactgctccaagacttagcatgctgctagtgcaacccgtgtgagtcctataacaatggcaggtgcttcacctaaggggaataaggggcttgtggtacacagggctagatgactgaaccaaaccggagagcactggctcatcttgaatgacgctgacaccgcctaccctaccccctgctccagacctgagaccctctgctacagaaggtagaccctgtgcatagagaatggagattctgactggaacccagggggttcccacagcaaggaactatcaacagaatatttgctttttctcctttaaaatttacttagcagaaagaagccagcccctcctattctctacatcttcatcccaaatgcatatgttttaaattttctgcgcatgtattctaatggcttgagatgaatggtcttctcaaggagataaagccattgggtggaggccacagcctggatagcaatttaacattagaacatcctaaactttaggttgtttctcaaccagtgggttccaacccctttgggagggtcaagtgaccctttcatatatcaaatgtccggcatatcagatatttacattatgattcataccagtagcaaaattacagttatgaagtaacaaggaaattatggctggggatcagtacaacatgaggaacggtgttaaaaggtcgcagcgttaggagggttcagaactgctgcatcaggagggggaaactctcccaggatgctagaacatgcttcgggttcccagcgtgacattcttggcatctattacttgtgaattccattttaattcaaacagggtttgaactaactggcttgaacatacattaggaccaaaggaaaatagacagcagttattaggtgtcgcgagtaatgcttgcttgtctactgtgagggaaaacagaattataagacacttgtcttttgtctctgagtcactcagatactgtgaccactgctaagctggccgtcctggctctgagtggcccagcgtgctgcttcctctctctttagcagtggaacacactacttattatgctcttttaaaaggcacctctctgtctgtgtctgtagagaggcaggtatacatactatattatactatattatgtgttcccgttcccctccccctccccctcctcctccctgtttgctaaaacacccgcaggttctgtaacaaagtaacaaagacccggccttcagtgaaagagctcacacagaaggagctgaccctagcactgctaacggccccctcaagcacaggccccccactaagcattcatctgttctaagagacccaatcatttttctcagggcagtcaagctctttagagcctgaggggcaaaagggaaggagcaggagacaaagagaagagcctttgaaacaaagcgcaaaagttcccgagtgggaacaggtgccaagctcaggatgagaagcaagaaatgcagagacaggtctcgtgtatcccacgtgggcagccctcctcccccttcctgcatcgtggcttgctaggctcgagcctaccatggactggcaccaggcaggcagcatgctctgctgaagggaacatgatgaacaaagctaggaggtaaggagaccctacccacaaggacagcctcctgattcctctgtgtgcggcttggcaggaaccccgagggagcggtggacaggaatagccacctccactgtccacaccaccaggtcctttgtctctgttttctttggagtcttctcagctccttgccaccctggcaggatatcccatcaccactgtaaataaccccagaggttttccaaaaggcccacagtacatcacacccatcagctctggggttctggaatcttctgtcacaaagtgagaggcaaaggcctgagggttaggtctcatcctaccagtctgccatggaatgttccagggctatggccttctctgaatcagactgttcacttgtgaagctgttgcgaccagagagagaggcctgttaggtatccagagagagctttgtgctaatcaagcaaggaaggggtgtatgctcggaccaggcatggtgcgacatgggcagtctcatctctgtgtagttcatttccaacctgctctagaaacacccaagcagccccagagtgcagtgcttgacctgaaggcccagagtcttgagccacctaccctgtgctgctacagcgctgggcagtttcctttctgttctggagtttgtttcctccattgttaaatgagaggcttcgttaagcaaaagatacaacaaacattgcccactggtctcctgtcttcaggagaggatcctaagatctctgggtccttccctctaaaaggcagagcctcagcgggtgctaggcttcctagatcttccacccacaggaagtgtagcttgcagagcctggtccctgtccacacagaggggctacccacacacaagtagcgctaggagctgcctggctgtttgaggaatccagtttcctcctggttgctccacacatgactctgggtaagatttgggtggggtttgtagctgctcatggtgtctctctctggggcaagcactgaccagggcaggaggccacctgcctgcctgagtgcccagcttatggtgcggtatgcaccccatcctgccgccgagcccaaggcctttgcttcctggaaagcctgccattgcctcactgttccttgcaatgaaaccttcccagaccccaccctgcactctgcctacacacaaagatccaaagccacaaaaccaggtgcttcttgccatccagctctaggtaagtgaaggggaatcacaggttcaagactagcaggggccatataacatgaccctatccccaaaggtaaatgccacatagcatcagtgtttgctctgtgctttttctgtgacctctgtttgctctttacatgaactgttacacggtggacatactgaaagcgatgggtacttagaaacagtaaagaaagggagtattaagaccaatatcacctcccaccatgtttacaaggaaccaggaactgcaggatgctggggtgaggtgccacctagctgctggcctactcaaagctgagaggcagcacggccaggtctgtgacttcctgcatatgccacagggccactgcacttctggggacccactgtccaggaaagatctggaagctggcatcagcgtagaccctctgaagccaggcctggagagcatccggttaagacggggagtgctttgttggcattgcgctctctctctctctctctctctcatcatcatcatcatcatcatcaaagctatttcaagtgcacatccaaggatggagaaatccagaggattctgaagttaactgttacactgccaaagaagagggcacaaagttgccagaggcagccaagggatctttgtccttcaggccctggaacaacatgaaggagctggtacccccaacattgcagcagtgtcatggtaactttcccttcacacgtggctgcaggtcaaacgctaaggaacccaacactgaaatgtgtgtggcaacgcatcccccttccaccagggacacaaagatggatgccggtggtcccaggctatctccagagcagataccatccctgccttgccatgtctgagggcaaatacaacacagtgaagttagggggcagcctgaagtctccatctattcatacctgtccagaaagtgaaaaaagccacaagtatgctgcccggcttgccatgaagaaagggggtctctcttaccagtcatcggcatcagtgactgtgatgcctacatgttctgtcccaccgatgcccggcaaagaactaaaacaggagggaggccgcacatcagccctgattttgctaagggaaaaaaaaagagcgataacaccttcccctgagattatcccaagcagcttgaccacaaatgacatcagagcctcttctgtggacgtacaccagaccagaactggggcagccagtgctgagagagatgtgtgctgacaggtcctgaagcagccacaacatctgggcggccaggggatggggagtcagaagtgaggaaagatggcctccactgtggacatgctccctcaccgtcctgagaccattgtcaagcgtgtcggcactcatttcagccatgacctctccctgaagtggttcacagatagattggctgttgaccttgccactggctcccaagtggggaaacagatgtgacaatcagaccatgaaagaagggagctatccgtggccttcttcccctggagacagtgttaatgaggagagctgttcacaagatttccaaggcacagagagtgtgaacaaacacaaaagaagcagcagaggccagtcctatcagagagaggctctgtgggtgtcagactcggggagtgcagatgagaggagacgtcacctgcgcataggagaaaacatagtatcaaatctgaactcactctgtgggctgttctgaaaaagtgtatctcaaggtgggagctgccacctgcacatacagagcagcccctgagttcaattaagacagttaagtactcactccagtttgcgctagtaagaatgctggctgtagtgtcctgacgccaccgtgtggctgagatgtgtgcaacagtctgtgatgccaggttgtactgtgaaggaacagagggtaaccaccatttgcccagcgaatgtaggaaccagggctcaaaattaaatctaaaagaaagaaaggcacgcgcatcaaaagataacttggtttgatttttgcctcccagaagcagagcaaagtgttcctacctgctggtgttgaggcctggtgttttcttccatggaaattggcagcgtcctacattttaattgcatggaaatgaaacgttttcagtgatgatggcatgatgggaaatcccgtctttaaccttacctgtgactgcattttcaaatcctacttaattaggatttcccgagccgggtgggctccatctatctgctcagttctttccctcagatataaacaatttctttctggcccacagcttcagaacctaacatctgcaaaccttgaaatgaatgggtgaaacccatgattttaaactcgattcttcccccacatcttacggcctgccgtataacagaccagcagcctcctgtggctgtcactaatcacgtgatcctcccacgctctccacacccagtctacctggttcgcgctgccttatctccagcactgggcctggcctcctcggggcctcagcgggaaggctttagcctctcagtttcgccctacaaatgaagccgaggagggcagtagagctgggtgaagggtttggcgtcagtgagggggacatagcacctcctgcttaaacgtgagtcagcagttgtttttcattgtttacacaaatctgcttggagacaggagaaagaagaaagtataactctaaaaacctgggtaaagctggtctggatcccaggcaaagggaacccttctcgggccagaaataaagaagtagaatctattttgcttaaccatgaaacaccaggccccacttccttgtgaaacggctattgttaaagctcatgatgtgtcccaggccgctcttaggaagcagcttgtcttccgcagaacaagcagacgcccagtctgatgaccactggcctctgatagaacttccaagcttagccatccccaaccttccaccctacaagaggttggaaaacatatgaaaatccctttccgggcctctgcagagagcatgtttgagcgccccctgctggtgaggttggaaaaatccctttccgggcctctgcagagagcatctgagcgcctcctgctggtggtgggcactgtttcccatgaaggaaactggaatttttcaaaaatagtgcaaacaggctaatggagaaagaatgggtcttagaaatcgatgatgtggttggccagggttgccttccatagttatagaatgattcatcataattttactttatgtcgccgcaaaatttgccatctttgcttattaatacaaagctgtattgacacaaaatgaggttcctgacataacactaggaaaagagaaaaaatagacaaagagaaggctgtgtagtaggagctcctttaaagccctttgcagcctgtcatgtatgaaacaccgtcctgtaagtatacaccattttcaaaacaattgaactttttatttctgaaaacatgattatatttgcagaccatcacttgcaccaaatgttcggctctaaacacaaccatggggttcactggccaggccttggcatcaggtgggccagatggcaagaccaccagcccactcagattccaggagtcattggcaggccagcaaccacggccttggctctgtggcccttcttgctggtggagaactgatgtggttacaatggctgttagtaatctacaagagcgatggtctactgtagataagctcagcatagacagactgcgctcttgagggacagcactaaaacccccgctgtgggctctttgcttaaccaagagcacagcaaggttttatctgccagagaatacatacctgcatataactgataaaaagctacaagatgaaagcccttccttccaaagttaccagctcacaagactgtaggcaaccttgcccatcaccagtgtcctctggtagacactcagaaaatctggaatatccatgcctacacggaatgtggagtaagccattgtaactaactgagcaaaagtgacctataggaaaagttcctgggtggaagcaaggctcgggctgccttcccacaaaggttctggtggggaaattcacaaaacagtgtaatgattccaatgactgcatgctgtgcagtcataacccatgtcaaatgggcttgctttgtttcataaactaattataacaaagtagactcgctctgtttcgagttctatatgtattgaccaatttataaacttgtataactactaccacaaatatatatcaacctaagaccaccccttctttgtgtacacaattccccctttctttcgtctcctcactacagccaccgctgctctagtctcccttcccataggataggcctttcaagaatacacataaaaaatagtatatatgaaatctttttgaatggcttcttccatgcagcatgacgtagaggtgtcttattacatttcaaagagttaatcttattgctaagaaggactccattgagtgagcactgtcagactatgttgattctcttgatgaagaacatctgagtttcttgtagtttgcagagattaaaaagttctacaaaccttcaagtgcaggcttcgagtgaatgtaagtttttcatctaagatttaaattgttttccttcaaaaagatatatattcacccaatatattcatgcaaaaattattttcaaagatatagcatttctctttcattcttcaaagcatgaaacgggactggagggccataccataaacacataatcggtgctgtaggaaactgccaggttgtttttcctggtgactgcatgattttgtactcccattgcagtgcatgggggagttctggttgctccctgtactagccaacacttgttattattgtatttttcttagctatctgaataggtggtaatagcatcatctcatggagcctgtttgcaggatcttcatggctgttgctatcgagcagctgtcacgctgattttttccccgtgtctctttcttacttctgagctttgacgatttagctgttcttttaaaacatattttatgtttgagtctttctttttcatatgtgatttgcaatattttctcccagtccaaaacttgtcagaccatgcataacagtgtcccgtgcagtgtcaagctttagcggggtcagagttactgttgcggggctgacgggatgtgcctaggatagtcagtctcctggtacccacattagccagagggttctccaagctgatgctccacagctattggcattgccaagaggcagctgacaaggagaccacagagcattcgtatggcagtctgggaaggtctggctcctcacagcagccaaggcagagcaaatgccattctgtaaccacagcaggccgctgggcatgtgggaagtgaagaggcgccgcccttgagagtttttcaaggtgtgagctcactgtcggaggagagagaatgggaaaggagaggaaggaaaggaagccatttacaaagtcccggctggcccgctggagtgggtcaggggaggcggagtttggcctggaagagtgagtagatttagaatgtggttcctgggaaacagtgagctttggtccctgaggagggcaagaactatgtcaaaggtttgtgatgtaggaagtgggtgaacagcgtcgaggtgatggggagagatcaaacgcacagctaggatcacttcctacatggagtagacatttgtccacagcctcaggacatacaacgcagattgtaaagctatgttagctgcttagttcatcacgaggatcatgatatagccgacccggaagaaagccaagtgctaggcaaacggcaccggtgcagctccagttttcaccacagagccacgcccattacgtacagcctctcgagctcgagaagcagctcttcttgcctttctaggtggcaaactccccagcgggttctcccaacccgagcccagggagacaggatgcttcaagtgactggattgccatcccagacacatggctgtgacccctgcagacaggctgtgtatatcactcctgttgtccttgaggctgtttggctgaggttgctcagaatcagcacaaggttgactctgagtgctgggagcaaaagagggagaaacgacgaaacccgtgtgatctcttccagaactccctgtctgttcctctctgaggacggtgacgttgtgaaatccccttgcaggatctttccaaggattcccggttagatgcaaacagtttctgtagctctgtgcacgtcccctgtgtcgagcagaggtagagagtgacagccaggaggacagcatcaggagaaagcagagctacttcagtctcccctccaagcttgctctcacttggggtaaatcactggccatatgcttgctagagcatcttattgactatattcactggcctaggtccctctggttctgtgggttatgaatcctcggcccagatggacgctcagagcaggtgttacttccatctgactcaagatgggaacgtgatagtcctctgtcgacagactcagaaccctggtgacacgaggtgacgaggctagctcataatgcacaaccccaaagtgaatgaacagactccctctgccagtgatggcttcagaaataagagagtagccacctggcaaactggtggttatgcaccacgcatgctccgctaagccccgccccggactcagttgtttggtggcacaccagcagcttcccaatctccaggaggcgtggagtagagactcaccttcctcagaagggcagacgtggcccacctacgccctctccatcctcagctgctcgcttctctctttcaggactcacacacgagaactacccattatggctccctgccccagaagtcgcagcacggccggacccaagatgaaaacccagtagtccatttcttcaagaacattgtaagtgactgtgcacaggggaaccaagaaatcatcaagggaaaggttgtggatccaaaagaggtcttagctcacacctaacctccatggatccttctcagggtgccgctggcctgagagacaccaacctcaggaggacctgggtcatcccaggtcctaaaggacacgcgtgggtgcatctgccatgcttttaaaaacctgtatattgtaataagaatttagtattcctgaaatcaggcagctagtaggtgcttaattaaaaatatagactttatgaccttgagaaatgaaaatggtgggagtcagcgttgcccaggagggctggggaataaacagagaaatgtagggtgctttaggccaacagaactgctctgcgtggcattgtaacataagacatgtgatatttgttaatacacataggatgcatgccacatagagtgaaccttgatgtatccagatgatgatggtgatggtgatgatgatggtgatgatggtgattatggttatgatggtggtgctgatgatggtgatgatgatgatggtgtgatgatgatgatgatgatggacaatgatgataataccccaatgtttgtttatcacttagtacaagcaaatcatgttaatgctggtgctgaacagcagaagctgagcagatgtgtgggactgccctatgggtacaggggaaatgtgtgacttcgtgacaatttctgtgtacatctaaactcttccacaaaataaatgacttagttacttctctattgtggtggcaagataccatgaccaaggcaacgaatggaagaaagaggttatttggggctcatagctcaaagggtgaatcagtggccatcatggtggggagcatggtgctggggcagtcactgagaaatcccatcttcagacacaaccatgaggcagagataggaggagggggagatagggatagatacacagataggtgatcgatagagatagatagatacagagttagagaggtagagaggtgatagatagatgatagatagatagatagatagatagatagatagatgatagatgattgatagataggaagatatgatagatgatagatatgatagatagatgataaataggaagatatgatagatgatagataaatagatataataggtaggtaggtagatagatagatagatagatagatagatagatagatagagatagatagataggaagatatgatagatgatagataaatagatataataggtaggtaaatagatagatgatagatagatagatagatagatagatgattgatagatgatatgatatgatagatgatagatatgatagatatgatagatagatgatagataggaagatatgatagatagatgatagatagatataataggtagatagatagatagatagatagatagatagatagatagatagatgatagattgataggaagatatgatagatagatgatagataaatagatataatagatagattgattgattgatagattgatagatgtgatagatgatagattgatagatatgatagatagatgatagatggataaatggatggatagatagatgcaagatagatagatagatggatagatagagatatgatagatgatagatggaatggatagagcaatgagtgggaatggcccacccaagtgacacacctcttccaacaaggccacacctcctaatggttccaccaagtaggcactaaacattcacatatacgagcctgtgggggccactctcattcaaacaaacataatggcctgggctctctcacaccaatcaataattaagaaaatacactataaatgattctgtcttgtgtcaggttgacataaaactagccagcacaccactcttgcaaaggaccagggttccattcccaccagtcatgctggtggctcaactgcctacagctccagccccactgcggctgctggcctccatggatgtctgtgcactcatgcccacacacagacacgagatttttttttttaaatggggcatcatattgaaactgagcatcagtagatgtgccatttccagccccaggaagggcatgatatagacgcatgtgctagcttctgatgcctggtagattggaaccatgtctgtggacatgaactatgtccaatgtcatgtgggaccctctgggaggacgtggggcttcctacaagaaagtgagtcactgcagcccacccctctctgtcttccaggtgacacctcgaacaccacctccatcccaagggaaggtaaggccttggatgttttggttcatcgagagttcattcatatgattatcctgaaatcccaaaatgtgttccaaatggaactgggctcaaggctccctgaatctgcccaagtcttgctcccagaggctcccactgggacagagatgcagcaggtccccagttctgcgtccacggccggtgcttccaggcagtgtccccctgagctgggattcacgtcctggccttgaagctttgagcaggcctagcaatccctgaatgtggtgcatttgagggagcctgtttctcttggggggaggaatgccacctggttgttcctgttggtttcaggactttgtcccgggcgatcaccacgtcaatgtttctgtcgtcactgtttctttctcttcctcacaggggagaggcctgtccctcagcagatttagctgggtaggtgatgactgcgtctcctctgcttcctcatcccctgcagcccgcgcagcccactgacttctaagttctttcagttgcttaacactcgctttttctgtcctgcccggcccagctcgcccaccatgcttggcaggctgttttctattccaggcagacaggaagcctttcagtgtgggttgctgccaggctgcatcccgggcactgcagagccctgtacctcctccccacaagtgttctgagctccttcccaagaaagggccatattacaaggctcagtagaccaaactacactgctgcccaccccttaagacagtactgctgatgcagaataatgatgctaaactcttgttccatttccaataacccttctacttgttaatccagaagatctggggttttgtttgtgtgttagtggcatctaacacagatccactaaacctccaagaaagattccgtaagggttttaggtttttagacacaagatcaaagttctgatgatggttttaactggtcggaacagcttggcttctaaatatttgcaagttttcatgtctacgccagcttaaaatgcttactgatttgtcctaatcaagtgtgttgatccctgatgctagcaaatactagatatggttctttctcttcattgttaaacagctgtaatttgcagagctacacagatgcacacaccagcctgttagccagaggtggggtggggtgagaggtcatcttatctatgggggcagtgtggtacagagcccatctgtgccaaccaaacaacgcacaagagaagaggtgaggggaagggaggagagagagagagagagagggagagagagagagagagaccaatataaacaaccataggtagaagatagggtcaaacatggggcacatatctataatgccagtattcagtaggcagaggcagggggattgctaaaagagcaaagtaactgtggggcaacagagttgccctgtctcagaaagtaaaaataagtcaaacagaggaaaaaatataaaaggaaggatagaggaaatttgcttgaaagatagaggaaatttgtggaactcctggaccattcccaaatgtcctcatactgagctatgaaccacttgatgtaaatgtacctatgtttttctcacacgtcaaatcttcggaactggtgacaagaagatgtctacccagcccccacacagcccccacccatggcctctttctgtctttaactttctgtgccaggagagataaggatgatgtgaagaacagcacctcattttatccaaaattcttattttagctactgctgtgtatgtcttaggcatgggttgtcagggcattgtggaaacactgtgagagagtaggaggaggagaagccctttgacccaccggcgaacaggcaaggtcttggtgtctctctctctctctctgcaatctctagtttgggtctcacagggcccccttgggtctctcttggtcccaagtcccttcgggttttcatcgcctcttttcaggatggccttcttgtctggacttccagaaactccttctcactctcgcaaaactctgttgtctgtgtcttgatattctctatgttttccaaggtgaaatcgactaggaaagtcccacagtgttgatctgaaagttgagctgttcaggtctcagaaattcttggtttggaaaaaaaaaagccatgttctgggggccagagatcatccaaagaagcctgtttctgccacttgtttcttccccaagtgccacaacccttctctgtggtatccgggagtctgtgcgtccaagaaacccccaggacacatgggtggctctgtctgccccaagcacacgttcagcttagaccttgtcccccctcgtgtccttgctcctaccctaacagaacacctaaaactgaaacagcctcctgacaaccagggacctctatctgcccgaacagagactaaagagagggaatgatgtcagtagctggaatcaggggagaatgttggctcatatggccagggtctaacttccatcttgctcgaggaggccaggtatgtggaagtgcctggaagtgtcttaatcctgccctcagtgcatcttagatggtaggtggctgggttgcttctcaacatccgtcttgcataatgcttgctgtgagtcagcacggaacattgagggtgttaggtgcagctcaggctggtggctggtcctgatgctggagctgttagtagtgacagctgttttcccatttccttgtcaaacaaagtcttgtgcctttcccttggggcggggccctgtgaggcagacagaggctttttggtcagcctgctgaacttcacactgaggcttgatgaagaccttacccagaatgccaatgtcatcgctcagggttactgagggcattccttgtagataagccagcactgggacccagagagtctcacatcccaggcctcactgtctattgcccaaggcaccagataagaacccatatctaggtcccaccatggccaccattgagaggctgccctggaccaaagactgggaaatctgtcttttactttaggaaaggtaaattttacagagtccacagtctcttccttttccttctcctcctcttcctcctcctcctcttcctcctcctcttcctcctcctcttcctcctcctcttcctccttgtcttctcccttctcttcctccttcccctcttccttttccttctcctcctcttcctccttgtcttctcccgtctcttcctccttcctctcttcctcttccttctccgcctcttccccctcttcttcctcctcctcttcctcttcctcctccttctcctccttctcttcctctggggcacacagcatggctaggcacaatctgagctgtgaaagaccagcagagaaaaacttaagggccaggcagagggtgacacttctggcccctgggctccagcacctttggtgtgcttcctctgctgatgagcgtggaggcccttggtgggaatttgagagatgattgcctttctctcacaaggatgccctggcatggagctctgcagctgtctgtaaagttgggcgcttgtgccctggaatattcagcaaccatggcccaggccctttgttctccagcaacacccatggataaacttggggactggcacttctacagcccctctccatcagagctccgtgctgctcttgctcccgaatgattcgccgatgccacctggtggctaatttcctcctggatagtccctggtggcagctatgagcagacactgagctctggtcttttcttgcagggggccgaggggcagaagccaggatttggctacggaggcagagcttccgactataaatcggctcacaagggattcaagggggcctacgacgcccagggcacgctttccaaaatctttaagctggtaatgtaatattcctaccacggggaaacacctgggcacctctgcgggaagtgggggcctggagccgtgctctctgttcactgtgccccactcctccaggcaaaaccgtgtccccaggggaatgccagggatcaggaagagtgttagcagaaagacgaattccagaatcccgagctgaacttacccaagggttcagtgaccatcttcacttacaacttaccttccctcctttgctcttagccaacatagttctgtcttccttctgggtatcttaggaacttaatgtgaagccaagagtcttttcaaacgatgctgtcatgctatgcacaggcattctctgggccttactataagcccatactgtgtctcttctctccctagagatataagtcaagggcctaggtgagaacgaatggcacctgtatgtggaaggagctgagggaaaccccctgaggggggcctcactaaaatcactcaaaagggacccagaaaaaaaccaggaagaggcctgcaattagctgcataggtgctagaatcatacagacccagtgacagatgtcagggtcatttttgttgttgttgttggccctgtggcctcagctcctaacctctctgagacgtggtttccttacccacggtgtaaggggatcatgtgcccacttacctcaggtctggtgagctggtggtggggcacacggcaggcatggaagtgactgcgactccagcacaagccaaacggcacctttatagagcagtgctggcctggtgtagaaaacctcacgatgtgtctctaaaaaggtcaaagtgatgactagagctcagagatgccctgtgttccctgcccagggaaccccaaagatgaggtctatctcggaggaacatgagtacccaggttaggttttgactctgaaccaagtcccagattttcccctaataaaagctccccttgggctggggcgatggctcagcggttaagagcaatcgctgctcttccagaggtcctgagttcaattcccagcaaccacatggtggctcacaaccatctgtaataagatatgatgccctcttctggtgtgtctgaagacagagacagtgtattcatatagatcaaagtccccctcccttggcaattctgcagcactccacatccccaatggccacagtgacctctgtcaggacatccaggatactctgggccagcgcttccttcctggcaggcaggaccaacaccccttgagactatggtgccaagctcagcatggagggaatggggtggttgtatctctaaggcagagatgtgacacttgctaagatagagaagaggggctagcatacacgtgtaggaacagcatgtgaaggaggcctcagagggttctaggagacagagaccagctgagtcgcccttgacatgctgggccaggaggagagagggacccaaccccccagaaacagagctctgactctgaccctgatcctggggacatgatggcagatgagacttgcagtcaggtgtcagggtgacagctgtctgactggcagagacagaaaagcagcaactgggttacagagtctctgggctagatgatacaaaagaaactctttttgtttataaagatccaggaatctagtcacatggctgattctccagttatgaatctatgtcacagaagcctctaggctggagagaggcagggtgaggctcatcagtgtcattcctggcagccattggaggtggcttccatgctaacttaaggctctgtggcatgtgtcatccttgagtccatggctcctgaccagcctggcactatctaagaagtccccttgcttcctagtatggcatccaaagctaccgttttttgctcactccgtctgagcgaggagacctgtgtctgggctctgacatcacagatagcaaactcacagtcagctattctctgctctctgcagccagcttcttttctgaggcaaagatgaacaacctggacgacagaggcttatgaaccagagcccccactgcaggcgtgaaccttaaggtgccacctacagtggcgccatccccccaccccccgcccagttcttgcttctttcttggatgaaagattactattcttgttggatggtatcaagcagaggtggctgatggttcaaggaacagtgtgagaatctatgcactgttgactcccatcttgtagcatccgcgccagctgcatcgttcccacagaccgaccttgggtggtgaatgggagacgccttgctggattcgtggtccacctctcatgtttggcacgcgaggggcctgcctatttggaaaaggggattctcatacttcagattctagtgcctttgtttctgataagaatgaggggacaagctctgtcctggagccgtttctcaggtcatggctgacactgggatgtgcagaggttcggatctgaggtatatgtttcccaagagaaccactgcatcaaggtttcgtggtttgtgactgcttgggtctgtaacacaggctcatcgagttaatccccctgggccttccattgcaggcatttactagtagtgtgtgcccgtggtcatcctacacagagagcaggcgacatgggcttctgcatcctacatgagcatccgcagagcccagacagggcagggcatatggatcgcgtggtgtcatgtgcagcgagaaccacacacctaagacagtcagggagaaagcctcacacccgggtatatgagcagaaagcaagcgagtgaccacctgctttctgtgtcaaggcaaagtataggcgctacccaaggtagatcaaagtaaaaaatgagttctaccctagatcttcatgttaacactcgttttggccaactgcctaggttctgaaggtggtaggagaggtcgtgggaaggcattttctccagtgacctctgaatgcagccaggggtcaccggtgctgaataacctcacggccatcctggtcttggattccctagacctttctgctccagatgctagcggttgcctcggcaaccacatccacctgggaagccccagtccatcccctctgcttaacttcacccttggctcagaaacctcaggcacatggcgtgtggcagaatcaacctggtgtgtgaggcttggattgctcagtgtctccttccacccaggagacagggccctgctctgagggaatatgtattgaccctgggtagtgcctaaaggatgctcaggagataggacagtccccacagctccacttaggtgcatatgtaacttgtgtgctggcctcaggagtgtgtgagactcacatttctgaaataggctcaacaccttccctggtcttctttctgtaaacagttttgtaaattgctttaaatttctatgtagatcaaggaagctttgatgatttccagtgtgtgtggctatataattaagttgtgttacctaggtagctcatgtgggctgacaggctgcgtgaccaggtgggaagagctcaaagggctccctggctcttaacaccactctacccaaaccgcttcctgcttgtctgctttttttgtttgttttgctttgttttttgtttgtttgtttttgtttttaagctcttagcagccggctctgagggaagggctctgattcgctagttcagtgtggcagttagcacctgggctggggagaatcagtggctctctgtgtctttgggacccacatcttatttctaggtggataaaaggagcctttgcctcttgtagtgtccccatgaggttgtagggtctcatggggacaaaggtatccagcagagagtgctcgcttcacatcgcaggtacacgtttaaatcaacctgttcctggtgagcgcaggtttaccagttatggggcctaacgcccaccaaagacagagcaagtggcacgagagacaaaaggcatgaaagaaaatggaagcagtggtgggtgcccaccttgctggctctagcccttgcttccctctgctggccgaccttgggaagatgactcaacttctctgatctttgattatcatataaaataagcctgtactcaaggttggctgtgagtacaagcagggcatcaggtggaagggcctgtgctccaggcgggtgctccaggtaggtgctccaggcaggtgctccaggcaggtgctccagacgggtgttcagtggctactagaaaacagcactgatgtgtctgccgttacatttcaaaaaagaagtcacctgaggcttggctggactctggactcctgtgtttcagtccaggtacactgtgttttctagaacagagattctaagacttcccaagaagtcagtgctctgcagggcccaggcatagctctgcccatgatacacataggaaaaactgggtcaggtcaagagagctctccgggtgaggccagggcccctatcctggaggaggacatcgcccaggtctgcatccctggtttccacggccgctgctgtcgctgtaggctgcgctacctctcaagctgattgggcacatctcatttttaattgcaaacttggtctctagaaaacccatcaattcagggtttcaagagccttatcatgcccgcattcacacacgcgcccgtgtgcagctagtgtcttttggtagcactggcagggcgctttccccaagtggggggcagctcttatgctcatcagcactgaagccgctttctagaaaacactgtggacagtgatcccagccccaaactgccttcagtcttctagcagagaaaataagcagcttgttttgagcaagataacgaagctaaagcattctccctgcaaaggcaatgctgtgggcgccttagacctagccacgccctgtggctcacggtcaaggggctttgccttaagctacaaactccacttagggctttctgcaggcggtgtgacaaatcgagggaatattctgtgtcctgggatatcacttcccgccggaacagcttgtgattggacaaccacagaaccagcactgtggaggggaagtgtcgccccgcagctacacaggcttgtgcctaactcctgtcttttctttttcccagggaggaagagacagccgctctggatctcccatggcgagacgctgagagccctccccgctcagccttcccgaatcctgccctcggcttcttaatataactgccttaaacttttaattctacttgcaccgattagctagttagagcagaccctctcttaatcccgtggagccgtgatcgcggtggggccaggcccacggcaccccgactggttaaaactattcgtcccttttcgtttgaagattgagttttctcggggtcttctcagccctgacttgttccccgtgcaccttgttcgactccggaggttcaggtgcacggacacccttccaagttcacccctactccatcctcagacttttcacggtgaggcacacccctccagcttccgtgggcactgcggatagacaggcacaccgccaaggagccagagagcatggcgcaggggactgtgtggtccaggcttcctttgttttcttccccctaaagagctttgtttttcctaacaggatcagacagtcttggagtggcttatacaacgggggcttgtggtatgtgagcacaggctgggcagctgtgagagtccagagtggggtggccctggggacacttccaggccagctatcccctgcaccccaccagctgatttcgagcgtggcagagggaaggaaaggggcgagtgggctgggcaatggccccaacaggaaacggggacttaggagaacacgctggagatatgtgtggccgccaaatgtcaccatctctcctcagtggctccccagagctggtgcttttaagaaccctgtttcctctcagagcccagggagagtccaaggacatggcgcatctggaagtgggactgcaggagttctctggtggcctcgtgctgtccctctggccacttctcatggtggggtggtcagcggcagctcgccatggcagtgcccattggtacacactaaccttggtggaaaaataaccattccctgcctcctagaaaggactcattcttagctttaggggggttcctgtcactgaatcaagtcgctgccctggatgcagggctggcctgggcgacgctccagggatgaggagctgagaaccccagtctaataatgtccatcgacacctccttatccctctaacgtactatgtcttttgatttagcatgccttctgtagaccttccaaagagccccacactggcaccgtcacccctaggaaggcaggtgatggttgatgtagcccaatactgcatcttgttaatctgttctaactctgagtagagtgtgggtttaagataacaccgattaatgtatcgccacaataacgtgagggtaagagaaaaagcagggaagaaatttccagaaaaaaaccctccagattgtcccacgggagtgtttgccctccagtgtgactgaacgaccttgcccatggcttcgtccagacagcgcagctgcagtatggctggacagaagcacctactattcttgaatattgaaataaaataataaacttgcaatgatctttgcccaggtgtctcattttgcacggcagcctgtaggcgtgagcccgagtgaagcacagcctcgtcgcagggtggagggctcttcctcaggggcaccgggttgcttcacggtgcccttgggagaatacctcaaggggcacgttgaggaggccatgcattgataaatcaagaagatggagtagaggtgatgtgggacagtgacccacaacacacaaggaaaaggattttcagtcactctgaggacacttttcaaagccattgtcctaggaaacactgcagaaaagcgggtcacgcgctttatccacggcggacggggattaagtgaagcattcttcccccctccccccatttgtcctttgtttctcttgccattgattttggttatgagacttctttttctaaaggattacccgaaatctcttctcctgttggttttgagagcgctcctggcccctttctgagtttccaaggcaggctatggaaaaccatcagatttgtgagctgtgggaggaaggcttgccatgggccaacattacagtctttctctggggcatgttgttccagcacagggaaccagtgcaggttcctggggtccactgactgacgggaaaccttacctccagggctcaggggctcacgtctataattctagcactcacaaggtgggggcgggagattgcatgaatttgaggccagccaaagttatgtaatgagttctaagcaagagacgctgtctcaaaaatgcatgcctttaatcctagcgctggggaagcagaggttgagctctgtgagcttgaaaccagcctgatctacaaagtgagttccagtacagccaggacacagaaaaaccctgtctccacacacacacacacacacacacacacacacacatccactaccaccaccaccacaacaacaacaaaacagacaacaaaaacccaccaggggctagagagttggtcagccattaagagtattgactgctcttgcagagcatctgggtttggtttccagcaatcacgtggagttcacaatagtgtgtgactaaagttccaggaaatttggtaccttcttctggtctccgcaggcatcaggcacacacaagatgcacatgcatacatgcaggtacacacaagatgcacattcatacatgcaggtgcacacaagatgcacattcatacatgcaggcacacacaagatgcacatgcatacatgcaggtacacacaagatgcacatgcatacatgcaggcacacacaagatgtacatgcatacatgcaagtacacacaagatgcacatacatacatgcaggcacacacaagatacacatgcatacatgcaggcacacacgagatgcacatacacacaggcatacactagataagcacacacacacatacatgcaggcaggtgttcacacacataaaaatatttttacaatcttacaaagataacaaaaggctgatgtccaatcatctccttgtcctttttagccaacaaaatcctcccaaataaaggatctggaaatacaaagatgtgtgcactgtttaaagatgcattgctgccgcaatctccataacctcataggagcagctgctccaccgtggtcactcaccacccctggctctattttaaagtctttccgccatctcgccatctctcctgcaatgaaccatgagctgcgggagaaagggatataacatccatctcccatttagggcagagcattctgccatcttttagtctctgcaccatggccagttgtgggtctctgcactcatcaccctgtgctggttgggttttgtcaacttgacacaaccctaaccatatcttgagaaagagaatcttaatttagaaaatacctccatagtattgacctgtaggcaagcctgtagggcgttttactaataattgatattgtagggttctccctactgtgggcaagtgatcctggatagaaatcaggctgagcaggccacagggagcgaggcagtaagcagtacccctccatggcttctgctccagctcctgcctacaagttcctagcttccctcaatgatggacttgtaagttataaggtgaaattggccctttcctccccaagctgtttttggtcatggttgaagaggaaacttctggtctctttggaaagtcagtcgtgtcagatgatgttttgctggggcacacaggtgaaaggatgttttgctaaagcagacacgtgaaaggctgtgtggtgtttagaaggaatgtaaccctgaccccacaaacagtaggagctcgagtgttggtttgacttgcccacctcactagtcttccctaatgacacacatgtatcggctcaccttacattgcattgctgagccaagcttgtggtgccttcatagacagaaactcgccagagaacctcttgtggggttcctgaagcttcttgctacttctacagacttgggcaggttggccatccttgagggtttcttctgtattgaactgcccttgctaatttgtgtgtggtgtctgccaagtagactggatgcagccgctgaataatgaagactgaaatcgcccccaaagaactatttctaaacatgtccacttcccttgtatcacaataacatttcttctccactacttctgtagaatccaaaataaattcaagaccacccagccccttccccctctgaagggactttccaaactgtactagcaggccaagtgcagagccagataaggaagctggctgactaaacaatgctgagaaaaaccctaagggcaggcagagtgagggactaggccaaaggtagtcaccccatgcaaaccaaccaatgcctgaaagggttacacttgctacaacaattagaataagccagctagccctgttgcctaaatctgccccctacaaggtataaaaagtgtgggtttttttttttttttttttgttcagggtctctcctcttgcctgtgtgctgagggggggaggccccaatgcattggaataattaaaaaaaaaaaaaaaactctgtggtttgcaacaatgtcggtctctgtgatttttgtgagtgagggtcttttggtggactccaacacttctggtgggtggtgggctagagaggaagttgaacctttataaaagtagattgtgagaaatatgtgcctacacatggtgttttatcacaggaagagaaaccacaccaagatgccatcagctgcaaagagaagcttctctgatgggttgagagaggcactcatctatggatagaaacacaagcctgcacacacacaagccagacaaaacccgggcatggagaaaggtggtgtgagatttcccagccctagcctagtggtagctgctaagaaagggagagccagttttcttttagagtgctgcttctggtgagttgaccacgccccagtggaagaccacacatccaagaatatgagagaaacacgtattggacttgtgtgagtgtaagaaggcaagattccccagccctcaacacccagccaggattagggctctgcttagctccaatcacaaaggtggaggtttgaccactcactcagtaccaatgaagctattccccagctcaaccaccagggacagtgttcctcttccggcatagctggggctgattgctgtgtcaagggaggttcatctaggctcctcagagccaaaagtctggtgtgaactgcttcaaacagcccagctgaggatatacctacaggaactggggccgttagatgtcttctgactggtgctagccataaagatagtgctattggtcatttaactggcagtcccattagtcaaagtagctgggacaggaactaattaggtactcaagttagcccatcccccagtgtcttcactgtagggaaatgaatgtcagaagaaatgcttacaacaactcattactgagctggggacatgacacagcaggtaaaagtgattgctgtcctgcaggacaatctggttagacccctgggactccatagtggaagagtaaaacagactgaaatttgcactctgacttccacagtgtgtttacacacacacacacacacacacacacacacacacacactacatttaatatacaaatttaagaactccatcgacaataattattttagtggctcttaactcctgcccagtgcccaatgctggccccatctgtctcataaacatagtaacagtggtagttaacactcaaggcatgaatgggaacagcagcattcagccataatgatgcatgtttatttttacccaagtatttcttattctcctcaaccccacactgggagctaagactctacagtaccaatgcctcatcttgatattgggatttgcctattgcagaccttgaacagtcactggaatggcaaatgaagtgatattaggtaagaacgaccaatcagatgcatgcttaagagaactatctttaaggtcaatcatgtgagaataccactatgcatgcatatatagattcctaagtgcaaaggcaactgaaataaattatcccaatataaagcatttattttgggggctgagggtatagctaagttataacttgtttagttagtttgcatgcacaagcgttagggtgatcttttgtgcaccatataaagatggtctttgtattattcaaatgctgggtagaatgttgagagcatagtggactttggtatttgcactggctagttttgtgtcaacttgacataggctggagttatcacagaaaggagcttcagttggggaaatgcttccaggagatccagctgtaaggatttctcaattagtgatcatgggaggaggtccccatgtgggtgatgccatctctgggctggtagtcttggttccgagagcaggctgaacaagccaggggaagcaagccagtaaagaacatccctccatggcctctgcatcagctcctgcttcctgacttgcctgagttccagtcctgacttcctttagtgataaacagcaatgtcaaaagtgtaagctgaataaatcctttcctccccaacaaaaaaaaaaaaaaaaaacaaaaaaaaaacgaccaatcagaatgtgcagccaaggatacattgcttgttggccatacggtttacaccagtgtttacagtgtaaatcagatgccaaggtcagaaggctatgcatgctcaccaggtatctatgaggcaggggagggaccctactctcccatctccactccactggactgccctccattgtgaactatcatacaaactgctgggactcgctatcacttccagaccatgagtatctgctgaatactcttgtagctccgtgtagctcctgtcgagcttgctcagcactggggtcaaatggtgatgggggaggggcacggctgccactgctgccacctgtcctctaacaggtgtttgccgaccttctggacaattctcctgccactagagctggccatgagcctccaaggctccttggagacactttcaactatcactcaaccaaacaaagttgtgaccgcagtcagtaaaggctgtgtggcacttaaagagcagtgtgtcccttaagaatcactgggaagtaagggtggttaaaagggtaacccttttctaccttttctagagagctgtgatggccagatatggccttggcaggagggcctggagtaaggttgtgacccaggctgctggccgaggacacctagagggactacaggtggtaggttggccttgtacttccttgtgacagaggggaagcagataaggaagggggggaactaggggagttgtgtagtgctgtctagaactaggggtacctggatgaagcagttacatttaaatggtaagaagggaaatgtagggctggagagatggctcagccaccacatggtggctcacaaccatctgtaataggatccgatgccctcttctggtgtgtctgaaaacagctacagtgtactcacatgcataaaataaatacatcttaaaaaaaaagtctgggagcacggcacacacagacacacacatgcacacacacacacacacacgcatacacacataccaatagaaaatagtgagcacacctaccagtgttactaaatacctgtcttctaggagcaaaggctgagagcccagggctgggaaagaacaaactgactgtgccagagaagagtgctcaggaaataaaaagctacgagggagagctcctggtggtagaaacctgggcttctgggaacatctcactagaagcagctatggcagcctacggcagctcaggaaagcgaagcagaagctcaaacaacatcagccgaggagaaaccgagtgtgggagagagagagagaggatgctttctttcgggggacccacacgtcagggtagggggaaccgcagcctctggtccgagatacccactctacatacccaatccggaaacattccagttacggagaacaagacacacacactctctggttacactccagctaacacacactggagtgttgtgtgcacggctgccactctgcagcagcactagggagccggtgagaaaaaccctgcagatgcccagtgcagatgccactttcaaatcttctatgggtgatggaacccacgcctgtgacgccgcccacggacaaggcgcgcgcgtggagaaacttgctgctactgtttctggaactgtttaaacaacaaagaaggaatagggctggctggctgctgtgcacctgcgacggcaggcttaagtgtaaggtggctttcaccctctgaggagctttgaagcattagcagaatcttcatcaatccagaatgccatgggacagcagaatgaccttgccaagcactgcatgcggcatgagcctctcctggaggaacctttgactatttgaagctctaagctggatggcgtggaggaagccagtcatcagcttttgtgtaaagcttcactgtggactgagccagagctatccgtaagccccaggggatctgctacattctgacaatatccctgtggcagctgtagctttagccgccagcccagcaaagccaagagaccaccaggattgagacaagggatagtctaagcacccacgccattaccacaattcctagagggcaggagtgagccagggaagctgcccacagagaactctggttgtggagccaggttgatctctggttccatcatcaaggtcaggacatcagcctttcaggctgcctctgccttccacggcccaacccacccaacctggagaaggagccagggcagtgcttttctccctggactggtagccgtggagcacgtgtggagtctcccaaacctcaaggccctttacctgagggcaggaatgcaggcaggcctgggcaggacataacctgagcagcctagcctagagatgaagcttttgtagcactctatggtaggccgcaaggcaggcagccttcgggtcacctcacaacacagaaaggcggcccttgaaacagctccacagcagctgatccgttgtaagtctctagcaccccagcaaacgcagagacagcttgtgacgcagagacagcatgcaggatgagccacttcctcggcatcccccctccccaccctgcatctgtcccttcagctgctcagcctgaccccaaccaggctctccgaatgttctactaaagcaggagcaggaaggacaggttcctcgcagcctggggaagtggcagagtcaggcacagccatgggtcctgcagggccacccatgcattctctgaggagggagccccacgtacttcagagcacatacgtcagcagatgcctccccctcgccgtcggcatgcctgtacctccacggcagaggaccagagtcgcatcagcttcatgccctgcagacacgctgggcacacggctaccactcactccaggccgcaagaagtaaatatacgggagttttaaaataatacaaaaactatttttattgtttttttaaaagccagcacagtggcttctggcataactatcaatttctaatacaaaactggattaaataaatatcatccaatgtataaatagaccatgagacaattctgaagataaaaagagaacttttcggtaaattaaaaaattaactttgaattttcttggtggggctgaagaataatcactatggcattttagaacctgtcaaatatacaaatcttgattcgatacaaaagtcttcatgccataagcattacacatagaaaagatttaaatagcacgattttttgattactgcctattgctcctgacacactaacagatctataccatttagtccatacaaaaaaatgaccacaatgcctgtgcaggtagagtgtggagtggaatataatgttcacctaatggtgagcacgcgtgggaagagccggtcaaaggcagcagtggccagtcagtgcactgccgtaattcccaggaattgtgcagctctaattttcagtcagcaaagagggtgcaaccagatttcaagtcacttcacaagaataaggttgaaaagtaaaaccagggtgagtgagaccaagtcgggctctcgtgggcagctcctgggtagctccattttccttggcttttggtttggttttggggtagcccaggctggcctggagcatgctatggagtagaggttgacctcctcccatttcccaaatgctggggttacaagtgtttgaaagcacatacgtgttgcagcccacttaagactttgctctacatgatacggattttacccacatcccaggcgtataaaccaagggcagagcaagaaggggctatgggtcagcctcgccttgtgcatggttcacgagtcagcacagcagcaccaggccctggggtcactctccgtggaggtgtggggacggcaaggggagggggctttgaaactggcttgagagaaaccccttatgcaaggaggcatgagatatccctggcctacagatacggaactcccttataaaacactacgtacatgcatttgtgtgacgccatgtaggttgagcatgagtcttagtgagtgaatacacctctcagaagatagcccacagtaccaaaggctgttctcggaaatctggatgacacagatgtctaaactcacaggtactcatgagaactccaaggaactgaactcagctttccttacaaatggtgtgcggggcatacaactttctggtgcacacggcctaccattttgatacctcactatggaagcaacttctgaggagcctccctaacctcctgaggccggctactctgccccctcatctcctcaggctgctctctgagcacctccagcctgactggctgtaggagaccttgctgggtgtgaggggtttctttcccagcctctgcccacctttatctatggccctgtgcggggtctgtgcacgccacactctcctgctccctcggtctcctcagctgtactcatcctagggccagcagcagcacgcctcagggataggcttagcggttcttctcccaaccaggagcctccttcaaggactgagtggctctgaagagctgaaggagtgacaccatcaagactgcactaggcacgggatttgctgtcaagggtcatgcctggctgtcagctccatgtgcttcaaggggacaccaagagagtatgcattctctggacctcacacaggtaaaagaaatatcataacagtttttgttttctgctaaaaatacctgaattgaaatttattccccacccaactagtctatctgaaacatgatttaaaaacaaacaaataaacaaaaaaaccacacatacaccacatttcctaatgccattttgcatttagttatttcaaaacagtttatgttatatagagttctaaaaatacagttctctatcctcaaaaccctggttacacatgaggctagaaaccactttcctaaaacagcattgcaaacatttaaaatacagagatcaacctgtaaaccacaatattcaagtgagttatcttctcaaaaccttgtattgtcaagga

SEQ ID NO: 1460 - DNA, 2486 bp, Mus musculus
agcactgggaggcggggcgggagcggggtgcgcgcccgtccccggagcagccgctgtcagtcaccgccgctgcgcgccagggaggaccagcctctggctcaggcggcctgagcttcacgaccccggaacatagtatccgcgccccagcgacccctagcccagcgttgggtcccatccgccgggatcccgggatcctgggcccctcttggcctccgagcagcagccagcaccgctcttgaacaccccattgggtcgccatgggaaaccactctggaaagagagaattatctgctgagaaggccagtaaggatggagagattcaccgaggagaggctggaaagaagagaagcgtgggcaagctttctcagacggcctcagaggacagtgatgtgtttggggaggcagatgcgatccagaacaatgggacctcggctgaggacacggcggtgacagactccaagcacacagcagacccaaagaataactggcaaggcgcccacccagctgacccagggaaccgcccccacttgatccgcctcttttcccgagatgccccgggaagggaggacaacaccttcaaagacaggccctcagagtccgacgagcttcagaccatccaagaagaccccacagcagcttccggaggcctggatgtgatggcatcacagaagagaccctcacagcgatccaagtacctggccacagcaagtaccatggaccatgccaggcatggcttcctcccaaggcacagagacacgggcatccttgactccatcgggcgcttctttagcggtgacaggggtgcgcccaagcggggctctggcaaggactcacacacgagaactacccattatggctccctgccccagaagtcgcagcacggccggacccaagatgaaaacccagtagtccatttcttcaagaacattgtgacacctcgaacaccacctccatcccaagggaagggaggaagagacagccgctctggatctcccatggcgagacgctgagagccctccccgctcagccttcccgaatcctgccctcggcttcttaatataactgccttaaacttttaattctacttgcaccgattagctagttagagcagaccctctcttaatcccgtggagccgtgatcgcggtggggccaggcccacggcaccccgactggttaaaactattcgtcccttttcgtttgaagattgagttttctcggggtcttctcagccctgacttgttccccgtgcaccttgttcgactccggaggttcaggtgcacggacacccttccaagttcacccctactccatcctcagacttttcacggtgaggcacacccctccagcttccgtgggcactgcggatagacaggcacaccgccaaggagccagagagcatggcgcaggggactgtgtggtccaggcttcctttgttttcttccccctaaagagctttgtttttcctaacaggatcagacagtcttggagtggcttatacaacgggggcttgtggtatgtgagcacaggctgggcagctgtgagagtccagagtggggtggccctggggacacttccaggccagctatcccctgcaccccaccagctgatttcgagcgtggcagagggaaggaaaggggcgagtgggctgggcaatggccccaacaggaaacggggacttaggagaacacgctggagatatgtgtggccgccaaatgtcaccatctctcctcagtggctccccagagctggtgcttttaagaaccctgtttcctctcagagcccagggagagtccaaggacatggcgcatctggaagtgggactgcaggagttctctggtggcctcgtgctgtccctctggccacttctcatggtggggtggtcagcggcagctcgccatggcagtgcccattggtacacactaaccttggtggaaaaataaccattccctgcctcctagaaaggactcattcttagctttaggggggttcctgtcactgaatcaagtcgctgccctggatgcagggctggcctgggcgacgctccagggatgaggagctgagaaccccagtctaataatgtccatcgacacctccttatccctctaacgtactatgtcttttgatttagcatgccttctgtagaccttccaaagagccccacactggcaccgtcacccctaggaaggcaggtgatggttgatgtagcccaatactgcatcttgttaatctgttctaactctgagtagagtgtgggtttaagataacaccgattaatgtatcgccacaataacgtgagggtaagagaaaaagcagggaagaaatttccagaaaaaaaccctccagattgtcccacgggagtgtttgccctccagtgtgactgaacgaccttgcccatggcttcgtccagacagcgcagctgcagtatggctggacagaagcacctactattcttgaatattgaaataaaataataaacttgcaatga

SEQ ID NO: 1461 - protein, 257 aa, Mus musculus
RLSFLGVFSALTCSPCTLFDSGGSGARTPFQVHPYSILRLFTVRHTPPASVGTADRQAHRQGAREHGAGDCVVQASFVFFPLKSFVFPNRIRQSWSGLYNGGLWYVSTGWAAVRVQSGVALGTLPGQLSPAPHQLISSVAEGRKGASGLGNGPNRKRGLRRTRWRYVWPPNVTISPQWLPRAGAFKNPVSSQSPGRVQGHGASGSGTAGVLWWPRAVPLATSHGGVVSGSSPWQCPLVHTNLGGKITIPCLLERTHS

SEQ ID NO: 1462 - DNA, 39344 bp, Homo sapiens
  misc_feature (1)...(39344): n = A,T,C or G
cacactgacctgcattttatggaaggtgtgtaaatgcagctttcttgaagcactgaagaacttttgaagatctgccactctgtagacttccgattcatgcacctttttgtgcatttatcatgcaagtgagtaagatatgcttgtttaggaaaagctgcacagggtaatcctttcttagtggaaatttcctacatttcatgcatagaggaaggaattgtattatgatttaaatttaagtctattcctttgatgattgaatgaatgaatggaatgagttaatacagaaaaaatctttaaagcaatgacctctctcaaatgcatgaccccttactattctttaaactttattttcttagtgacattaagggaaacagtgattaccttaaatctaagtaagaagaaactgggtatggtacctcacacctgtaatcccagcactttgggaggcccagggaggtgaattgcttaaacccaggaattcgagaccagcctaggtaacatggtgaaacccgtctctacaaaaaatacaaaaattaggctggcatcgtggtgaacacctgtggtcccagctacatgggaggctgaagtgggaggatggttgagcccaggaggtagaggttggagattgcagtgagctgagattgaaccactgcactccagcctggatgacagagaaagactctgtctcaaaaataaataaataaataagcaaagagataaaaaattaaaatatttaaagtattaaatctggaaaatagaccagaagtatctggtttcaagtacctatttaatttttatcattttgcattcttttttctttcctatgtattttatttctcaaattgagcacaaataaatagctaagatgcattatgtatatttctcatgaagcagtgctacatcaggccttttgttggttgcagaaacttaactaaaatgcacttgtgaagagcaggagcttatctcatgacactggcaagtctaggcggggcactggcttcaggcacagctggatccagcagatatagtgacatcctctgggcttcttgatttccatttttcacttggcttccctccacatgattggtggcctcaaggggcctacttcacacagtgacaaaagcagccgccaacaattctaactttttgtagatgtggcagtttggaatatcaggggaagattaacctgtggggtatttggattggctaggcctgggtagatgctgatttctaaagctaagatgcattatgtatatacaatatgtatatattgtatatgatgaagcagtgctacatcaggcctttttttggttgcagaaatttaactaaagttcacttgtgaagagcgggaggttattatctcatgggactggcatgagataatattctagtcccatgagatatgcccctccaccccatgagtagggggacatctggggatgaatctgctttaccatagaatggtgaaacaatgtttctcgaaggtagggatgctggacagataaatatgtacttgcttcaggtattttctacacagggaatgaatctccatgaatttgtttcagaggataccatctctcactatactttgactgacataggtatatactaaatattctacaacagtataaagattaagaatattgtatgtggattgaaattgatccagctttaaatcccatcaccacaaacaaaaatgtgcatgagtcctaaggttggtttaacctttccaagacttggctgtttgcttgtaaaatggtgaaaataacaccaactttatagagttgttatgagaattcaaagagatagtgaacatatttcctacagtatagcacataagacactctttcaaaattattgctaattattaatgacttggttaatgctggtttattactattcattcattagcatgctcacatgctagcttaggatgcaaagatgaggaatgtgtctgctgtgtttcagagtatggaggtggttaaatgaatgtggccagataatactttaaatgcttccttttccattttgttctagatattttatttctgttctacaccctgtatatcactaaaacctaactattagacaggattatgtccctcagggggaaaattacaacagtccccaatgccagaggtaggggtaagggaatggcgtccaacttctgctgtgagttccaaaacctgctgtttaaagctacagagagagagtggccttgctggaacagtggtccctgtgtggagcctggaacatcctagagacccgagagtggggaggagtgcagcggacaccgaggctggtgcttgtgccgtacccttggggctggatgcagggcaggagggcccagcagggactggctgggaagccagggggctgggtcagtggcagaggggatggtggccccctgcccccacaaatccccaggagtttgtgactccagcagtgcctgtgcagctgccctcagaccccaggagtgtgcttcatccacccagtgggctgcctgcatctccaaggtgaccggagcagccaggtccccaggctggccctgcccctgttgtcacagacacacagggcccatgggcaagcagggaggatgccgatggcatccatccccaaaagtccttccctggccagtgcctggctgtgtggaagacctccagagacccagagcagctgcctggagccgaccccaatgtgctctggagagactcccgggttaaaggactgcgagatgcttgcccgcgacatgcgaagttacaaagcattgtgagggtgctttgggaagccaggacagagttttctgcgagtatagagggaggagtgatgcgccctaacagggacagccaaaaagactctggaaatgagataacattgcagctgggacttgaacgatgagtcaaaacatcctaggtgtaatacaatgaaaattgacattcagataggtggtctgtctgtcatgtaggaagaaaaaaaaattaaggaagagcagagtatgttaggacgcttactaagagtccacttggctggaacagctatggggagggttcttccatgtggcttggaagcttctctttcttttctatttgattggacataactgattctgcagacctgcaaaacatcaatggggctgagaagtgcagtcttccaggagcctggaaggggagaactgaaaatgtggtgaacacacataacatctgtcacagattattattattattttttagagatgaggtcttactctctcacctaggctggaatgcagtggtatgatcatagcttactgcagcctccaactcctgggctcaagcaatccttctgcctcagcttctcaagtagctggactatagcaggtgccagcatgaccagctaatgttatttttatttttattgtagaaatgggattttgctttgttgcccaggctggtctcaaactcctagcttcaagcaattctccctctttggcctcccaaagtgataagattatagacatgagccactgtgccttgctgagttttaaaatttccattaggagagactaggtcgtcttgaattcaactctaagagaattggaataagacagaataagacagataattgagacccttgtaaaaatgcaggatccttgaaaggctacactgttagtgaaggattcacctataaaaagtttcctggcaaagaagtgctgtagtcagcttttgctgcattaagctgcagtaacaagtagctcacagccacaaaggctaatttcttgctaaggggacattttaactggggtcaactgaaatcctgtggcacgtattcatggagaacacagcccaaagcagcagcctgcactgggatgcacagtcttcgtacctgagggggatgctcagtgttcgtacccgaggaatgaatcccatggtattgcttagaccttgagctcaggatgacctcacagctgttgcactcacattgtctcagccaaagcctgaaggaaatgggtaagactcatttctgccctgagaggagcacagaaattcacctgggagaggcaggattacagaatcttccaatagggagcgcagtaaatgagtgggaacaacaaagcaatctgcccacaaacacttctagaaaactccgtggcagccttagggccaggtgggagggaaagacctgagaattcactcccccattacctctcttatgtaggttttggggtttgaatttacccttgtgtgtcctgatgcatatcatgctgagaaattaacttaaaaatgtcctgagttgatggtaccattgggccaatggcagagcaaataaaaacacttttataggagtatgcacttaactcaagtctatcaaatcatcacaggtatgttctggcttaacagaaatctaaaggacaaaaacaaaacaaaacaaaactggaaacaagctacgagaataggaacttggtagaagtaataaaagcataattagactccaaggacttcagatattagaattttcagaatataaaatcagcacatttaaaatattcagataaataggagaggtaattagaaacatcagcaatgaggaagaaaatattaaaaaataggcctggcacatttgaaaaaattctgtgagaacttaaggagagtagttaaatcaagggtgtacagctgaagaaataccaataaattggcacagatgaagagatgaaaagtatgaaaaagtgagtcagtgataggaaggagatagtggaaaggcctaagctatgtctctcagaattccaggaggagagagtgccaagaatggggaaagtaaaagagataatggctgaaaatttttccagaactgatgaaaaatatattaatctttagcttcagaagctcaacaagaagggctaaaaaatgaaaatcatcacaaacctatcaaagtgaaattataaaacatcaatgataaagagaagatattagaaatagagaaaaaagtcagattatctctaaaggagtgacagaaagcacatcagctgatttctcaagagcaggagcaaaatccagaaggtggaaaaatatcctcagtgtactgggagaaaagaactgtccatctggccaactcccattcaataataagagccaatgagcaatttttatcattgactatcactaaaggaaaacttaaaatatattctctaaaaacaaggaaaaggcttaagatgaatagaggaaggtgcagaaagccatgggtaagaatgtgggtcaccaaactggatattgcctgtatcacacaacaaatatgccgaattggggggaaattaaaagaactaaacaactgggcaacaaaaccaggtagaatgacaaaaagtgactggagttagaaggcttcctgaaacttgtatggcttgggagaaggggagtgataacaattaattttaaattctatttaatattaatagaattttagtaacttctgaatccatgtctccagctctggtctctctcattaactcaagactaatccacccaactgcagtcttgtcagtcccatgtctagcaagcacctaaaatttaacttgatgctccacacctccaaacctgttccttccactctttgtgtcaactcagtaaatggtgatttcccatccaggctgtcagactaaaactgtggtagtcaaccttgctctcccttttctcccaccttaaatccatccaccaacgaatctcatttgctacaacattgagatatccagaatccaggtccttcccaccacacctagaacgatctgttgtctgggttcctgcaagcttactggttggtcttctgctcttttctttgctcttctaatctgtactccagaatcatcattctgaatcgcaggtcagagcataacatctctctgcttgaaactccctataggacttcctccgaagtccagaatgaagtcccaggccccttccttgctctccaaggtctgaggtcatccatccccattttcctgaaccaatgttttctgacctcgtggctgacaaatcttcttcccagctgtttccatgacagcaaaactgtactcctcgttcttcacacagcttcctctgctgcactgtttcccgggaatgtgtcatgccacgtgtttaaaaggtttccttctgtacttccttcaggttcctactcaaatgtcagtttttcagatgtttctccctattgccctgtatatagttatactctctaactgctctctatcccttatcctgcattcttctcttttagggttgtattaggccattcttgcattgctataaagaaacacctgaggctgggtactttataaagaaaagaggtttcattggctcacagttctgcaggctgtacaggaagcatggtgctggcatctgctcagcttctggggaggtctcaggaagcttctaatcatggcagaaggtgaagggggagcagatacatcttacatggcaggagcggaagcaagagagggaagggaggaggtgccacacactttcaaacaaccagatcttcagactcactgtcccgaggacagcaccaagccatgagggatccaccccattgatccaaaccctcccactgggctccacctccaacattagggattataattcaataagagatttggcgaggacagatatctaaagtatatcagtagtgtttaccacatgtgacattatcattttatttatttttaaatgtcgtgtccataatgaaatgtaaaatccataaaagaaagtactttgttgtgttaattgctctatctccagaacctacaatagttcctggcacatagtaggcactcaagggtaaccagtaaaacaataaatatacactatatttcttccttttccaagaatgtggagggagggagaaaacactttaaaatgcaattcaaaagatgtcatgaaaagagagagagagagagagaaaaagcatagaaatagaaaacaaataaaaagtacaaaataaaatgttaaaaataaatccatataggttagtaataacaataaatataaatgacctaaactcaccagttaaaaactagagattttaaaattgtgttttaaaataattcagttatgtgctatattaaagagatacctttaaattgcaggacataacataggaaggctgtaaaagatgtaacaggcaaatacaaagcaaagaatgttgttgtacttatagcaataacagacaaattatactttaaggcaaaaacaaacaaaacatgtaccataataccaaccacataatgttaaagcaaaaaaaaaaaaaaaaaaaaatcaccacaatatattaagatcatatgcgtatgccaaaaatgtataaagaaatgactaatagacaacaaatttaggttacttggagatagtgggagaggtggaggttgtgactggaaaatatataaaagtgacttcaactctagtgataatatttaaaaattattctaagctagatggtgggtgcattggtattcaatgtaattttatcatatctgtttcatgtgaaaatagttcataatttaaaaactctcccaaatcatattactactaactttcaatgcaacagagctgtcaaatacaacatgatactttgaaagcctgggtcggagagcgtctcagggaagaaaagcaatacggattggcaagatcacctgaggaagtttcaaggcattctctcaggtcggggcaggtaagagcattcttggctttagcaggatacccaaataggcaagttgcttacactcaattttgtcttccagaaaatgtgtgtgaatagaacaattcccttgcaaggaactccctagcaatgaatgtagataaaatacatagatgttcaatgaactgcatcaagatttatctggaaatgaggcagaacagagctagcaaggtagaaaaacaagatcctacttccttaactcctcaaggcaaagagcccctgccctctttggtctttggattacccatcccctcaggcactgcgtccgcgcataatggacagtcaccagatggtgaatgctggaaacgcatcggtgtttttgaaagtgaaaacagacaaatcaccgcaaataaaggaatcagtgtcagctctctagctgggaaccaccaaggttacaaagctaacgtgactggccctgctataccgaaacggcttaatttctttctggcaaatccacatttacggcagtaagatactaaacactttctttcactttaaaaatatttcgtttgtcactgctgcagtttatgtccctcagatgagtaatacgaggcaaaaatgaagtgaggttgggtggtgtgaacagccttccccttccatgtcagccacgtctatagagaagctcacgcggccctttccctttgcacttctctcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggccggcggcatccggcagccccgccttcagcccgccgggcaggtccgcactccgcagaggcgagcgcgctccggttccagccgggaggtgggcggcgacccatcccgctagaatccgtccagtctctgctcgcgcaccgtgacttctaaggggcgcggatttcagccgagctgttttcgcctctcagttgcagcagagaagcccctggcacccgactctatccaccaccaggaagcctcccaaaagagctctcgccctgtggacgactcggaatcccctggaaaagccgggagggagtcggaggcgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgctggcgcgcagcaagccgggcaagccgcggagcaccaccaacctgttcatcctcaacttgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtgcacgccggtcgcggggccgagacgcgcgagggagggcggagggccggtgggggccctggggtctcagtgtcccgcggccctgccggagccttggcggcagcctggccccggtggtccccactctggcggcgctggtacggatctgtgcagagaggcttcctggccgctgctggagcgtgccattggcttgcgcaagaaagttacttggagtctgagagatgctggggaaagtttgcagttcacttcgcatggtccagtagaaccagtttctcctcccctccccttcctcggccctgcggcccttcaacgcccccaggttgcctgggcggtaggtaggcgggcgctgccgcatccttcccggtacagcaaaccccgctcggttccagcaactcttcaaccagatcagctgcgcggggaggttaccgccgcggcgctgtgggacctgaggagagctctggtggtcaccagagcgcggaccttttgcgagggtgacgggtccccacagctccctcccgggctctcagctggccgtggcgggggggactcgcggggcggcccctctcccccggggtgcgcagtttgccctcgctccgaaggctttgcgcacaccgggctctgtgaagccgctgctcccggggacagagcctcgaattttattttattctgaagcttagctttgtaaacccaagtgcaaaagggtgtttctttacagagtcttgaccgcaggctccaggaacttggaatggaatggactcgagctttcggcttccccatttcaatcctttttagaaaggtctcctgaacagggtgaagtggttgaggcggcgggtcttcaccctaactgtagcagaggcaccgtccacgcgtgtgggagatagtttttccctttgtacagccgggcagagctcagcactcacattctttttctcattaagtccacaagggtttgaagactttatactgatcaaaacgtcttcagcctttgacatacgtgtttttatttgcgtaaacgggagcttattttaataatcaggtgatggcgattcaccgggtaaaccctaatgtgcgcaacctcctcgctccagagcatcgccatttgaaatacagctgttaccagttccacccgacttcaccgctgtctctcattctgtttcaataaggctgtgactatacgaccacaaataacctgactaggtagaacaactatcacttttaatactcaagtcacaaggtatttttatcaacaaaagtgtttactataagccacctgtttccccccacctatttcatctaggtagattgtgtctattttgaataataatattgctggatattatctgaacggcctgcaccaaaaggttaaatatgaagaaatacagtaccactttgggaggccgaggtgggtggatcacctgaggtcgggaattcgagaccagcctgaccaacagggtgaaaccccgtctctactaaaaatacaaatattagctgggtgtggtggcgggcccctgtagtcccagctactccggaggctgagacagaagaattgtttgaacccaagtgacggagggtgcagtgagccgaaatcgtgccactgaactctagcctggctgacaacggagcgagactctgtctcaaaacaccaccaccaccaccaccaccaccatcaccaccaccaccatcaccaccaccaccaccaccaccaccatcaccaccaccaccaacaccaccaccatcaccaccatcaccaccaccatcaccaccaccaatatagtagcagtaagggaatttggaaaagaactctagcttagctatttggaaaatggctggtttattaacgtggtcttccgcagatgctaaacaaaggctatcttacatagcacaattatctgatatgtgcaccatctcatttaatttgcacaactctgtggcttggagctattttattatttacccgtattttattatttaaggaaaaagagctttggaaaggaacacctgacccagattatgaagctggtgaatgattctggaaggattttaacacagggattcccagtcttctgaggacgggacagttggtgaggccttgaggacattgaagtctgagattgagattcttaacatatatggctgttaagttcctaattactgtggagaactgaagcacacgcttccttatttccccaaagccttcagggagaagagctaaaatcttcttactggaaatgacaaagtaagattttaggagtaaattgaattcagcataatattcataatatttgcaagttaatttcagggctgtcatggataggtggagatttcagttatttcaagttgattttctttggctcaggcattaggtgtgcaccatccagttaaggattttgctacttgagtattagtttcaggattagctgttcctccaaaccccaggccttttggatagcctgaaaaaacacagatggctaaaagggaacctgaggttatgatgctttaaataaacaaaaaaacttaagacaattgcattccagagttgccttttgcctccaaattctcacaagtttgtaagggagcagtcttttgcaccagacagtttctgggaaactcatcgaatacatgggtgggaggatgagtcgaagtggtctgcccagtgccccctgaagagccctcccctctgctgctatggagctgttcttcaccaggtctgtgcccctcgctcacttcccttagagtgaattactgtccagaatctccttggtctaccatgaggataaactcaatgggcccactcgactaagttactccgaatccccaggatgtagccagcaggacctgggtttggtttgagctagcaccttcctgtgcacactcagaaatttacagactcaccaagagaccccagtatgttattatcactctcttcttaaacgtcgtcataccctatcatggtacctacattcttcctcctttgctgctgagaccttcagtggggtgcatcataatatatcattctgtgctcatagtaggagctattgaagagaagcagagctaataaaaatagacttgagtattttctccattgaccatttaacagcattcaacattcttgggtgttttgaagtggctgagctgtgatccgaattcctttttggaaggaacaattggagctcggcagcgttatgaagctggtcacatttggacattttgttgtgatttgtccaggtgtccctctttgattttgcttgtgcggcctctcctgttgtctctcctgtgtcctcagtgaccagtgttgtcctgtggtttcccattgggaaggctgccactgagccatctaggcagtcctgtcctcttgggcagggtcctgcctcctccagccctttccttcccctttgaaacgctctcatttgctcctgcaggaaacccctgttctgtcgttgccttgcattcaggttttgatactcccatttcggctggtagaacagtaaactaacaccttgtcaatgtattgagtgttttcccaaatgctcctgcggcacgtaaacacttgttttgttgcagatgttgctgagtcatttcaggaagtgggaagcatttcggtaggggagagaatttaaagtcagaaattcacgtccctggggtggcagcttgttcacctgcatagggcctgggcagctggtaaatatatcctgtggcttccaagtaaggtgtgactaattgctctgaaagtgcctcatctggctgaatggagcaggcttttgcaataagttcaattcgattaaattatttccatgctacagggaacaaagaactggttggaacatggcttccggttccttgagagacttctcagcaatctacagatgctctaaagcacttagtcgccctggggctagattttctctagatttttccctcagatgggatatagcaatgaacttaagtgacagttctgcaggcttgacaacgttgtctaagaccaaatatatgttggaaattcctacatctaaaaccccacattttcatatcatttctcctgagtattacactggcaagaaaagacaaaaatagtttctttaattgagggagtcagtgtgtttcaaggagattccctgacagggacattaattgtcaaaccttgcaaaaatgttctgtaaatcatcagtgacgctgaatcctcaataagttgtctgaaagcacagcacagtgggtaggatttgaataaagaatgaaaggaagcctgatgggaggtgatttgccgtaaggagaattgcagtggaggcagcccataagaggaaggagaaagaatattttggcacaaacgctggcaatatttgggttggctgcactgaagaaatgtctgatgatattatcttcatttgtttacttgcctgctttccgcatcagatggtgaatttcagaagggcaaatctctagtttttcgatgcatccaggatctaactttgtgcctgacatgtagcagggacctggtgtttattaatatatggggtcctggaagaaaccaaggaagacaatagtgtaataagcacacctgagtgggtcatggcatggctgtttctgggcaaaaccccagagctccacgccctgggcattctctgcaaacaggtgctatggctgtgaacttgtctggctgtgcatcagccttcctggctgctcctaagtgttagaaaagaatgtatttggcaactcatgttcattgttacctaattacctaatttgagtttttattttaatgatcttataaatagtgatgttaccatttcagcatgtcaataattgttaatgcaacataggcagtgggttatgagaggtgaggcgaactgatttcaatagtctgtgtctttcaggtccttaatcacttgcataaaaagttgaagaacatgtcaaagaagtctgaagcatccaagaaaaaggtaatgatcacaaatatatatatatatgttacttttcagagcttagtttacctttgttttttttacttgtcctcacgtccatccaaagcctgtaacatttaggacccttggtgtggctaaggaggtttgagatgagcctcccaccgttaggatgggaatggagggtcggccttggcaagggcaccgtgggtcactccgtgctgcattcaaacttagctgaagatctggggagatgaggaaatgcggattctgctgattgtgcgcctcaccaggaggtgagtgcacttaggttgactgagacagaggagtgcagagtgcagagttgctgacatgcatacttagagggaaagtatagtcattttgttttatgttttcaatctctgatgtgattccgaaaagccctggtttggttcttgtttaagacaacgttgttataatccctccctaaagccaccagagtgctgggccattcttgcctctttcacccacatgtgctgactctgacccggcaggtaaagactgaagagtggacaaggctgaaagcagattcctcccgttgctaactgactttctcatcccccagccccgatttaaacaagcttctcctgagtggtattacagcatctaacttattgatggtcatgatattctacattttgggggaaaactatttcacaaatcaaggttaaatgaactcttactcagaaaatatctatatagcttctaattttaggaagtagaatgagattattaggcaatatgactaaggagtaggaggttataaccagatattttaacccaaaagtgtaataataacatcttaaaataccttgttttttccttatatttattatgatcaatgacatacctaatttatagaaattatagtttagatcatgtttaatcatgtttacttaaaaattctacttgaataaaggacagctcttcctgactttccttctttatgaacagtaatgtggctaaaaagccatctgatagtccagagtcaaaaccagtggtagagaattggttatagagcacaaacattaagacttttttttttccctggcagcaaaaaattagcttatgttagaaatgcaatcatacagtgtttaggataaccacctaagaatacaaggtgcagtataaataacaagaccatgctatggctttattccattgatcctttcttacatctgaacaattattatgaatatttcattttaggcatctaggccccgcattagagcagctgaccaagtgctaagttatatgaatggaataaaccctgtaagttggtgctttcctcctctctttttagtgatgtgctgttatggtagagattttccatttttctggtatatctattgatttttcctctgagtcacacttcttatttctaagacaatggttctttaaagacaattaaggatagtttctgacttctcctaggacagttatttttagagcacctgctctgtgtagaaccaagccgatccaggggattctaagaggaactggctccgcatggaagccaacattgtaatggaagagatcaatgtgtgagtcccagaggcctgttcaagggggcagtgtttggagcatcagggaagggagagattaatttcccttgggagggattgggctcgtcaaactttaactgagaagacaccattgatctgtgataaatgtgtgttaatgattcaaaagattttatgcttaccaaaagaaataaaaccaaacatttatttaacatttgctgaatcttacttgtgtcgatggtagttttagtctccatatttgaaaaagtattggagagaaattgtgaaggtctcagagaagaacaaaatactgaaaaaataggtcttataaaaatgattagaaaagcttctattttattttacaataaaaaacctaaagatcagtgattagttcagtcattagttatatacacatacacatatatacacaaatatttagatttatgtgagtatatgtatatataatacatatgtgcttacatatatacatatactaaatatatctatataaaattatcttttgcttattcttaccatgaggatctagcatttgaagaagggatgaagattttctttttcgttttcacagcctctgacccttaacagctactgaacagatgtcagatctttgttgatgtatttaattgcctccttgtttgcacagaataaataaatgtggtggtggtggtggtgatgatggtggtggtattggtggtggtgatggtggtgggtggtagtggtggtgatgatggtgatcattgtggtgatggtggcgattgtggtggtgatggtggtggtcatagtgggggtggtggtggtcatggtggtgatggtggtggtcatggtggtgatggtggtggtggtgatggtggtgatggtggtggtggtcatagtggtggtggtggtggtcatggtggtgatggtgatggtggtggtggtcatgtgatggtggtgctggtgatggtggtgatggtgatgatggttatggtggtgatgatggcattgtgatagtgatgtgtggtggtggtggtgatggtggtggtggtcatagtggtggtggtgctggtgatggtggtgatggtggtggtgatggtggtggtgatggtggtgatgatggtggtcatagtggtgatggtggtgggcggtagtggtggtgatgatggtcatggtggtgatgatggtggtcatggtggtcatggtggcgattgtggtgatggtggtggatggtggtggtggtcacagtggtggtggtgttggttttggtggtggtcatgatggtcatggtggtgatgatggtggtcatggtggtcatggtggcgattgtgctgatggtggtggatggtggtgctcacagtggtgctggtgttggtggtggtcatggtggtcatggtggtgatgatggtggtgatgatggtggtgatgatggtggtgatgatggtggtcatggtggcgattgtggtgatggtggtggatggtggtggtggtcacagtggtggtggtgttggtgttggtggtggtcatggtggtcatggtggtgatgatggtggtgatgatggtggtcatggtggcgattgtggtgatggtggtggatggtggtggtggtcacagtggtggtggtgttggtgttggtggtggtcatggtggttatggtggtgatgatggtcatggtggtgatgatggtgatcatggtggtgatggtggtgatggtggcgattgtgatggtgatggtggtggtggtgatggtggtgggtagtgatggtggtggtggtcataggggtggtggtgatggtggtgatgatggtggtcatggcagtgatggtgatggtggcgattgtgatggtgatggtggtggtggcgatggtgccagtggtggtggtgacagtggtggcagtggtggtggtggcaatagtgatgatgatggtggcaattgtggtgatggtggtgatggtaatggtggtggtggtatgtgtgtgtctaagaaagagatgggagagaggagcagagaaagggtaagaagagggtgtggaagcagaggcgtgatgagaagggaggtggcggagagagggggacagaggcaggagaggtgagacaggggagactcgggaaggaaagcaagaatacatggcaacttccctgaagacaggaactgggttggtccatcgtgggtatttccccaggtctcagcacagaaaattgctactggtgcacacgtgttcatcatttgattggtaatggaagatgtgacagggatttggctacttgtttccagccctttctctcaatgtataagtaaagttccctttctcagctctgtatccactggtcttagtacgttcaggctgctttaagaaaataccatagtctgggtggctcataaacaatggaagtttatttcttgcagtcctgaagcttggaagcctgaaatcaagctcctgcagattcagtgtttggtgagggccgttttctggttcatagatggccccttctctctgtatcctcacagagtggaaggtgaaaggcagctctctgcgccctctttcataaggggactggtcccattattcatagggtgggaggtgtaaggcagctctctgggcctctttcaaaagggcactagtctctgtgtcctcatagggtgggaggtgtgaggcagctctctaggcccccattcataagggcacggatcccattatgagggctccccccacctcatgacctaattaccatccaaaagccccacctgttaataccatcaccttggtgattaggttccaatttatgaattttttggacggggtggggacataaactttgagatggtgccgccgtccatacggggctttcctgttgagagttataattattatggggtggggagattggtctttcatgataaacatgctaacagttattctccatgtttggagcaagtgcaaaagaagaataggatttctactgcaggaataaagggctaggattgatcacatgcttttcttaaactctgctagacataaagaaatgtttctggctcaaagctgattgttaaaaccttggaagacctcaaaatgggatagacacccatactggatggttgcttcctggagaaaattggattaaaggacctcttgatgtcctatcaagccactgggttcttttaatgtttgctttttttgttgtttctttggcttaaagtaattcagtaaggtttttggatgtcatttatacaatttgtgaggtttttttttttttatcattctcaccttttattcagttcttttctccccagccaaattccattagacatattgtgagtaaaattctttgaagaaagaacagacatctcagatgatttgaaaaagagcatctcacaataagaagagagactaatattttttcagatactttcagcagaaggagcacaaagaaaccatgctattaaaagacctaaactcaagtgtaagaagaatttgtataaagatttagcacataattttaaacaataattttttctccatcaaaagataatgttgagattctatacgctaaatagacaaaggagggaagcagtgcacacacaggggacatgcccgtctgacggagacggaggaccctgtaagagagtagaaagaatcacgtcataaataaattttaaaaatcagcctcgtcctccacagaggggagttctctatgttactttctctgcgctgtatccactggtcttagtctgttcaggctgctataagaaaatacaacagcctggatggcccataaacaacggaaatgtatttcttgcagtcctggagtttggaagtctaaaatcacgctcctgcagattcagtgttttgttactttctgatgttactttctgatgtttccatgggaaagacaggaaggaagtggcttttccagccctttctaaggaaaggagatgcttcagccttaggggttgataccaagcattttttattgcctttaaattgaggtggggaagacaactttccttttgttgtgacttttatgtaattcatcagtggttctccaaacagtttcttgagctccttttaaatttatttttagggatggggtcttgctttgttgcccaggctggggtgcagtggtgtgatcatagctcactgcagcctcaactttgtgggctcaagagatcctcccacctcagcctcctgcatagctgggactacacgtgcacactgctgcacccggctaagttatttgaaaacattttttaaaggtggggactcaggatgttgtccaagctggcctagaatgcctgacctcaagcgatcctcctgcctcagcctcccaaagtggtgggattacaggcatgagccactgttatctggctgagctttttaaaaaggcagattcctgggtaactagtaaactctaccaattgctttaaagccataagagatgaggtatagctatccgaattaaaaaaaaaaaaaaaagctttgcactggttgaggatgggcatactaacctacttaaatcccagggttgaaattagtacacgtgcattattttgccagatctttaactttgagcgtgtctatgctaggcatatatcgtttcccgagtttgacagtgtggagcagtagtaaatcaaaaaagatggttttccactggcatggaacttcttgccccgtgtcccatcttctaccagcatccgttgcaagggaagaatgaagacaaaaatcatctactgttttcaaccatgcacatgggtgtatttgccacattgtcattgctacgactgaattggactcacctcaaagatagcaggaccaggtgcccagggcctgtttgcatggagttggcttttaccaaccaggaggccttcaacttcaatggcctgagatgcttgataaacaagaaaatagtaatcccctggagatatttagctgggaggatagtcagtgttgacaggccttctattaaactcttttgggaacaatctgagacagatgatatagtttatgcaaatacccattaagccttctttcctgatatttatgttgcaaactgtaattccatctcatttcaaagctgctggtaaaccaagaaaaagaacctgattcttatccatggctctaagagcaatgggactagtaaaaattaaaaggtaaacttggaatgagtcacagacacacaaagttaacaaacactgccagagaaaacactccggcctcagggcacactaccatttgccctgtggatgttgataaggcatagatcttatcagtaagctgctgggatagatttctgctttgtacttagtaaaattgtctaaaagaaacaatgaaatgcaatacccggagggtaaccattctgtgacatagagagatggtctgattgtcttagaaagaaatgatgatgttttatattctatttgtaggtataattatatctagattgttttgattaaatcatctgagaatggcatttctcatccactaatggataaatggattgatagaaggcactcccttaatatatgtgagcacattatctgcttgctttgtgtgtcatgcaataagtggctttaatatgtaagcttgtaccctgtaaaacccgtacttagatttttatacctgagttgtttgtcgtgtttaaatagatgaggcatggtctaggaatcatttcattggttcatcttattcttagctgaggaagttgaggctcagggagtttatgacattttgcaaaggtcatacaaccagcttatggcatggccaggtgggaacacagacctgctgtcagtcctggggtcttgtgcaatccctggtgcctctcgatagggagcttaactctcatctcctgtccacctcgctagtaggatttgtcctggccttgatctgagatctagccctccctctactctctctgcctggatcctgggcacagcttcctggcttccagtctccctctttgataaacatcatttcacgtcttactttgctacctcatgtcaatccttgaagagctggcatctcatgcgttatagtctggttgtcatttctattgcagtgggactccagttcatgggaagtgataagaagagtctttttggccaggcacagtggctcatgcctgtaatcccagcactttgggaggctgaggcggacagatcatgaggtcaggagtttgagactagcctgaccaatatggtgaaaacccgtctatactaaaaatacaaaaattagccagcgtggtggcgcacacctgtaatcccagctactcaggtaggtgaggcagaagaatcgcttgaacgtgggagatggaggttgcagtgagccgagattgtgccactgcactccagcctgggtgacagagcgagactccatctcaaaaaaaaaaaaaaaaaaaaaaaaaaagaatccttttgctatgtaggatttcccctcctagcagtgtggagctgtggttcccactgccctgtgatagtcctgcagggtgtgaggtccatgcaggatcactgtaggaagtcctatgtcccaagggaaaatctgtggtgggacagtgctgtctcagtcatggagtcactttcccatgtcttagtcttccctccatgtgaagttataagaaaaataaggctctgtttattttcattctttttctctttctcttcgttccccccaacttttcttctcccacttatccattttagagtatttctgtttagaaaacagactggtggccacaggtaaacccttcatcacatctgtatgctgtgatgggaaggccaggggagggggtctgctttcctgctccatgaaacccagtgaggtctgggaagagagtgggtatattagtctgttcttgcactgctaataaagacatacccaagactgggtaatttataaagaaaagatgtttaattgactcacacttccacagggctggggaggcctcaggaaacttacaattatggtggaagggaaagcaaacacgtccttcatatggcagcaggaaggagaagaatgagagtaaagggtgggaaaagcccctataaaaccatcagatctcatgagaactcattcgctatcatgagaatagcatgaaggtaactgccctcatgattcagttacctccttttgggttcctgccaccacacatggggattataggaactacaattcaagataagatttgggtgggaacacagagccaaaccatgtcttactgctcctggcccctcccaaatctcatgtcctcacatttcaaaacacaatcatgcccttccagcattcccccaaaatcttaactcattccagcattaactcaacagtctgagttcaaagtctcatctgagacaaggcaagtcccttttgcctataagcctttacaatcaaaagcacgtacctattatacttcctagatacaatgggagtacaggcattggggaaatacaaccattccaaataggagaaattagccaaaacaaagaggctacaggccccatgcaaatctgaaatccagtggagcagccaaatcttaaagctccaaaatgatctccttggactccatgtttcacgtccaggtcacactgatgcaagaggtgggctcccatggccttgggtagctcctcccctgtggctttgcagggcatagcccccttccgggctgccttcatggctgatgttgagtgtctatggcttttccaggtgcagggtgcaagctttggatggatctaccattctggggtctggaggatggtggccctcttctcacagatccactaggtaatgccccagtggggagtctgtgtgggagctctgaccccacatttccattctgtactgccccagcagaggttctccataaggactctgcccctgcagtagacttctgcctgggcatccaagcatttccatacatcctctgaaatctagatggaggttccccaacctcaattcttgacttccgtgcacctgcaggcccaacctcatgggtaagctgccaaggcttggggcttacacctgctaaagcgatggcttgagctatatgttggcccctattagccacagctgggacacaggacaccaaaccccaagactacacaaagaagcaaggccctgggcttggacatgaaaccacttttcctcctaggcctctgggtgtgtgatgggaaaggctgccatgaagacctctgatgtgccctggaaacattttccctattgtcttggtgattaacatttggcttctcattatttatgcaaatttctgcagcctgcttgaatttctcctccaaaaatgcgtttttttcttttctattgcatgatcaggttgcaaattttccaaacgtttatatgctttgcttcccttataaacgtaagttccaattccaaaccatctctctcaagttcaaagttccacagatctctagggcaagggcaaaatgccaccagtctctttgctaaagcatagcaagagtgacctttactccagttcccaagaagtttctgatctccatctgagactaccttagcctggacttcattgtccatatcactatcaccattttggtcaaagacattcaacagtttctaggaagttccaaaatttcccacatcttcctgtcttctcagcacccccaaggctctaggaagtttcaaactttccaacattttcctgtcttcttctgagccatccaaactgttccagcctctgcctattacccagttccaaagttgcttcgacatttttgagtatctttacagcagtgccccactctctgcagtaccaatttaccgtattagtccattctcacactgctaagagacatactcaagactgggtaatttataaaggaaagaagtttaactgactcacagttacacagggatggggaggcctcaggacacttacaatcatagcagaaagggaagcaaacatgtccttcttcacatggcagcaggaaggagaagaatgagagtgaagggtcgggggaaaccccttataaaaccatcagatctcctgagaactcactgtcacgagaacagcatgaaggtaactgcccccatgattcaattacctctcactgggtccctcccattatgtgtggagattatgggaatgacaattcaagatgagagctgggtggggtcacagccaaaccatatcagtgggattgctgccagctcacgctctgatgcttcccctcccaatgtccaagcatgctctaaaatattacagcctggactatgtctgagagaaagaagttacttgagtcctaacctttggccaagaggctgaaaggtgcacctctttgcgcttaatgttccttttttcctatgagaagtaaacttgctggtgaagtgaacagaaagctgaagccatcgaacagaggaggctggggaagcactctgtcccttcacgccagggaactgagatggaggttttcttatggcagcctttattgcccacacagctagcataatgcttcttgagaagcagccctgttgggtgcagagagggaagtgtggcttttgatgaccagaattttccctgcagctcagctgcccagtgcatgggctggggagcatgtcggcctggctgccagccccacctttgcattcagctgtgggacactgggcatttgctcttcccctcctgagtctcagtttcctcatctacaacctgtgggtcatgacagcatctgcttcatagagtcgtaaaggacattcggtgaaataatgcatgtggtcccatcatcggtccactagtttcgatggctctgttgtgaccatcgcggcactagaggttgtgtgtgggttttgagctgcacttgttagagaaccatctgtttgaggagagaaccaactgattggtttgtattttatagtttaaaaaatactagactcccgtaattaaagcattttaataaattggatcattgccttttctttgaatccaaagacagagttttcaattaatcacaaactaagctatctagctcttgtctttcaacatgtgtggaacagacgaggttgccctgaggcttaattccagtcccataggtttgtggccagtggaggaggccatggccatgtatacaggcacatgcttgttgagcataggaggttgatgtcctctcctgttgaggtccctaaccagcgatgacttcctcctaccatttgctcagtagaaatcacaaaagaaacacgaagaccctgcctctgatttctaagtatttctgatttaggagcagcaaagaaagagttaaaatgaaagaaagcaaaagggactaattcggtccatagactgaaactgaaatgaaacacatcgctgcatcaagtaatttggccttgaatttgccaaagtttaacgaggagaaataaacacttacacacctgctcatagaagtgactatttggagcaaagtccagcgctcctccgagatgcattgctggtgatacagctgcggtgggtgagatgcttgaacagttttgctagtttaaaagttacagtctctaactttgtacttttctagttccatgacttgaagcatacttcctataatgcatttcacatatatcacaaaattattactatggaaggtaatgacaggtcttggaaaagttatgaacaaaattattatggggagtgaaggttaacacttaaagcagatgtagtatccatttttgatctcatgaaaatatacataaaattagcttaggatgtattttaaaatgctggattccttttgtgttgtaatcaatgaatttccttccttcttcttctcccttaccgcctcctcctcctcctcctcctcctcctcctcttcttcttttctagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaaataaaagtcgaatagacaccccaccatcaaccaattgtactcatgtgtgataaaagatagagtatccttatggttgagtttccatataagtggaccagacacagaaacaaacagaatgagctagtaagcgatgctgcaacttgttatcttaacaagaattcaagtcgttttaattaaatcccacgtgtgttaaaaagtactttgatccatttaggaaattcctaggtctagtgagaattatttttcaattttattttagttctaaattatgtttcagaaacaaaagacaatgctgtacagttttattcctcttcagacatgaaagggaacatatatattccatatatatgttcaactcttcatagattgtgaactggcccatcaatatggtcaggaatatttgcagtctacattttaaagccaatttatttagaaaaaaaatttgagctttaattctttaattttaagagaagtaatattgtgaactatgtattttaaaatatgatcatggacacacaatgatgaattttttggccatttacatagacatatctattaagtggaaagaaggctttctgaagtctgtttgcacaggtggcatttgcttccaattgtagctagcgcacagagctttggaagcctgtcattatgagatacagtcggtttacctcaggagtcaattcagtgttgtactggtgacctgggatgcagtagtaggcactgttgattcaaatttatcctgtgaaactggctttatagagttaacaaaacagagtcagagaccactgtcttaacagtggaagatgcaaataagtttttgagaataaaactggattttgaaattttacattagtacttgacaaaagttttcattttgccttgaatggaacctactaaaaagagagatgaaaaaaaatcagcgaggttgatgtagataataatttctatgggaccaaagactagacagaattcagtaagtcacatgaagtaatggtcatgcctgtacataaagcatatttcatgtttgatttagatgacattcaaaaaaaatcatgggactgaatatacctggggtatcctatcttgtacaaatgcatgctttttcattaaatttgtaatgatgtttaatgaacatttccaccaaacattatttcctctaaaaatgttaatttggggttaaaaccatcaccatttgaatttcaaatgtagttttcatgacaattttatattgatgtgtgtttacaatgagaaaatggcatgaaaatattaaattgtcttgtatcggaaaagtacttttcagactgtaagactttgatatgttttaggaggcaacaaaagcaagaagttttttttttgtttgtttgttaaaaaggatttggccaagcacagtggctcatgcctgtaattccagcactttgggaggtccagctgtgtggaatgtacttgagctcaggagtttgagaccagtgtgggcaacatggcaaaactcggtctctactaaaaatacaaaaattagctgggtgtggtggcgcacgcctgtagtttcagctactctggaggctgatgtgggggatcacctgagcccgggaggtccaggatgcagtcagtcaagactgcaccactgcacttcagcctggatgacagagtaagactctgtctaaaatatatatatatatgtgtgtgtgtgtgtgtgtgtgtgtgtgtgtgtgtaatgtacctctgtgccaaatcagcactccacatgaaacatcaaattttagataaaaatgcaaacttgacataagcctttggcatgctaatttttttagctcattcacttactttcactaatcatatttcagtgactagtgtttacatttgcaatgttattaataactctctggataaaaggaaagaaaaacgttagaaagattttgaagtgatgtattatgtttgttgactagaagaagaaattgtgtttatgtgtaagtgagggtcttaaagaatatgtcctttgcatcgaatgttttttgcactttattcaaatatataggagcagaaaaattttatcctgacgatgatacttcctgtgatttgtggaacttgaagttgctgttgcaaactccagaacaacttctttgggtgtgaactcacaaaactgtgtaaagaagtgccttcttgttgtgtttgagtttgcatgaatggaaatgatttcttgcaccatggctatttctttgttttctccttctgatctgtaagcatataaatggaagtatttaaaaaaatactgtagctaatgttgctattttctagaggcatgccgaaaatgtgctgtgcctttggtccttcccagatgctactggcacgtctgaagcttgaggcatggtacaaaaagtaatagcttgcgcttgaaacccccccccccccgccactttgctaaatgtaaatgctaattgttgcattttacagttagataggatatacttcctgcatattgtcattctaatcaattcctcttactcagagttttggctgagtctacttctaaaacaaattttgatagggataatgacatcttctgcaaagatctaaacctctacaaaattttctgaataaagagtttcagaagaactcgtaaacagaatgaaattaaccagagaagtataggagtgtgttgcgtttgccaagcatctgcttcccagctagatttccccctaatatacaatgaccaattctgaagcaccttcttttccgtcactaaataaagacagcttcccaaggacacactttttctcccagcatcaggttgagggagaaatattgcttatacctttgaagtcaggctgcttgaaactcacattttcagtttacttcaaagaaaactgatgctttctaagcagatttggctgtctcagtgcccaaggcagctgttattttcctaggctttttgctttcacgtaaggagacaggctttgggatatttagtagctgaaatgcttgctgtttcacatgcataagcaaccatttcagtgtcctgctgatgaatacagtgatgtggatggaaacgttttcttgtcctatatcctggggataggaaacagattctctgtgctcttctgaccgggtatgtactcagcaacatgggggactgaggccattttctgaatactttaggtaaattacttttgcttttaactaaattgttttattttacacattgggagtaaaaccatttccgccccatcccaatctcttgtgcttttatcttttttatcctaactcacttctatccagatttcctctcgataatatttaccacagataaattcatctttcagcgcagatataacaaatcagagtggggaggagagatgcttaaggaactgcatgagtcatgcaaggctcagaacttcttgtggctcaactcgaaatcatattgcattcctgcattctcccagatgctttgaggcagtgcagcgatcattctaatatgttaactgagacccaagatctcagcaggagaggacagcttatccaagcatccctttccttttcagtcatggccatggctatctgtaaacaccaaaatgctcatgctgaagcagcattacattgaggaaaataacctattgggcagcttcatcatgttcttgctttaaatgatttatcaaatacatgtatgtaaactacatagtcactaactgcgaaaatacatcaatgtggctacttcctctggaaagttactgtctaaaatttgtaaattttaatcttcactgttgcacatattttccatgtcttaaatttgtaagtgggtttctatgaaaggtaatcgtattcttcttgaccattaaaaatgttgcatgtaaggctatttctcaagtagatgttaatgacttgtttaattattgacttacttattttaaaagctgtatgtagtaagaacaagtaggtggtttaaaattcagatagttacatgttggcctggaaagaacaaaattatgaaatggtaattatatctgattttatttaaccatattttaatattttctcttttagaagtggaaaagttgagcctgaggaagaatttaaaatgcttaagacatctttgatgggggctgtatttgcattaggcagaggtgtctaaggagagtgtatcgtgtattgtgatgcattagcaggatgttttgttcatcgacttgtgaaagtgctgtggataatagatggtggtttcttttcttagtgtggcaggttcactcacattcatgtttttgactttagctgccatcctggggttctgagggtagcatgtctgtttgactgggcaagaccctcacataccttggcaggccctggctttcgtttctctgtggtgcctggtgctactcacagggctgactcacgggcagatgctccccatccttccccataggccctgttcccgcatccgatgattctcaggttttgttctaggtgcagaaatagtgggagaggccataatcgtgaatgatgaataagaagggaaggtggggccgggcatgtgacttatgcctgtaatcccagcactttgggaggccgaggcaggtggatcacctgaggtcgggagttcgagaccagcctgaccaacatggagaaaacccgtctctactaaaaatacaaaaattagctgggggcacacatgtgtgatcccagctactcaggaggttgaggcaggagaattgcttgaacccgggaggtggaggttgcaatgagcctagattgcaccattgcactccagcctgggcaacaagagtgaaactctgtctcaaaaaaataaaaattaaaaaaaaaaaagaaggtggccagtgagggttttatctttgtattcactggaaataacctcagctgaattttctctctgaatcttttcaatgttggctccatttgccatactcagacaattgcttgaagagctgaactgttagctcaagatttcgttggcactgttggatagaaagcctctccttttctgctggagaagagatttctcaggccaagttgtgtagctccaaattctccgcaattagagaaggcacagtaaagaaaagatcccttgctgatggaatggactggaactgagctccactgtttaaatttttgactctcaggtagtggtgatcgttatggtaacccatgaactcggatgaatttcggggcctgctgtgggttttctatgggacaccatataccacagtactgtatttcaaaatattggatattgattatgaacactggaactatttatgtgtcatcattccaaagaccattgtgatctatgaagctcctttatttgctggctagattgtccaaaaacaagctcacttgtttttgggcaatctagccaaggtgtcacataatggagaaaaatgcagatggtcctgtggctggtgtgaatgaagaatgacctgggcccaacatagaacttttccagtatggtgagcatcaaagtaggcagacatccaaaagccaagtgaagggcagatagatccccaggtgccacccaggctctgcaggcaaagctctcagggccccatttgtgtttgtgtggcctgcactgtgtaagtgtcgttcccctaggacttctgcaatgggataccaaagatgacgtgtaaggccttcagtatataatggacttgtgccaagtacctaagggttcactgccttgtttgaggaatcgcagagcatcatttctgattggttcttagagcctgcatcttgtaccactgggacttctggagacctctggggaccgttgactatgctgggagggtgcagaaatgaagctgatggcagaagcaggctcccagctcctcttcttctgctcagccaggtgattcttacctccattggcctttggatgtctgcgtaataatttgttgagaatcattagagaacaactaatccaaaaaatctatcatcctttatttgtgttgactttctgattatgccttcattcactctttttattacttatacacatgtctgtttttattcttccctactcttttcttaaagttggtcatatttctacacttgagatcttccagtttctgtgaatgttgaggggttcacaaagtggcttggcctcagacctctatatccttgttgttctgtttggacttaggacttttttcctggctatcctgccaatacttttccatctaacagaaacgcaagcttcaagagcaagttatttttataacagatcatgtgagcaattcctccatagcattggttgtagaacaggtcagttggcatgtggcctcctgagggccttgcatggggttctggacccagcgggggccacatctctgagaattcgttccctgtgggtgtctggggtgcatcgttacttctgagatgttatgactcagcagatgagatttgtccgtctgctcagtgagaggaattccaatgctgggtcttgactcccgctgcagggagctctctgggcccgggcatgttggatggagttgtgatgggtgtgcctccctcggacttactctggccaggaactgcatctgctcctctaaggagatttgagcaggtgaatggagtttctgtcattcctggtctagagttcatgtgtgaaggtcaaatataggtggggacttggcagcacacaactctgagtgaaagacacgatcagcgtgatagacaggtgtcttgctatgtgacttgccattgcggtcactggttatacaaagtctctgtttagaaatagcaaagatccaagaaagcagaagagtgggggtgggagtggggctaaatgtgttgctcttcagtggaaatctgcccattttgttgaaaagaaaggaaacagggtacacaaatgctgtttgggaacattgtgtcaggatcacctagctttgacgatgagagtgttttttaaaacggaaaccatgtcattttccttctagagagaatttcctggtatgtcaatgtagcttcagaaataggtctcagtgttctggctcagggcgaggttacaaaagaggcttcggtagcgtcctcaggcccgcgtgccctgtgttcttaacagcctcatggggcctagaggaacttttacatggtagacactgagtgaatacacagattcctagatttgagatattttcaaaatagggctagcatgtataaagaatcaaacttagtcattccattgaagtgaaattggattataatttagaaatatttataagccagaaatggttgtgtaaatgttagttttcatattttggttttctaagagtcacattttattgccatatagcacaaaatttgacaatgaggtatagaaatccaaaattttcttgggtacaattgaacaaatcttttaatctcttcagttctatctgcctaagtgaggagagtagttgtggagcattgtagaaaggataaaatgaacattaggatactgagggtttggtctgaattctgttttttcattgctactggaagtgctgtctttggtatcctcatgcatacaagaaggatttggaaaatgtcagtgagtttgaaactggctgtacagttgaatgagctgggcagttgaaagtacccgtgatgctctggccttaccttagatcagagattcttatattttatcaagcatcagaatcacctgcagagcttgttgaatgcagattgttggccacatctccagaatttctcattcagtagatttgggatggagcccaacgatttgcagctggtccagagaccaccttgtgagatctactacctgatttaattggtttgaaggtgaaggtggagtccaggctttttaaaacagtgtctgtattttcagagcagataaccaatcaaattgagcagatggtcttttaaagtctaagcttctatggttctgtgaaaaaaattgtttacatggaatttaaatcattcagaatttttattgcttacattgatcagatccataaaatatctgtttaactattacattaccctagctacagaaatttgtaagttttcaaaagcatgaaggagtttaataacttgtaagactttcagagattgttataatttttgcctcaaaaaaataaaataaaatagcttggtggaaaagagcacctatgcattcaatttgtttccctcaaatgctaagggttaaaatagtactcaaaattgttagatgtgaagttttgaacccagtgtttaaactcagtgtttaaatatttgcatgtctttctatgtgactgctaatttttaactacattattatctctaagagataaataaactttccctgtacttaaagtttttaaattaagtatcttctgataacataagtagtatgagtaaggaaaaaaaatctatgtgtactgtatttttaaattttaataaggtttgatatggtttggctctgtgtctccacccaaatctcaccttgaattgtaataatcctcacgtgtcaaggaccagcaggtggagataattgaattatggggccggtttctctcatactgttcttgcgatagtgagttctcaggagatctgatggttttataagcatctagcatttcccctgctggtacattctctcttcgcctgctgccatccatgtaagatgtgacttgctcctccttgctctctgccatgattgtgaggcttccccaccacttggaaatgtaagtcaattaaaccactttctttagtaaattgcccagtctcgggtatgtctttatcagcaatgtgaaaacggactaatacaacgtgattgtttaaatgctgatatgaaagcagtgctgaatgtggatcttcttatgccagatactgttataattattctctagagagctggccatacaatttatctcattatttatagatctagcatgaatgccagtaagctgacaaagccaaaagccaaaaactaagagtttgtattaatccagttaatgccaaatctagtcatcctccatcatcctacctctgtgttctgcatgaaatataattggcctttgtgatggaaccagttttcttgcattgaaaataaaatttgttcctcaaaatgctctagtttaagagtgtgctttttttcccaaacaaaatggaaataattttctgttcccattaagttcttgaagacactgtattctttagttactgcatatttgagaatattaatttgttgcctttatacctgaaaaacaatgtgagatgaaattattttattgcagtatgtttttattaagatatctctagacccagcttagaattttgaatgttactagaaaaaagtcagaaggcaaactgatgcccccattttaggtaactagcttttttccacttggatgagctgagatttttagagttactgatgcctgataccttcaccagaatgtgttttcatcactctctaatacctgaatattcttcataaatagaattatatttccataaacatgaaagggacatttagactggtaaagtgaccatttagtctggcaattccaaatcttttttcatgtaaggattcttttacaaatataaaattattcccagactttcatatgacaataatgtacttttagtatatgtcaataaatacaagatgaaaaataaaatgaaaaataaaactacagacctctatctctcgtggatataaacacaaaatcttcaacaaaatgttgataaatcatatccagaaaggtttaaaaagaattatataccattaccgagaagggtttattccaggaatgcaaggctggatcaacagtgaaaaatcaatctatgtaatctgccatattagcagcctactaaaggaaaattggactatcataattgacacagaagaagcatttgacaaaatccagcaccattcatgattaaaaaaattctcagtaacctaggaatagaggaaaatatcctcaatttaataaatagcatctacaataaaactctagagctaacatgttttaatagtgaaagacagactgcttttcccttagataaggaaaaaggcaaggacatctgttcttatttaacgtggtatggaagttgtagtcactgcaataaggcaagaaaaaaaggaaaaggcatatagagcagaaaagagggattaaattgtctctatttacagcggacatgattatctatatagaaaatccccctggccgggtgcggtggctcacgcctgtaatcccagcactctgggaggctgaagtggtcagatcatgaggtcaggagttcgagacctgcctgagcaacatggtgaaaccctgtctctactaaaaatagaaaaattagatgggtgtggtgatgggcgcctgtaatcccagctacttgggaggctgaggcaggagaattgcttgaacccaggaggtggaggtggcagtgagcctaaaataaaggacttggccacagaatattacatctggttcctgagattgttccagtctagtatctcctttctgtagtgatcaaaattttgaaagacactgtgataaaatcaatagatttcaagtgtaatgacttttaatattgtctgctttacagtgacttcctctagccacatctgtaatgctgcagagagttgcctaatttttctttccactttggcttgctgattattttatttagtaagaagaagctattttccttctgcatacttacacacatttgatatgattttcttttctttctttcttttgttttttctttttgagatggagtcttgctctgttgccaggctggagtgcagtggcgcgatctcagctcactgcaacctctgcctcccgggttcaagtgattcccctgcctcagcctcccaagtagctgggattacaggcatgcgccaccatgcctggctgattttttttgtattttagtagagatggggtttcaccatgttggccaagatgatcttaatctcctgatcttgtgatccgcccacctcggcctcccaaagtgctgggattacaggcgtgagccaccgcgcccggccttgatatgattttctctacatacaagggaaaatattctggttcattggtgttgtcatctgtggttaagataattttaaaaacaaatacaaaaatgactgcaattatggtgtaaataagatcagtgggtcatttatgttttttttaagtgaaaaatatttatttaaagaattcatagactcagcagttaagagaatattatatcttcagttgaagccattttaaaactgcatattccaatatcatcatctcaaggtgtaggtactatttaatgatagaataaaatattacttaatattgcagga

SEQ ID NO: 1463 - DNA, 2117 bp, Homo sapiens
cgtgctggcgcgcagcaagccgggcaagccgcggagcaccaccaacctgttcatcctcaacttgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaaataaaagtcgaatagacaccccaccatcaaccaattgtactcatgtgtgataaaagatagagtatccttatggttgagtttccatataagtggaccagacacagaaacaaacagaatgagctagtaagcgatgctgcaacttgttatcttaacaagaattcaagtcgttttaattaaatcccacgtgtgttaaaaagtactttgatccatttaggaaattcctaggtctagtgagaattatttttcaattttattttagttctaaattatgtttcagaaacaaaagacaatgctgtacagttttattcctcttcagacatgaaagggaacatatatattccatatatatgttcaactcttcatagattgtgaactggcccatcaatatggtcaggaatatttgcagtctacattttaaagccaatttatttagaaaaaaaatttgagctttaattctttaattttaagagaagtaatattgtgaactatgtattttaaaatatgatcatggacacacaatgatgaattttttggccatttacatagacatatctattaagtggaaagaaggctttctgaagtctgtttgcacaggtggcatttgcttccaattgtagctagcgcacagagctttggaagcctgtcattatgagatacagtcggtttacctcaggagtcaattcagtgttgtactggtgacctgggatgcagtagtaggcactgttgattcaaatttatcctgtgaaactggctttatagagttaacaaaacagagtcagagaccactgtcttaacagtggaagatgcaaataagtttttgagaataaaactggattttgaaattttacattagtacttgacaaaagttttcattttgccttgaatggaacctactaaaaagagagatgaaaaaaaatcagcgaggttgatgtagataataatttctatgggaccaaagactagacagaattcagtaagtcacatgaagtaatggtcatgcctgtacataaagcatatttcatgtttgatttagatgacattcaaaaaaaatcatgggactgaatatacctggggtatcctatcttgtacaaatgcatgctttttcattaaatttgtaatgatgtttaatgaacatttccaccaaacattatttcctctaaaaatgttaatttggggttaaaaccatcaccatttgaatttcaaatgtagttttcatgacaattttatattgatgtgtgtttacaatgagaaaatggcatgaaaatattaaattgtcttgtatcg

SEQ ID NO: 1464 - protein, 293 aa, Homo sapiens
VLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKENKSRIDTPPSTNCTHV

SEQ ID NO: 1465 - DNA, 33403 bp, Mus musculus
  misc_feature (1)...(33403): n = A,T,C or G
ttgttttttttttgtatctcgtttcttgagttctttatatattttggatattagtcctctactggatgtggagttagtaaaaatcttttcctgctctgtaggctgcgctttgtctgattgaaggtgtctttgcttttcagtttcatgaggccctgtttactaattattggttttagcacttgtgttaccagtgttctgtttaaaaagtcatctcttgtgcttattttattgatttaaaaaattttctagcctattgatatcagccttgagtttggttatttcttgccatctactcctttcaaatccagaaagtctttaatttctttcttgactcatttttcattcagtagttgttcagtgtccatgaatttgtaagctttctgctgtggttgatatccatctgttgtaggataggatgcaggattttatattaacttccttgcatctgttgagacttgctttatttctgaatatgtgatcagcacccatgaggttcagagaagaaggtatattcttctgtgtttgggtcaggtgttctgtaactgtatgttaggcccttttggtttctaatgtcagttggctccagcatttcttggtttaatttttgtctggatggcctgcccattgttgagcatgggatactgaggtctcccactatcagcatgttagagtcaatatgtgattttaaactagagtagtgttgcttctatgaactttagtgcccttgtgtattgtgcatagggtatttcctttgatgagtgtgtagtgtccttctctatctcttcggattagttttggtttgaagtctattttgttagatattaaaatggctacacgtgctttcttcttatgttcatttgcttgtaatatatttttccatatttttaccctgatttgatgtctcttcttgatgtgaagatgtgtttcttggatgcagcagaaggaaggatcctgtttttgtatggacctacattgtatccatatatgatattaaaaggtctttttcttgtgtttcatttatgttgcaatatgtagggcctgatgtgatagggttgttggattctagtggaaacattgtccattggttgggtatttaagctggcatatttgtatctgggtttggaaagattgtaattctaggtgctgatgtctggtcttgtctttgttgaatggatgttttgttccttggtttctgtttcctctctggttcttaagagagttaggagttgtgtgttgcctggtaggaaattctcttgggatcttaatatgtgtggccactggggttccaagtaaactatgtttctaggtattgggagatgacacttatcaatggggatgggcttggggtgtcgaggaggtctataggaggcaggaaagcaaggtgctccactaggattgcctacactcctgggaaggttgtcagagagcaaggagagtccgcagcagcaggtgtctgctacagagctgtggattaaactggggactgggatttgaggagaggaggaatactgaaggtctgaagcttgcctctttgcttctctgtctggcttggctggagggttcccagagaaagcctattggagttggggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatatgaaccaggaacattcatatgtcacctttgatggcctctcctgcatcatctgcacctgcttggatggtcagtacaccaggtgaaaatttctctggtccctcgtgttggcttttcctgcaggccatgttctgtgagagttgagtgctttgttctctccaggttcccatttgatttcagtggacattgaatgtagatcactgctctcactcagaagaaatcctttggagagaacttcattttcaaagaagggattttcatctcgataacaatctcttctgcaacctgattttacagcttcaaattctgtcgtgtgaactctggtcaaatactgcagagcctctttattctcctcctcaagtggtgcagattcttttggatggtccgcaaatgttgttacctgaagtttgggattttagccattaattctgacttctgagaaaatggttgatggagagtttgtatttctgttctcttctcaggtttcctcactgggatgcttcttaacctcatctgtttcattttgaccatcatcactatactcaagcatttcttgctattcatcgtctctttagcaggtcaggaaggggtggctttctaccagctttgaggcaggagccagtctgggttgcttggcctgagacaggaacacagattgttatttctgggccgtgcacagaagaaagtattcagaagaagaggctggagtttagatgctcacagcaggaggaaacccaaagtgaagtaaggcagttaagagcctcagtagcatcgctagaagggcttggaagacaaggcagaggactggatccttgagtaaatgggaaattgaaatgcaaatgaacagaatacaggagagctttgagacaccaagaaagatctaattgccaaattatgggtagaggaggaaaatatcatgataaaagcttggagaatctcttcagtaaaatcacagaagaaaatttcccacgcctagagaaagagatgtgtagaggtttgctctggttctttctcgcagtcccaagctcccagaaataagactcagattcaaagtatatttacaaatacctagcccatgtagctaggctcttctcggactagatcataacgtaaaataacccatttaccctgacctacactctgccacattttgtacttaggcaccgtacatccctctcaatgtcacttcttcctggtgaatctcctgcctgacactatcccagaattctttctgcctagtggatgcctatccaggtctaagaagcttacagaacaccacatagacaagaccagaaaaaaaaattcctgtaatatattaaaatttcaaaataacagtggaattaattttagggcctcacattctgcattactttgtatagataacttctttaaattttttaaattacatttaaaattacattttatttgtgtgtgtgtgtgtgtgtgtgtgtgtgtgcgtgtgtgtgtgcatgctacaatgtgtgtgtacatgcatggtgtgtttgtgtgtgtgagtgtgtgtcacatgcatgacacagtgtgagtatgaagatcaaagaacagcttttaaaagttgtttctttcctttcaacttcagagagtgggggcagggttctatatagagacagactgaactcgggttgtcaacaacttgttaacatagagactgttgccatggaatatgggtgttttattatttctgtgtttccaaacacatcttgatataatgagatgcagagaacaatatcagggcaattcaaccctatgatggtccctctggttccctgaggctcagcatggtaataaagtcttttcaagttcatggagataaactcaagccttagctctaaggtctggtttcttcctctacccttccatttgtcgcagtgtcagtcaaagccaagctgctgagacactacagctgccacggctcaagcagacacagggcacgtacccttcatcccctgtaccacctgatcagatagatgactcagtggccatgactactgaatgtgggtgggtcaggcaggaccctaacacctcagggttccccaaattggaatgcgccaggctgtcaagagtaacaagaggagggacttgttcctctctggtgcttttcctggggtcaaacgagacatctcatcaccaattaccgtaaagccaggttggaaggaaggagagagggagtaacttcagggagataattggacagatgagagctttcagtccctttaactaaccctggaactcacattgactttaaaggaagagaatatatatatatatataaaatagttgtttcaaaagaatattgaggatgaaatatcacttacataaggggaagatagtgcctgttcatcttaattagctggaagtcagtcctgtaccacaggggcatcacaccacgtgggtggatccacactgtgctggaaagagcaatagcagcgcctgtcagtcccctgtactcatctcagggggcgttagggccctgcttgctggtgctgcagatcaagcttgttaagataaagttgggcgggtgcttgcaatcacttgcaaagcctccccctgccgcaggcctgcccacttttcctgactcagaggtctatgttctttttcctcgtccatttctttccgatgtcagtcaaagcctgtgcgtgctgcccctgacactctaggcctcatgtgttctctgaagacttacttcatcctccacccacttctgccttgctgctgctagccaagctccagggctgagcccagcaggctttcttgtatcctaacctaaaaggtgtgattttctttcttcctctctttcaggcaactgccgcagtctacagcctgagtgccctgctgtttttccctcaaaatttgatacaaaataaaagatttatttttttgtcttggtgagagagtatgaagggtgctgtgggggaggccacgttgttctgagctgccttgctttctgcctctctgtcaccatgtgtgactttaatttcaaatcctcttttgaagtacctggtgaaacacttggtgatttttcgggtgacacataagtacagatttcagcagcctttataggacacttgaaaaactgtaagatctgtagaaatataatttgtgtgcttctttgtgggttcatcacatattccaggtaagatgtgctgcttcaggaaagctatgcaaggcactcttcccttcttctaagtttccctcataatgactaatcaatcaatcaatcaatcaatcaaccaattcaatagaggcacatgacaaggttgctctgagatcaccctgagctaatgaatggcgtgaggtgctatgaggttctgtggttggactgcagcacactcatgtagaaaaggtactattgagtagagaatagaattttagctcactcaaggctaaatgtttcataaacgagaagtaagctatagctgggcagtggtgatgcacacctttggtcccagcacttgggaggcagaggcaggtagatctttgaatttgaagtcaaccttgtctataaagtgagttccaggacagccagggctacacacagagaaacctgttttgacacacaaaacaaaacaaaacaaaacaaaagctgttgtgaacttgactttttttttttactgtgataaaaagtcattctgtggaggatagttgttcatggtgtcaagttttcataggactgaaaaatgaacttttcatttgggagttgccctttgagtgaagcaaggccccctagcacgcctcggaatatcatttaaggacatatgcatatatcactcatttctcgcccacccacctacccacccaagcagctcatagactctcagagaatgagggtagagaacctcatagagtaggggcagggttaaataaacaaacagccagacagcaaggcaagcacactcttaaaggaaacctagagagctgtgttgatgctctgagatcaggaggaagaaacaggtcctcctccagggtctcgtgcccttgtgcctctctggagtgcaattctcttttgtgtgtctgagttactcaagttaaatcaaattacaatgtcctgagttgagcatagttttatgggaatgtacttagaacttgggattcataaaattctcaagacacaagacacaatctagcaggaaagaaattcaatgagaaattaaaaagcaaacagaagctacagaaggaacacacaaatgcagctatggagaaatgacaggaacatgtcaggctccaaagtgttcagacattgaaatattcagaatataaaataaccacattaaaagtacttgaataaataaccagggtaattagaaacacagataatgaaaaaggaagtattaaacaaacctagtcctggtgtatttgaccaaaaaaaaaaaaaaaatagaactcaagagctatggtaaaatggatggtgcatggcctgagaactaccagggaagtactacagagtagagatgggagataagaccacgtgactatgagactgaggagagatgggaggtaacaccatataactaagagaaatgagaggtaagatcatatgactaagaggcaggagagacgggaggtaagaccacgtgactaagagacagagaagaccatcatagatcgtttagaaatccaggatcagggaagaacaggaattgggaaactcaacatctaaaagaaataatgccttagaattttctaaaactgatattactccttacttctagaaactttagggacggtttgtgtaaaaaataaaaacatcacaaacgttgaagcaaatcctgaaactctagtgacaaaaagaatatagaaagaagtaaaattatgtataaaaaatgacaaaggacagggagccgactccgtgagaatgaaaacaacagcgagcaaagaactgttcggtcaggggctgctggatcagaagggccaaaagcttttccatcattgctttctactaaagggagaattgaaaagctctctctgactgagggagaaagcttccgatgggctgaggaggcaaaggcaggcagctacaagttctgggagaagaaaatgggcttttggctgtctactgatgatctccagcaagccagttaaaaaggttaagcagttgggctgcagagccaggtgagccagtggagacaggagtctagcaacgatccaaggctgagctgttagcaagtgggtcataacaattcattttaattttcattttcattaactaataatggactcaagacggctctaaactcacgtctccagccccaaggtgttgcattatttcaaggcttacacatccaactccatgctggtcaatccattatgtactatggataaggcttctaaaaagatgtaacagtataatataaaatgtggcaaagactgcaaacaggggagaaagcaaggcaaggacacagtaacatgggggagaaacagcgttaggagggacaggagaaacccctgtgagcaagactcttggagcagaatcttgcagacatcagggaggaagctctttggaggggccgtggaacattccattgggagaacagcagagggagcagcttgtaggaaacaggacagaaaggccaagtgtccaggaaatgtcaacaaaccaactgttggatcagtgacaacaaggaagaggcaaggatcaaactcactaggttaggaaacagagatgagcaggctgggtccgagagccctgcatttatgtagtgctctgaagacttcgcagtgtagagaagagtgcagaaatcaagacaggatgctgtgaaccaagccttggtgcgtctacatgaggaaagatgaattacctgccaaaggcaaaccaaggcaaaacgtagatcaaatacaactgcatctcacagtactaaagcaaaaatgaaacctcaacctcccctgccccccaggccccagtcttagggtttttattgctgccataaaacaccaggaccaaaatccaagttggggaggaaagggtttatccttctgttacttcatcattgacagaagtcaggacaggaactcaagcagggcaggaactggaggaaggagctgatgcagaggccatagaggtgctgcttactggcttgcttcccctggtttgctcagtctgctttcttacagaacccaggaccacccagggatggcaccacccacaatgggctgggccctcccccattgatcactaattgagaaaatgccttacagatgaatctcatggaggcatttcctcaaccaaggctccttcctctctgatgattgtatcacgtgccaggttgacacacaaaaccagccggtacacctccaagcccaccacggaataccatttaaggacatacgcatatatcacacgtacatctggaaaggggcatcgagcacacatttaggtggtggtagtggagattgtgactagacaggtgtgggaagtgacttcaaggatattgatgagtttttaagtattttaagcgggagggtggacttgggggcatgatataatctcatcaatggacctcccatgtcaaaaacagttcgtagagggcggaggagatgtctcagggcataaaagcacttcccaagcatacctggtgacttgagttctatctccagagcccatggtggaaaaaggcaagcaattcctggaatttttcctgtgactgtgaccacaagtgccagcgtacacacacacacacacacacacacacacacacacacacagtcacagagtcacacacacacagtcacagaatcacacacacgcagtcacacacacatatgcattcacacacatgcaaacacacacacacacacacatacacacacaaaacagtaattcattaatacaaagtttataccacatgaaaacaataacaacagccaagtccctataaattcttgctggggatattgatcactggtagtagtccttgcccaacatgcttgaggctctgagttcaaccagttgccagaaacaaacacacacacacacacacacacacacacacacacacacacacacacagcagagtaaaacaaaatagaaccctcatggctacccccccccccccagtcctattccatatgactttcaatgctgtcaacagaacagaacactatgaagctctaggtcacagagcattgctggggagaaaggcaagacaactggtaacccagctccatcctcctagaacaggtaaggatgctctccgatgcttagatggatgctagtaacaactgactgtcctgctttccttaagatgaatacatggtctgtttgtaaggaggctctctgtattaagcacaagagcaaagcactagcaggtacgcgatgcatagcatccttgagtgtccctggcagtgtgttaaaagagctggtggtggggagaaatgaggtacagctggttcctaaactccccccaggtaaagtggctcctgcctcaccattgcgcatccttgcctgcagggctggactgtgcaacccgcactggtgcatctccacagagctttcccacgagcaccctgtcctacccttctgtgcacaatctgtttctggccttgtgtctagcagttgtggtcactcaccgctggaggacgctggcgttttggaaagcgatatagttacccggtacctacatgcaagagcaggtctttcttttggactgctagaagcagtggctcatagttggtgtggcccccgcctcccttctcagcagagcggcctttcaccacagtcaaatgactcttcacaaacacttcactcgtcaaggcttccgtttgtgtcactcagatgagtaatgtctggtggaaatgatggatccccgaggtgaacagcgtgcgtgcgtagggtacgctggtaaagaaaactcgggcagcctgtgctttgtgtctttcctgcttcttcactccctagcttgtgactggacgagggagggagcgcggcagagaatatcacagaatcccggtagcagtaccaacccttgatttcagtgggatttatttctgctcttccagggagcgggaaaaaccaaaggtaccaattggcaggagggctgcacagcctatcgcctcagcctgcacacagggaccagagtggcagcggggcagcacgtagagtggagccccatttccagcaaggaggtgggctgccacctatccggctgagaaggcacacaggggtgggggcgggatgcatttgaatattcacagtccctcaggtaaggcagaatctctgctggccactggggatccgtgagagaggctcgccctgcagaggacccgggactaagagggagccgcagcgccagcgccagcgaggcagggaggtggatcttagtgcgggaagctcagcgaccctcttcaccattgaaggtgtgcatcgctgggctctgcggagcttggcgggaagaagaggctcaaagcaacaggtgcaacctcaaggcactgaaagcaaggggacgcagctcacaagggccaagggattgaacccataaccgctcagaagattctccgcctgcggagagctgcggaggagtcccacccgtccagcttgctgactgcgagcagtgagagtcgcctagacccgtacctctgtgttctggagcctgccgcccccgcacgggaaaggcttagctcgggacttgcagcaccgcctcctctttagccaggccaggcacgaggatagtgtgatcgggcacagccagggtcgctcttccaggctttcttgcgggttgcgggaggtactagttggagacgcgcgcgctcgctctcgccgctctgtcctgggccactccgtgatcctaggctacctccagagccagttttccctggctggcacaactctccagggcgctccggtccgttgcacagcgccccaagggggtatcccagtaagtgatggaactggctatggtgaacctcagtgaagggaatgggagcgacccagagccgccagcccccggagtccaggccgctcttcggcattggcgtgggagaacttcattacgctggtagtgtttggcctgattttcgcgatgggcgtgctgggcaacagcctggtgatcaccgtgctggcgcgcagcaaaccaggcaagccgcgcagcaccaccaacctgtttatcctcaatctgagcatcgcagacctggcctacctgctcttctgcatcccttttcaggccaccgtgtatgcactgcccacctgggtgctgggcgccttcatctgcaagtttatacactacttcttcaccgtgtccatgctggtgagcatcttcaccctggccgcgatgtctgtggatcgctacgtggccattgtgcactcgcggcgctcctcctccctcagggtgtcccgcaacgcactgctgggcgtgggcttcatctgggcgctgtccatcgccatggcctcgccggtggcctaccaccagcgtcttttccatcgggacagcaaccagaccttctgctgggagcagtggcccaacaagctccacaagaaggcttacgtggtgtgcactttcgtctttgggtaccttctgcccttactgctcatctgcttttgctatgccaaggtgagtgaggagcgctggccaggctcctatgcagctcttagtgaccggtgaccctgaccctggagcttcctggagcttcatgtctccgcgacactcccccactctctatcccgttccatttcacttttgtctcagcttgctttctccgatatcatttgtggagcaaaaaaaagttaacttggagtttgagagatggcagggtaggggggcgtgggggtggggtggggaggggagagtcgcctgaagtttgcagttgaatagaaagactttatctctgctctccttcaagggcgctgcagctcagcacctgatcacttcagggttcagagaggcagttgtgtgtcttggatcacttctcaaaaggttagagcccccttagtttcagcagcttttaaacaaaattggtgggctccaagaaaggaatacaacagaacaaaggaggctgcagggtcaatgctccctctaagagccagccatgggccatggtggattctagtcacccctcttagctctctgctgagacctgctagtgtggtggtccctggagccaagctcttccaacaaagcagcacactggcacctgcaccttggtgagttttcagagtccagactccataaacggcagcacatcaggttgagggctttgggttttagtttagcattctaaaaaccaagtgggaagcccttcttccccctagagacctggctgaagtccccgggggaactatgggtagaaggacaagtgctaggaattcagatggtgagcaagaacacacagctgggggagctgagtgtttatcctgtctccctgtattgggaaggactggtggctcacaagctcctaagaattacacaacactgtgcatttatgttaaccaaaccccgtaaacttcttaggtgctatttgttgatggtttatgaatccagagtgtattgttggtggccacttgatgtggttcttgggggtaacctctgtcataatatttccttccagggtactatctaatgtaaattctgaggttttcatgtaactttatccttccctgactccaagtctgtgccagcaacaccatatacaaccccccccccccatgtagaaaagcaatggttccttacatttcactcataagggacccatttaaagaaggccatcttcccacctttgtatgatatgattgtgtctcttttgaatggcaatattgcttcagtgagtgtcactggatcaaacttgcaaggatagccttgctggttggaaatggctgatttattcatttggtctttgcaaatgcaaagcaaaggctgctatgcacctggagttttggggtgcaggctcacatccatgaatgtgcccagtaagcctccgggtgggagctgctatctctattttattaataagaaaaagtactttcaggacaatgcagtgactgaccagatggtaaggttggtaagttatggaggaagagtttcaggaggtgacagtccatcccttctatagcctgagctatagaagagaaacagagctaagaaaaaacacatttagaatgtgttagctcatggatgtttcagcaaattcagtgttcttaggtgcttcaaattgctgaacttggatccaacttagttggcctgactgtttaaatccaagtaacaccaagaagttggccaccgccgacgctcatgtcctagagcagattctcttggtatctcctccatccttttccccccttgacctatagtattgtgatctgtggtctttagacaacttcctttgggaactcagcatctctagtgatttatgattacttagcagaactatcagagacataagctagttttaataagtttgcaaatagtgacattgatgcaaaagatgtttccagctaggaagaacacttgcttagaagcccttatgctctcttgccagtgtcatattgggtagaaatgacgacatgactgtcgttgctgttgttacatatagggattcacaagcatgctggccgttgccagctagctggtcagccctgagtccatcagcaggctcctggctccagccctcaccttcctcttacaagtttttcagattgctgctattgaaaacttctctgtactttctggcggcaggacagagctactccagcattggtgttatcagtcagttatccacttgcttccacagcaatcgaagactcatttggttgtgagacactgaagtggtttcaggcagtgagaagtctctcagtagggcaagaagtttgaagacagaaattcacactggagaaggctgctagggtgactgctttgctgctggggtagagaaggctggtaactgaatcccgaggtttcttaattagaacatgactgatggtgctggttggagctgaatggagcagacttctgcagtaaggccaattcgattaagttatttccatgttgtggtgttagagggaaacatccaagtggctggaacatgcacccactccccgagcgcttcttcagaaatccagtccattccaagctccttgctgtatattccaggttctccatcagaatagggaaacagacctaggaccagccctgcagggcaggcactgtggagaaagtgcagattgtgaattcctatgtacaatagcaatggctaccctaacatcatttctccaacgtatgacagaggcaagagagagcagaagtgatttctcaatttaccaaagtgatcttatctccttgacaggtatgctaagtataaaagctgcaggattgaaaaaaaaaatcaccagcaatgttgaattcctaagggtgttgtctaaagaccacacagcatttgaattatacatgaaaggagccctgctggcttgtgctttgctctagagcagtggttctcaaccttcctaatgctgtgaccctttagtacagttcctcatgtcatggtgacccccaccatgacataatattatttcctgttgctacttcaccgctgtaattttgctactgttaatgaatcgtaatgtaaatatttttggagatagaggtttgcaaaacaggtcgtaactaggaaggttgagaaccactgtcctagaggtctgaaatgagaggctttcatagatagctccaggaactgtcgcaggactgggcaaccacactgaacaactgtcagttatattctcttccttgttcggttggctttctcccctgggtggtgaacctccacagcctgggtctctagtttacaatatgtctctaagctgtctctgtgtcccatgtatgtaataggacctggtgattttaagcatgtggattctctgacggaagcaaggccgtaagagcaggagatttgcttgagtcagcgccaccccacctcaggagaggctctttctccaagaaacttggagcctggtttatgctctctgtggctctatccagacctgggtgtggtctgtcttccagggatacttctaaacacagtcagctgctcggattcagggctttaaaaaaatctgaaatgcatttctaattttgttgttttataagcactagtgttaccatacccaagctcagtggttgtcactgaagaagaggcagcgtgcaagtaaaacctgaagttaacccgcttcatccggttatgttttgcaggtccttaatcatctgcataaaaagctgaaaaacatgtcaaaaaagtctgaagcatccaagaaaaaggtaaattcacacacagatgcggttcctgcccattttcgagagcttagttgattgttgttttagattattttcacatccagccacaggttcgaggaccagttgactgaggtgtacattttcaggaactgccacagctaaagggtcgggtggagcaggagtcacatcaagaaggtggcaggtgaagaccagacagggtagggaggccaggaaagacagacagacttccagagggaaggcttagatcagggagaactcagatgtaatttgcatatagcatattagggatgattcgaaactgtcagtttgcttttcactggggagagcattggtgcgtcacctcttcagcctcaagggcaagcaggttccagccttacctctcccctagacttcggctgtccttggcatggaaaagacagaaagtaaaatcgctgggacccgatccctctttctcatctagggcgtcccacctgacactttcttctgcataacaatactaaaagcttctaatttcctggggtccactgcatcttcattcaccgaagcaaactgttttacacaccaggattaatttatcttttactgtaatgaaatctatgtgatttctaggtttagagagtggaatgaaattattagacaattttattagagggaagataaccagacattttaacccgcatgcattactgaatgtatgtttaaatgccctttttccctttctaaatacttattctgatcagttatagatattttgtaaataatcatccagatgatcgtgtttactctaaaggtcttgacttgagtacagcctgctctgcctttcctgatcattcacatcagcgtggagaagacccacacccctcacatcttgggatgcaactctagctgccctggaacctgagatgcagaacagactggccttgaacttgtggtgatcctcctgcttctgcctcctaaagagacctgtttactcctggtagctcaaaataactcacgtttgggataccatcatttatacgtttagacacacagacacacagacacagacacagacacacacacagacatacacatacagacacacacacacacacacacacaccccaactgcctaagaataaatgactccctctgccttctgccctttcttacatcccagcagtcacttaactttagatgcagatctctctttataacaactgatgatgtttgaggcctgtgactggagtcaaccctggatactgtgttcttctcctctgcttccaatgctgcattttaatgcagtcgtaacattcttttaatctattagtttttttttttttttttaaagcaacacttctcgcctccaagaaaatgagtccttaagggcaattaaggacttggtgtaatttctccttgaactgctcttcataggtactgcgtgggaacaagctgacctctagtttctcaaaggaacaggcgtcctttgggaggtggaatcaagagaaaaacccagaccatagaagttcaataggaggaatgttggagagtaacatccttcagggagctggggaagtagctcagacaacaaagggcaagcatgcacgcatgcacgcaggagaaaccgggtttgatccccagactctgagtttaaaaaaaaaaaagaaagaaaagaaaagaaaagaaaagaagagaagagaagagaaagaaaaggaaaggaaaggaaagaaaagaaaagaaaagaaaagaaaagaaaagaaaagaaaagaaaaaaaaaaagaaaaggaaaggaaagaaaagaaaagaagaaaaattgcatttggtgtgcacttgtaatcccagaactggggaagcagagacaggaagatccctggagcagatccctggggcttgctggcctgcatcctagcctagtcagtaagctataggccaatgagagaccctgcctaatcaagaaacaaggtgggttgctcctgaggagagatacctgatattgtcttctggattccacaagcagacactcgcacatgcacacacaaacacacaacaacaacaacaacaacacacagatacatacacacagagttgcacaaacaacaacacatacacagacacacactgggaacaaggaggctgattaggattcaacagagaagaagatgctaaatatttactgctgatcctaaagatttaagccaggtagtgagatcctctgatcttagctgcttgggaggctgagacaggaggatgtcaaatttaaaatttaaggcaaacctgagtcacttagctagacccaaattatctaaaaataaaaagtaaatggcaaaggtctgggatatattcttgtggtagagcctgtccctgacatgcaagaggcttgtggttgaatcctgaggaccgaaaacaaaacagagattttactctgattgagagagtcaaactactctttgaaaaaacaaaataaaacaaaaaacacaacacacacaaaatccaacaacagcaacaaaatcaaaagtttagatgaacctcacctttttgtctttgacaaggtgttggtgagagactggaaagctcccagaaagaacaatgtgtttgacggaaagatgcaaggccatgtaagagaggctgggggaagcttctgctttattttataatgaagactatagcggtcattttgtaagcgagcacatatgtacaatgaatacatatttatataaactaacctttcattcattcccgaaatacaagaaagttagagcatttgaaaatggaggttttttttttttctttctcttccctcctcagattagcccttcacagctgctgaacagatgtctgatctcctctgatagacttaattgccttttttgtttgcacgaagcaaataaacatgatggtagggtgcatgtgcgtgtgcgtgtgcgtgtgcgtgtgcgtgtgtgtgtgtgtgtgtgtaagagagagagagaggaaagagattcgggggagggggagggaaagagagaagcaggtgatgagactgaagacagaggaagaagaaaacaagacagaaagaagagtcacctggcagggtgcggcacagaccacagtatccaatcatagaggatcagctggggacccttccctagcagatctcagtgcagggcgtggtcattggaactcatgtgctccgtgcttaccactgagaggtgacatgggactctgatgaagactgatggtcaactgtgtaacttatcctttttcttactgtaaccagtcccccccccgcccccctccccaagatgcaactcaaaggaggaagggtgatttgggttagagttcaagaagttagagttcaacctggtggggaaaggcaaggtggcagaaagatgaggtgacggacacattgtgtcttcattcagaaatcagagaggatcatgaagtgcggggctgagagacttcaggtctgccctggtggctgacttcttccagttaggccctacctcacacccggtcctcagcaggaagtgtagggtgctgacctgtgagtcttggttacaggaccttgcacactcaaactgcagcagtggattgacgggaaggaaagaggttccaatggacaatggatgggtgggaatgtcagttgttggctcattctaacgtcatttatcttcaggttctctcagtggccaagcagatttctgtccttgtgctgtatccattcgaaaatgtgacaggaacgaaatatcccgtagggtgtggcttataaacagcaggaatgtattttctaggttcttgagcctggaatgccagggtcaagtgctgatagacttttagccccagccttctgtctgcatttgcacacagtagatggagtgggggtagggctcttttacaagggcattggttccactctggagtatactttcctcatagtctcatcttctaatgaccctacctccagatgccaccatcttggtgatcagattttaacctatgagggatacacacgttcacatcagcagatgagctttctgtgcaaggcttatcactgttatgaagtgcgagcccagctctttgtgatgggcacattgtgtgactattcccatatggaggaaagtgtaggaagaaagtaggatgcctttccataaataaattaaagcccaattacctattaaggactttgcctaagcactgatgggcagagagatgattctggcttgagactggttgacttaaaacaagaatcttatctaacgctgggagggtggtagggtagcacagtgggtgggtgcttttgggagggagcctggtcaaaggcccactgatgtatgaacatctgcgtacttgcaacagatgcattttggttactatagtctgttccctgatgtgtccggtgagcgctctggctgtccttcacacagcttgcttggggcttctcacagtctcccctgtgctctctctttccttccccactgagttttgttaggcgcattgaatgagactctttgaagaaaagacagatgtctctgattgcacaaatcaagggagtctgatattttttttagacaggttcaggttaggaagaaagaggaggcacgctacgaagagccagatctcaagtgtgtatatatacagcgtctctgtcgaaagtagggttctgtgctccaaaccaaggaatgacgtcagtcactgtgtgtgcccagtatcacaccatcgctggcaaagataaatggctttgtaagaaacagggacatggtgttagaaatgaaaattaagaacttcagtctttctgtttcaccctggcactttccatgcaggggagtctggtgcattctgatatttcagagggatgtagcagaggcagcttttcttgcattgtctgtgggtagaaatgcttctgccaggagagctatcagtattaagtgaaacctctttaattgctttcacttaaggtgcatgaggtaaccccacctttattgtggcttttatgcggttcttcagggattcactaaatctcctgagcattgtaaagagtcagcttccaaggtaactatccagtaactattatccactgaatgagccacggcccattcagtgacagggctcagagtgctctcggataatgatgggcccactgctttaccacagtcccggggctgagatgagaacacatgcgttattgtgagcagatctttaactttaagcctatgaactccagacatattgcttcctcaattctataccagaggggtgattaccggtcaaaggaggacagtttctaattagggcagaatttctcctgataaattttgttcttttcagatccaccagcatttgctgaaagagcaaaaaggaaaaaaaaaaaacactcttagggtttatctggcttttcacactactgaggctgagactaaggcccggggcttgtgtgaaggacacagacgtacggtgctagagagaatagcttctctgagattccccactggaccagtggggtgcttagcagcattctagtaagctcttaggagcagccagaggtagacaatagctcataggagcatgcacccagtatttgcttctgatgcttgtattgtaagttattagccacttatattagcacttccagttgaccgtgaaaaagagcctggctcagatgtgtgttcctcagaaaagcagggggacggtaaacatttaaaggcttgtttgggtaaagtcacaaacgctccgagaaaccactaccataaaagcattgcatactcagggcacacagccatttgcaattctgacctcgataagatagaacccagcagcttctgagctgccgacctgctctaagctttgtgcttagcccgtgcttcctaaaagaagcatagcaggaaatagtgaccgagtaggacttttgtagggagatgggttgaccatcttagacagaggagggtacgttctcctgtattgcgagcacaaccatttacaggttgtttgattgaatcaccagagaatggcagttctcacacactaatgggcaaatggattgatagcaaacacttccgtaatatgtgtgagctaattgcatttgctctgtggcccaggcagtaagtggacttaataggtaagctctcactttgtaacacctgcctgtgggtttttaatagtggagctggttagtgctcacatggtccgggtacaatctgagaatcattttgttggctaatctgcattaacgaggaggaaattgggtcttgaggaggtttgtaaccatcttccaaagatggtgagcagatccgctgtctggccaataattgtgcaaaatctaggatgcctcttggtattgagtttagctttcttctcctgtccctcctgtcttgtggtgtttactgttcttgacctgaaatccagcacccccacgccccacctcgctctctctgccttctctgtcagaagtctggccattcaccatcactgttggttttcaaccgcctcagtgatgaacttctactgttgtcttagcttgctgccaggattcagcaagatggaggtgtccgtaatgccatgctatatttcagactttccattctagaacagtggctctcaacttataggtttgacaaatcctttggacaaacctctatctttaaaaatgtttacattatgactcacaacagtagcaaaattacagtaatagagtagcaacaagataattttatagttgggggtcactacaacatgaggagcattagggagtctgagaaccgtaggatttgctttcatgagaagcagtagagaaagactcctgccatgtagcacggacctgccagcagtgtcctttagaaaggtcttctgagatttgtttgccttctaggttggtggctggtagggaggccttgcccacgcacacagaccatggctaggttggtctatgctcccttgttttgaggtcacgagccaaggacactttcttcctgttgtttgcttggtgagaatcattaggaaacatagagacctgcttcacgtgtctgagtgcctttgacttaggaaaagttaagctagccataggccttgttggtctccatgatgctctgggaatggctgtgagaaggttagctccccagagtctccaccttgtcttcagtaatgagaaaccaacctctcccacttgggtgcacccgggtttgcctgagctctgggctcctgatggaacttggtgtgtgcgcactggaagaggcttgctatgctggttgggttttcttgagttgggaggtcttgtgtaaaggtcacactggtccagagctctggctcctcctgcctcgtctcttggctgctggcagaattctctctagcttaggcaacagtccttagtcttgatctgtttcccatctcacacttaccacagtctgcatgcgttttacacgtgcctaggaatcaggactgtgttaggtctctgctgggtcttgagatgttgtgtgaggtcaaatttaacacttttgtgtgatctcatgaaagtacctgtgagggctggagagatggctcagcggttaagagcatagactgctcttccgaaggtcgtgagttcagatcccaggaaccacacggtggctcacaaccattcataatgcctttttctggtgtgtctgaagactgttacagtgaactgacatataataataagtaaatttttaaaaagaaagttttttaaataaataaataaaagttttttaaataaataaatgctacagaggtgtattttacagcgctgtattctcctgatataactggtgtattcctgcagctcctgtcccctctccaaccctcttccattactctctcttccagactgcacagaccgtcctggtggtcgttgtagtatttggcatatcctggctgccccatcatgtcgtccacctctgggctgagtttggagccttcccactgacgccagcttccttcttcttcagaatcaccgcccattgcctggcatacagcaactcctcagtgaaccccatcatatatgcctttctctcagaaaacttccggaaggcgtacaagcaagtgttcaagtgtcatgtttgcgatgaatctccacgcagtgaaactaaggaaaacaagagccggatggacaccccgccatccaccaactgcacccacgtgtgaaggtttgcgggagcctcccgacttccagctcccatgtgtgttagagagaggagggcggagcgaattatcaagtaacatggcagcttattctccacagcaattcctatcgatccaactacattccacagtggtaaaaggacgttgattgttcagggaactcgtgggtctactgaagatcattttccaatttcattttactctataattgtatatatgagacaaaagaaacttctgtatagtttctagctctcaaggaatgaaagtcctacagcactctgcaaatgttttgatctccatggtgtaaagtaagttctgtaaagcagagaataatatttgaaatccacattttcaggccagttaatatagggaaaaagttctttttaaaaaaaaatttgagaggagaggtaatagtctagtctgtgctttgaaatacaactgtgggcacagaatagtgatttttattttattgaacctttgtggaccggcacctcatctgagtcgtgggtgtccagaggtctgtctggggatgtgagacccatcaagtacatcctgggagatcagcgttgactctactacgaaacaatcctgtgagctgggagtttagggtgaactaagaaactccatggaagtctgccgaggactgctgcaaacctgtgtgtagctttaaggatgcttttggcaaatgcgttagctgcgtctccaaagaggagagacgtttgattcagaatgaacgaagacaaaagtatcctgtgggagaatagagacacacagagacatgctgcctcatgcagatttgtaccaacaaatgtctaaggattgttttccccaaatattattccatggagcaatgttaatttagaattaaaaccatcaccatgtgacttacaaatgtaactttcacaacaaatttcatatttacttatacttgccataggaaaatgctgtgaaattactaaattgtcctgtcttagaagaataatgtttaggtttaagactttgataatattttaggaggagggaaacaaagcaagacactttaaaaaaatcaaaaagggtgtatatctgtgccaaatcagcacctaatttaggttaaaaaatgtaatgtagacttctggctcgttaacttttctagctcatttattttcgtgactattcccctgtaaatagtgtttacatttgcaatagtctctggatggaaaaggggggactgttggaatcacggggaatgaagagttctcagtggctgctagggcgggatgtgtctgttggtgttattgggtattttaaagagaattataagccctttgcatggatttttgtttgtttgtttgcactttattcaatattggagcagaaatactttatcttgaaaaaggtacctcacgtgattaggggaacctaaagctgtccttgtggatgttggcatatgtccttcattcacactgtccacagaggcgcttggtcagacctgcatgtgagagagatatcctatgctctaagagttccttgttctcttctgctcagagactttgtagatggaaagccaacactgtggccccgaggcatggcttatctagaaggcacgtgttcatacacccataaggctgggtcttgcccagaaagcggcatctaatgtgacagtgtgtacttgtgaaccccaaatttgctaaacatccattcaaactgctcctgctcctgaaagacgcctctgtaaactgccattctgaccattttctcttcccttgtgcttgactgtatttctaaagtgacttagaatcccaactgtagccacttcctgggatgatgggagactgagagctctggaaggtgttcttatgacctggggcagatcagtcacgctgacgagtacagcaagagcccacacatgtgccaagcttcctttccctggtaagtgattaccgaggacagtttggaggcagtggatgatggtggatgatggtgaccggcggaagaaggaatgtgtgggcctttgaagcaggggcaggtggctgctttttagggtgttagaaagaaaattgatgtttttgtgactacaagcttttctgctgcagtcctctgaagcagctgctattttgtgggttctttgtttcatgcagagaaagatttggatatacttacataactggaatgtttgctgttgtgcacgcacgcacgcacgcacgcacgcacgcacgcacgcgctcgcgcatgcgcactcacccacacacgttcatccacgtatgtattgagccgtgcaggaacctgaggcccctttctgaatattagattcaaattattgttacttttaactaaattgttctatttacacatttcctgtctccctttgtccatcttttatcctcttgtctcagcttcctgcctctttgtacacagttagccccagctcccccagatatgacagggagcagagcgagcgggctgggttcatgagtcatgcagggcctggagcttatgattcagcttcaaatcaggatggaacggatcactgctctacccgcctctcaggtacacagaggtccagccgtgataatttcactctgctgactgaatccgcaggtcacgatgcagctgacaggagaggaccacccacctaagtacccacttccttccttacctaagactactgagcccctgagcaccccgtgcttgtgataaaaccacaggaacaatggggtgtgtggctgcatcatgctcttagctttaagggagttgcgacgtgcatatgtatacatcacaaagaatggggactggagcaatgcgtggatggggtcatccgcggaggaaactccgctatccagcgtgctccagttctcatccgtgcttctcatgttttcattttgtaagtgactgtctaaggaagtgagtcagatcctctgtcattcaagagttgcacgccaggtttcttcttgacgatgcgttaatgacttgtctagttaacacttcatttattatgttggccataggcagcaggtggcccacgagcctcaccgttactgattggctggcaattgtgaccagatctgggttaaagcgataccgtatctgaatgtttcccctgttggaagtgaaaaggttgagtaggaagaactgtttaaaaggctccccgtgttgtggatgcaagctgcttctgcgtaaggcatttcaagtcacacattagtcaagatgtcctattctcttgtgcacatgccatgtctctgattatacccggtggcttctcagtgtgacagggtcagatgcggctctgcagggctgaggtaatcctgtctatgtgctggtggcattcagaagcatcagccgtctgaacactgactccttcatggtcttgatggctggctgcgtcctgttcatcatattgctggccctgtgaacatcctgggctctcaggccctattctgggcacagtgacggtagtgtggccacatgagtgagtgaggagagcggggtgagctctgtggaaatgacgccatctagattttctgaatctacacagcagtggctggggctggcaggttgaacagatgtctcgtggagtatgggagtcagggcaaggacccctagttgactgagctttagactctgtaggcttctttgggataaagtcctactgcagtaccgcattttcaaagattagatactgatgattaaatagggcctcttaagcctgagaagctgcgcggcttcttctcgccctctgtcagctggttttgggttttgaaagaccactgctcagccacatggtgacaaaggaggagtgcctgcctgcctgaagttgtaggtaaccaacccttccattcagtgtcacggtagggccaccgaatacagttgaccatgtggccacctgccattgtgccctatgaaggaagagatttgctatagacagaaattagtgccaatcctggagcttccaggggaattccaaaaatcatgaacgcgggattcctcaggatccatggcgtagcgtgtgcaaagccttgctgaactgctcaggaaaccccgggtggaccccagggcttgcccttctgcggaggcttgaggctgcccttctgcggagctctctgtggtctgagatccatggggagacacactctctctctctctctctctctctctctctctctctctctgaagttgttgaacaagtagcttctacttcctcagtttagtagttgacttataattcaacctagcacagacatctatgaacgagaagggggctgcaaacccaagctacgtgctgctgtgaatttctcatctttcctcagtcactgcctcgaaaatgctctctccggctgttctctcagctttagccacatatactcaactgggtgtgttttgcctgtgtggagggatatcggaggctggccttgtcttccatgccttcatcatcaggattcttcttggctatcccagcaatacttagttttttttttttttttttttttttttttggtttttcgagacagggaatacttagtttttaaacagatccgtgtgagacatgtacatgtagacttcaggagcagactgtttctatcacagaccacgggtggttaatcaattctttcccatagtcagactgcgcaagagcaggccagacagggcagaaatggcagccctctaggctttgagagtgccatatgtctgagaactcatttctggtgtgttgtgttctgaagtgctgcgagtctgtggtggaggtgtgcgggcaaatgactgtagtctccactccagagcttgcttcttgggtcagccatggcctcctgggcaagcgctatcacactgtgctctggagagcccagaattctctgcccatcgccggatccacctctataaggacactttagccggtgaccgagttcccagagtccctgtcataatcttcttgtagtgccataatacaagatgagctgtagatgtctaggctccatgaggtacctgacgaccttgaggaaggactgagtcagggtgaacttgttatggaacttgccatctaaggtgttgcgggtgaaagaaagactgcagttacaaatgttgaattggataatagtgtgagagccacccagtgttgcctatgagagtgtttgattgactgaaggcaagaggttggtttttcttttttttttttttttctttttgtttccagagaacgaagcttatatgggtgcagcaaagaaaagggtttgcatgaacaggcttggggccaggcagtggcacacaagcttctcatgtgcttgtgctttggttctctcaagttcacttcattcagcaaggaactgtctcctgacttgtgtgaggtgagtgagcagaggccaggtgtgggatcctctttaaaacagagctaaaagattaatggcaacaccttccgaaataaaggccagtgataccacagacataccaggaagctataaatgggtatgtgagtgctatttcccatgttttacttttccagggttccatcctacattctcctttcacggggagactggaaagctgacagaaggggcaggcattcccattctgcatctgttgctgaacagctctgtgcatttctcaggttctgtgtgcctgagctgtgagagccgtgtgcactgcagagagagcagtgtgtgtgtgtgtgtgtgtgtgtgtgtgtgtgtgtgtgtatgtatgtgtgtttgtgtgtgtgtgaactccatttgggtctaaatttcctttgcaagttattctttggggatggtattctcattgtctgtagaggagggttctggaaaagatatttcagacttggaataatttaggaagtccaaataggcctgttccccttccctgggggcagagggtctccagtttcacgtgggagctgaagaactcagagtgtgggtccttccagctttaccctgtgggataagcaacctacagcattttttttttttgtggttcatgctggtggtctgaagtcacagttagaaagccacttcatggcttacaggagggtaaagggggcacttgggcctgtattcaaggcttctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctgcctctgcctcccgagtgctgggattaaaggtgtgcgccaccatgccttgctcactgggaatttctaccatttgcattggtcggactctctgcccattgagctgctggcattgaggtagccccagaaacacagggtctccagagccttagggactgcaggaacttgacagcctttcttctaattaaggacttcatggcccttttactccccatcccaacacaaaagcttaaagtgatgttcacagtcgttacataaggagttttgaaatcaatgtcttaactcactgttaattaagtatgagcatgtctttgcctctattattatctccaagagataaatataatattgcttgtagttctctatacttaaagcttttggttaaatatgtagtaaaagtaaagaaaaaaaatgtatgtatgctctaacttgcgtcttcctgatgatattgcctaaatgctgctattaaacagtggtgtgagttgcctggtgcctgatgctcttgtccttgttccttaaggaattgtcagtcaaatgtatctcatagtgacaaactctagcaggaatgccaataaacttataaagcaaaaataccaaaaatgcagagtctgcattcacgcgctttaagccaaaccaagcccatccgaattcacctcacgcttgtgttctgcatggaatctacactgtgatttgaaccaatttcctttaagtgaaaataaaatttgttctttgaagtgttctcattggagtgtactctctccctgcaactagattgaggttgtgtcatttcttttaaagtttgagaacacaatgaaaagttgttgaagagggttgacttcattagtaccggatgctccgcttgaagcagaacaaatcgtggccgtggaaagccgactcccgtgtctgtaaagatctccttagtttcctcttttgtctttattacttatccttctttatttttacttttgttttcctcttttaaaaactatttttattatttttaattatgtgtatttggctgtgtgggcttatgtgtatgtgtgtgtgtgtgtgtgtgtgtgtgtgtgtgtgtgtgcatgtaggtgttcatggatctccctcattggctatgcagaaagagatgggagcaaaagatgtcattatattttaatttaaaaagttactacaaaaaaaaacagtgctttttccaactcttcttttccctccttcagtttttattttgatcattatttttctattttaggaaaaattacttttcattataaccttagctgtgtacagagatactgatagactgcttgtcaatagatattgactgagagcttgcataggattcataaacataaggcagagagctaactgggaatggggtgggcttttgaaaccttaaaacccataccctagtgacacgtctactccaaaaaggccacatctcctaattcttcctaaagtgtccaccaactggggaccaagaattcaaccatgtaagcctatgggaggcattctcattcaacatatcgtaaacttaaggaagaaagggtttattttggtttacagttacggagggctcgagtcactcacgatggggaagacaaggggacaggcaaggaaggggtcatgggggaagcaggaagctggctgattactctgcatctttacttaggatgggaataaggatggcaagaggcatcagggagcagctctcaaacctggaggacatacgtcttccacttaggccctacctcctgaaggtcccagaacccttctaaacagtgataccaactgaggactaaattcaaacacatgagcctatagggtaaatttcatattgaaaccccatgacccccatgtgagagactgacggataatatgctgattctatttaaaactgtatgaggcacttcatatccatgctccattaaagtgaaagggatattagtgaccactgagcgtggctacttccaaacttttggaaataagtacgttttccacataaatcacaccacaattacatctaggactaattgtccttttcgtatggaccaatggataaaaagggaaaatggggttgttgaccacgagttctcatgaaagtaaaatgtaacgggtcatattcagcaatgttttcttgacaatatccaagagtatgaacatcttgggtgtcttagtcagggtttctattcctgaacaaacatcatgaccaagaagcagttggggaggaaaggtttattcagcttacatttccacattgctgttcatcactaaaggaagtcaggactggaactcaaacaggtcagggagcaggagctgatgcagaggccatggagggatgttacttactggcttgcttcccctggcttgctcagcctgctctcttatagaaccaagactaccagcccagagatggtcccacccacaaggggcctttcccccttgatcactaattgagaaaatgccttacagctggatctcatggaggcatttcctcaactgaagctcctttctctgtgataactccagctgtatcaagttgacacaaaactagctagtacattgggcattttcaaaatcacacaagtcaactacatgagatgatagatatgtcaacttgtttaaggactatattcatcttaccatgtgtatgcatatcaagacaccatcttttaccccttaaatgtatacttgtactggctgattttgtgtgtcaacttgacacaagctggagttatcacagaagaaaggagcctcccttgaggaaattcctccatgagatccagctgtaaggcatttcctcaattagtgatcaaggggggagggcccaggccattatgggtggtgctatccctgggctggtagtctttggttctacaagaaagcaagctgagcaagccaggggaagcaagccagtaagtaacatccctccatagcctctgcatcagctcctacttcccgacctgcttgagttccagtcctgacttcctttgatgatgaacaccaatgtggaagtgtaagccgaataaaccctttcctccccaacttgcttcttggtcttgatgttttgtgcagggatagaaaccctgactaagacaatactataacaacaacaacataccatatttcatgaccaagtaagtttcatttcaaggatacaagaatggatcaacctttaatgtcattcaatttatccaccgtatcattagtctactaaaacatggtaatcaatgtagatgataggttggacagatccaacagccaatcatgatgacaaaaggaaatgcctggatttgacagatagcatcaaaactcaaccaaccaaccaaacccaacaaaacacccgcccccccaccacccatagctcttatcatagtcagtaacaaaatattggatattttcccctctatccaaggaaaatggcaaagatataataaaaagggtttcctatcaacataactgtgataatttctagccactgcagtagaaaaaagaaaaaaatgaagtaaaaaacagataaaaggggaaggactgaattttctttgtttgcaactgacagcattgcctagggagaaattctctgaaacccacaatgaaaactccttaaatgttaaatgatatcagcaagatcatagcataaagggtcaatacacagaatatatatagaatatgaaacaaaacaaaaatcactacaatcaattacctttagcatagtcacaatataaatattgagatatattcattattctaaaatgttacttcaaatatgcatggaaatgtcagagctactacctcaacttggaagaatcgtttgcagccctgaagcaggatgcttggtcatgagatgcaggggctgagacagcacatctactgtcttcatcccactggtttaaggtcgctgagctcaactctatcttgaggtcagtgatgcttcttatccccaactgctccacacaaagtcttcaatctcatgtctgtaatgctcaaacaggttgcacgctctcaaatatttctcttctacttcctgtcattattt

SEQ ID NO: 1466 - DNA, 1991 bp, Mus musculus
ggatccgtgagagaggctcgccctgcagaggacccgggactaagagggagccgcagcgccagcgccagcgaggcagggaggtggatcttagtgcgggaagctcagcgaccctcttcaccattgaaggtgtgcatcgctgggctctgcggagcttggcgggaagaagaggctcaaagcaacaggtgcaacctcaaggcactgaaagcaaggggacgcagctcacaagggccaagggattgaacccataaccgctcagaagattctccgcctgcggagagctgcggaggagtcccacccgtccagcttgctgactgcgagcagtgagagtcgcctagacccgtacctctgtgttctggagcctgccgcccccgcacgggaaaggcttagctcgggacttgcagcaccgcctcctctttagccaggccaggcacgaggatagtgtgatcgggcacagccagggtcgctcttccaggctttcttgcgggttgcgggaggtactagttggagacgcgcgcgctcgctctcgccgctctgtcctgggccactccgtgatcctaggctacctccagagccagttttccctggctggcacaactctccagggcgctccggtccgttgcacagcgccccaagggggtatcccagtaagtgatggaactggctatggtgaacctcagtgaagggaatgggagcgacccagagccgccagcccccggagtccaggccgctcttcggcattggcgtgggagaacttcattacgctggtagtgtttggcctgattttcgcgatgggcgtgctgggcaacagcctggtgatcaccgtgctggcgcgcagcaaaccaggcaagccgcgcagcaccaccaacctgtttatcctcaatctgagcatcgcagacctggcctacctgctcttctgcatcccttttcaggccaccgtgtatgcactgcccacctgggtgctgggcgccttcatctgcaagtttatacactacttcttcaccgtgtccatgctggtgagcatcttcaccctggccgcgatgtctgtggatcgctacgtggccattgtgcactcgcggcgctcctcctccctcagggtgtcccgcaacgcactgctgggcgtgggcttcatctgggcgctgtccatcgccatggcctcgccggtggcctaccaccagcgtcttttccatcgggacagcaaccagaccttctgctgggagcagtggcccaacaagctccacaagaaggcttacgtggtgtgcactttcgtctttgggtaccttctgcccttactgctcatctgcttttgctatgccaaggtccttaatcatctgcataaaaagctgaaaaacatgtcaaaaaagtctgaagcatccaagaaaaagactgcacagaccgtcctggtggtcgttgtagtatttggcatatcctggctgccccatcatgtcgtccacctctgggctgagtttggagccttcccactgacgccagcttccttcttcttcagaatcaccgcccattgcctggcatacagcaactcctcagtgaaccccatcatatatgcctttctctcagaaaacttccggaaggcgtacaagcaagtgttcaagtgtcatgtttgcgatgaatctccacgcagtgaaactaaggaaaacaagagccggatggacaccccgccatccaccaactgcacccacgtgtgaaggtttgcgggagcctcccgacttccagctcccatgtgtgttagagagaggagggcggagcgaattatcaagtaacatggcagcttattctccacagcaattcctatcgatccaactacattccacagtggtaaaaggacgttgattgttcagggaactcgtgggtctactgaagatcattttccaatttcattttactctataattgtatatatgagacaaaagaaacttctgtatagtttctagctctcaaggaatgaaagtcctacagcactctgcaaatgttttgat

SEQ ID NO: 1467 - protein, 339 aa, Mus musculus
REWERPRAASPRSPGRSSALAWENFITLVVFGLIFAMGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGFIWALSIAMASPVAYHQRLFHRDSNQTFCWEQWPNKLHKKAYVVCTFVFGYLLPLLLICFCYAKVLNHLHKKLKNMSKKSEASKKKTAQTVLVVVVVFGISWLPHHVVHLWAEFGAFPLTPASFFFRITAHCLAYSNSSVNPIIYAFLSENFRKAYKQVFKCHVCDESPRSETKENKSRMDTPPSTNCTHV

SEQ ID NO: 1468 - DNA, 57243 bp, Homo sapiens
ggtggcgagacaaaggcctgtcattttcatccctaacttttcctattttactggcctatgaagtctgggaatccccatttagatgggaacgatgcaaatacataaaataagccaacagtggcgactcacggcaggctaagcctccactgcatgtcttagagcttattgttgggaaaccctcaagttacctgagggatggtaattttcattgccttctgtctcatttaagatctgcttggacgtgatgtccaccagatattttgacagaaaaaaattatgtatttatttagagacggggtcttgctctgttgcccatgctggagtgcagtggcttgataatagctgactgcagcctcaacttcctgggcttaagtgatcctcccacctcagcctcctgaggagctgggactacaggtacatgagaccatcccagctaatttttaattttttttgtaaagacaaggtcttgctgcgttgctcagggttgtctcaaacttccagcctgaagccatcctccccatttaagatctgcttggacattttattaaaattccctagtgaaattatatttggatgatcccttaggtctaatgttttgagatctctaataaaaggggacaacatttaattaattgtagtgaaaagaaggatagtatcatctcatccacagaagtccaccgtgttatagttaaattgggtagtgtgattgccttcgtggagaaggtgatttctgcgttatgttttattctagttttattcgttatgttttcctatggcatgctctggattactaactaaatgcatttctgttggcctgaaaacccctggctttagaacaaagttgcaaacccagaaggtatcaccagcgagcctcatccaatagcctcagaacgcccgcgctctgcctccggttgcggctgacagccgccctccgtgggtcaagccagcgtgaaaagcgctgagttcaggcacagacagcggcctgcaggcaccgtccctgaaacgaggcggcagggccccctgaccagaagcattggaagcacaaagattcatgcagggtggtcgaaaccaaactcaacaggaagagcaacaggctcagcctcatcccaggctccgcagttgagcaggttccatggcacaggctgggagcacagcgagcgggatgagcgatgcactcacggtgccgcagggcatggggagaaggacggtttttcggagagggagtaacccgctgcccactgctcccctgcgtgtgccagaaaggcagcagcggaacctcggcctgtccgtcctggtttactcagggtgtggggtgtgcctgggaacccagatgtttgtctctcacacgtgctggttttgatggaagttacttgtgcgatgtgatttccacggatgcaggggaatggagcacgagaaacatgctctaggtaaaaaaaaaaaaaaaaaaaagtatttcaatagaggacagtgtccgctctgtcatcaccattctactggagacagtcaggtatggatatttgattcctgccatgttctgattagagcaagatgagagtgggacagtttcctaaacaagcctggagccgttgcacggtgagcttcatactgttggaggtaacactcggacagactgtcgggtgggtgttgaatgtcctggagtgtgggactcggcttttgttcatgtttaacagtcattaacgtatcgatgtccaggtggctatggtgcaccaagaccgctgagtgcactcgaggtccctgtggctgcaggcgggggccctggctcagctcttggctcccgacagatcagaaagcctctgggtctctcctggtcagccctccgtgaagcagctgctagccacagatgcgtcagccatcgattatctgcagttcaattttaccctgagaggaaaagcctggctgcagtgaaagccactttgggctggagaagggctggtgtcagacagctagaggtgggggatcgcctgcgtttctagaacatacggagggagtttaggcaggagtgaacggcagctcctccatcaatcccaccttaactttgctaagtctcagtttctggtatgaataaaagggctactaaaaccacccgcctcggagagttacgagaatgcacacatgcacctcccaaaactcctgcaatctgctcaggaatgccctctctgccactctctgcgggtgctgtgggtggaaggcagcgtttgtgggagggtggcatggggaggacacgtcacccaggtcagtgtgctgctgcggaaaggagcctggggttatttcaggtaagaatagaaatgaatgctcccatctcataaacacagaaacaggcacatctgggctcagcgacttgctggagcacatcggctggtcagtgttgggactgaggtcggcctccaaggtccttccctgtggttctgcccagacctccggccctggcctcagccccaccctggcgactgcaggccctggcgctgccacgacggccgattctccgtcgcccacatgctttgatttgctccaaggaaactgcagagcacgagggcctggggcttgtggaaggcggtcccgcttggccatccatgtttcatctgagcaacacatccaaaagcataaattagggtttggactttaggaaaggataaagcagaaaagtttaattctgtattctggaacttcagagccatgctaaatggttttatttaccatattagaaaactctctgcagaaccagaaagagtgaaattttgctacagaaattaatttctaaacagaattctttagaccggggtatccaatcttttggcttccctgggccacattggaagaagaagaattgtcttgggtcacacataaaatacactaacaatagttgatgagctaaagaaaaaagtcacaaaataactcataatgttttaagaaagtttatgaatttgtattgggctgcgttcaaaggcatcctgggctgcatgcggcctgtgggctgcaggttggacaagcttgctttagaccatgggtgtagaggctgacttaaaaataagtatataaaaagcagcttaacagctatcatgccaaaatctaagtttttctagcaaagaagagtggggggtttggtgtctttccttttggagtatactccagtaaatatcagcatcttctattagcaaacgttcaatgcttgttggacatctgtggaggccccacaccatcccagatatgttagagaataaacagagcctggtccctggccctcggagaggaggtcacttgactggagagaacaaagcaaatatgaggcgattagaagagaactaaggagtgactctgtggtactggagggtaagacgcactcggagaagggtgtctgggcctcccagggccagcctccccagggtggggacctggaggcagaggcagcagcgtggccattgttgagaccacagaggtcaagggcctgcagcattgcacatggcgccacggaggagaacaagggaacccaatggcagagagaggagtgtgtccttggagctcatagaatgaggagtccgtgcaggcgcatgagttaggagccttgtgttgcaaagccctttacggatggtccagcggttgtgcaggcagtggaacccacgaagggatcctggagatgagggaattagccacgatgtcgcagtgagagccccagcagaaagcggcagcaagcaaaggaagcggggggttgtggtcacataagaaatagtccaaaagaaggagtggcaggacctggcgacgcttgtgtgctggggatgagccactggaagcagccagtcacactgtaaaaatgaggccacgtgacctttcattaacaccacctcagtggaagatgagcttcctcaggtcatgacgcctgagtttctttatttagtaaacgctatcccccacatatcacagctgcgtcctgctgtgcatttctgtgcctcagaaaccactcggagatacatgatacccctgttgttgctcacagatggtcagtgatttgaatatcaccaccttctaaaggccagcattgtcctagcaataagattagggtgtggtgttgttgtttaaggaagttttcctgcaattgcagaaatcgattaataccacagaaaatattataagtacatattttggaaaatgtagatctgcatgtttcactaattgtgtaataatgctctgctctataaatatccaaatgtaaaagtctgcattgggatttcgtttgactgaaggcaatattaacgactaaactgcactcgcccctaccaaaaacgctgcacatccatagatttagacttcttcgcatacttcttatgtgttgggagaagctactttggggacaaaaatgcccttctctgtgcctcacaaataactgcattcagggacacaaagcccaactgttgcaaaaatattagtattcagatgttcttgtgttttgttaatgcatttaattatgtacaatatagctattgttttcctttcacatttgcattaatttatattagctagagaacataaagcacagctataaaatcagactaatcatttctgttgttcttgcaacctataaataagcattgcaccctgcaaaaactgcagctttgtactgaccacagtattcttcacgttgctttttcaaacactacagtgcaatgatgtacttaataatatgttataaagcttagcgttcttacatagttgaatttcaccagtggtcatggaagaacggtgccaccgaagtctcccgccccacctggtcctgccttttccgcacttgtcctggagcaggtgacctatttttcaggcacagggctcagccagcacagtcacactggcagccgtacgcaatcccttgggtgcatggacgagaccaccgcgaccctgggttccaactgctggctttacactttgctgttggcaaacatctgtaatgtatgtgagagcaggttaacctgccttggaaccaggtcttatgtggactgcatgatacgtctcacttacagggcagtttctcaacccagatgattttgattaaaaaaatcagaagcactggaatcctttttccaatgagcgagagttgtaagtgtgcaaacatccacgactatcagcagcagaaggaaagcaaccccacctcactcctcccatgccaccacccccagaactggtgccctcccctcttcgcatcccccagatgagacctcagtgctgaaggggcctgtgtcaccgtgcgttctcagattcaaaaaaggccacccgctgcagttggccaaagaccccgggaaatacactgagaaataaagaaaggagctgcattggagtccaagtgctcatgatggcttaaaagtagaggctgggcacggtggctcacacctgtaatccaagcactttgcggggccgaggcaggtggatcacgaggtcaggagttcgagaccagcctggccaacatagtgaaacccagtctctactaaaaatacaaaaaattagctgggcacagtggcaggcgcctgtaatcccagctacttgggaggctgacgcaggagaatggcgtgaacccgggaggcggaggttgcggtgagctgagattgtgccatcacactccaacctgggcgacagagtgagactccatctcaaaaaaaaaaaaaaaaaaaggtgcatcttcacaggcattgttttatctacagcatcgcccaaggtcagccacctgggaggctagcaggctgtcatctggcttagtcaatagtgctattaatgcaagaggaaattgcatttttatttaaagtttctacaagaattgctgaacctgggttccaattctggtggtgctctgcctgtttgcgtgtgtgtgtgtacacgtgggtgtgtgtgcaccagagcgggggtcacctaaccttaccaagtacaaacttaactcaggtgggaaatgtgtcagtcccactctccctgagagctgctgccaagagacgtagaatcttccacccgagaggctgctcctacggcttcatcttcagagctgctgataccaaggctgtacggagcggagggtggaggactctttctcagaagacaacactcttccagacatttagtttaacaacttaacatcccccaagttatgtgtcttctcagtccacgtgaagaaatgccctcaaagtatttttagtgtgaaccaaaccacatgagaaacatcttttcctcaccaacgtctttatgactttcctgcctcttagtaattgtgcagaaaagagttcacactgcagcctggagccgtccactcttaggcaggcctgtggtgagctaggtcccggggtgtggtctgggaatgcgggtttccagagtgctcccacccaccatgccctaaccgggagggtggttcgctgtgccggaacagctgtgagcaccacatggtctgtgcagaacagcgcctttcctctgaaggctggaatcttggtggcaccaagcgaggcagcctatgagaccagccccgagtaaagccctgggaagggtctctaacgagcctccctaacagacagcatgtcacacatggggtcacagcatgtgctgggaaattcagcctcccatgtgactctgaggaggggttcctggacttcgccatgcacctctcattgcaatgagtcatagcagtgacaggaccatatcctaagtcccgggagctctcctagcaagtcagggaaactggaggggtcacggggaccccagggcagttactgaaagaggtcctttgtggaaaccgacgtagaagaatatctgtccactgctcactcttggtcgcttggcaggcatgcattctcaactgttcgctggttccctgtctacaccttccccaaccaggccacctgcagccactctccccactcccccaccccaggccagagacctttctttccttagtgtcccagccagactcccagtccctgtccctctcccaattgctcaggatggaagccaaggtgcccccggcctctgggtaccaccatctccatcatatccctccacagaggccgtccactagaatcttccctccccaggccccgctgctccccaaaccaagccctgtcttctcgccacatagctgcctgctctgccctttccacagtctgttcacagccatcaaggctgtgatacccctgctgttgctcacagatggtcagttccctgcacaggccctcctgcctcccaggttactgcctggcctgggaggttctcagcccggccatcctcctggacccagaaccagcatggccgctctcctgctgcttccgccaccgggagccgattccgcgcaggcttccagtgggggctgccttcccctctgccagaagcaccctccccaacttccccaagtcctcgcagggcccagactctcatcttgtcctgtcatttccgcaaggaccttcctgctgacccaagccctctctgctttcctgttctcttgcctgatgtgaagttgcacattgcatgagttggggctgccaagacaaattaccatatgctgggggcttcaaactacaggaattcttctgtgaccattgtgaaggccagaaagctcaagttgagatgtctgcagagccctgcttcccccgaaggctctacaggagaatttgctccatgtctcttactcctggtggtgccagaagtgcttggtgttctgaggtttgtagatgcccccctccaggctcctcctccatcttcacacctctcccctgtgcatctgtggctgtgtccaaactgctctcttcttacaaggacaccagtgattggagtagggcccaccctactgcagaatgacctcatcttcacttgattccacctgcaaagatctatttccaaataaggtcacactcacaggtacagaagttaggacatggacatatcatttggagggatactattcaatccataacatacattttcacctgctttccccactagaatgtaggtttcacgaggacaaggacctcgtgaattacaatcactgtaactcagatatttagaatggtacattacacctatttggtactcataaataatggatggatggatggatggatggatggatggatggatggatggatggatgaacaggtaggtaaatagatggatacatgagtggatggatggatggatggatggatggatggatggatgaatggatagatggatggatgaacaggtaggtaaatggatgaatacatgagtggatggatggatggatggatggatggatggatggatggatggatggatagatggatgagtggatggatggatgggtggatatatggatggatggatggatagatggataaatgggtaaatggactgatatgtggatggatggatggatggatggatggatggatgagtggatagatggaggggtggatggatggatgaatggatggatgagtggatgggggatggatagatggatgggtaggtgggtgtgtgtatggatggatggatagatggatggatgggtaaatggactgatatgtggatggatggatgacgaatggatgaattgatggatgcatgcatgcatgagtggatagatggtgggtgggtggatggatgagtggatgggggatggatggatggatgggtaggtgggtatgtgtatggatggatggatagatggatggatgagtaaatggactgatatgtggatggatggatgcatgagtggatggatggatgagtggatagatggaggggtgggtggatgggtgaacggatggatgagtggatgggggatggatggatgcatggatggatggatgggtaggtgggtgtgtgtatggatggatggatagatggatggatgggtaaatggactgttatgtggatggatggatgaatggatagagagatagatggatgactggtattacaggaatatgtgagtgaatcctgttttctgtagataagtaatagagtttggagaggaaactaactaaatgatatttatttaaacctaacactctaacttgaaagcaaaatggattcattgcccttcgtgacagaaatgtggtattttttggagaaagctatgagatgctggtatacaacatgaaatatctcaatcccacttcagatttctaattgtttctgcttccagaggagaagccaagtcaaaatgtcctgaataagcagttctctattgtgagaggcctcttgtggaatctgggattgaaacaattctaaatgccccacttctttcatgcatgaattgcaaaaagatgtggcaagttttgtttctaccaagaaaactaaaaacaccttttgtcaaataaatgctccttgcatatttaacttatgcaccagtggccttttaaacagtcaatgtcccatcaaggtgcctgcacatctgggctctccgggagcagccatggcagcacccgggaagaaacgctgatgtggctgctctgcatgctcagatgacttcatcgggaagcctgggtgcattttacgctgggtgccaaatctcgagtaactgaggaattcccagagccttctgaaacacagagctgcaataaggctgctccatccaggttagctccatcctaggccaagggctttatgaggactgcacatattctgtgggttttataggagacagctaggtcaagacccctcagagaaagctgctttgtccggtgctcagctttgcacaggcccgtattcatatctcattgttgtttgcaggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcgaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaattgcatgcgaacttctttaatttgtcgtttttggtttggttgcccccaccacgtcagtgtgctgtgttgccggcatttttgtggcctggtgacacagctggcaggtaagtgtgagcacccgagctcctgcccttctgtgtgggaaggtcacagttgctcactcatctgcttttactacacagagacattttactgtcttctctcacctgacctgtgcttctgtgtgggaaggtcacagttgctcactcatctgcttttactacacagagacattttactgtcttctctcccctgacagttcggtgttctggtctttctatggtgactattctgattctgcctgaagtttcttgtgtttctctcaaagcatcatcccgcaaatgttagggagggtggacgctgagcagatcccactggcaggtgctgtcatggacacagcccgccccaccagcatctcctgaatgaacgtgcacatgggtgccagtgcccacagggccccccgggagctcacacacaacgggggtcatgggaacctcgagacactgaaatgaggggatggtgctggctctctgaaagatgataatgagtgtatgagatgaagctgaaacttggggtctttgagaaattagaaacaagagtaaagataagtgattggcttggatgcggtcctgcctttcatgtcccatcagaccctcgtcttaactcatctcctccctttaaactcatttgcattttaaagcattcatttctctcatcgttgattttcctttgataaaaagtctggacatttgataacaggcaattctgatcggtgaattaggagcttggcttgacatctgagggaatagatcatccttagaaaaaaacacacaatagcactcgtgaaaatcacttagatattgatacaaatttaagaagtgtggacatttcctatcaaaccctgattcaatgtttttaaaagttttttcctttatggctatcagcacactcttaatgctctgaaatcatcctacttcataaaaacgtagtaaaaaagaagaaacagctaaagaacactgaactctcttgagggagccccatacaagcgggcttagcacacacaatttctcctaagaggctattcttgcctttcgtcttctctggcccttgcatttgtcctccctcttcctggctctgggagtggcaggcagccggggttacaggttgcatttcctgaaaaccatcagtgggatgtcttatggctaccccagccacctgccttccccatgagtagacggggagtcagtagaggggcttcacgccagcccaccagagccacgagaacatgcctcacagtgatgatcttctttgtgaagaagagccattgtaggagatggagggaaaattaatggaaagttcttcgcttgttggccctgtacatagcgtacacttgctcacgctcatggacaccagctgatgggagtcactgcttatgaggacagccaagtctcatcagcacagcaactcccgcaggcttatccacggagacctcctctaaagtgaatactcaatttacttacctttaatatcatgaattaaagtcaccagaaattcctgctaacctagaaatagcctctctcatgcagggagaatccatcaggagacgtacagctaagcacacactcaccacagatttgcctctgaaaaccccggtgtgttcactttccataatacttctagaatgctcccacattcttcagtgtcggaactactctattctcatgcatactcagctgctaacctggttaaaagaatccatttcatctgcagccaatacatctcctgaaacctattacgctgatttcatctcttgaccactataagtctcctctttctcttctctctctgtcttcattttgctgtagctgatagtcaagaaatagacatttcttgcagggcacttaccttggtcctataataatagtctttcaactgcagccctcaaagttcattgatatagcagatactctcgtgtaactgacaaagataatacattaagttaggagctaatgctacttaggaagatttgtagccgcagagctcaggtgaatgcgtagctcctgctcctgctgaggaagattaacttcctgcttatgttaaattcctaaccttcaccagtaccaaggaataatgtcagcaagaaaatcaactttaagtaattggctaaagtgattttgaacactattgctcctaaaaattatttcctcatgctctgcagaaaatcggaaaaggtccgtcctcggttcactgaaccttcacagagcagaaaaagtttcaacctgtaaatccaatgcagaagataacacacttgctataaaagaaaaaatacaactctgcaagtaaagtggaatgtaaaatttatccattccatggtagacgtcaaaaaacccttttagtgcactttgctccagactgggaaaggccttctgcactggatcctagaaatctttcacagctggtgcctgctgccatattaagaactcttggtcccattgtttgatacagggcctcagaatagactttggaggagagaattcttccctaaactttccttttgctctcgatttcctgagtccttcagggcgcatgcctgccctctgacctcccatcacctcttgctcttccttccatcatccatcatctgcacatgccttcttctctccctgtcgtccttcatcctccaccccccgctcactcctcctcactctgggctcttgccaagccagctctagaggagatttgctggaggactttggggcattgccggcggcgcccacccggactcacgcagcccactctgtgtcccccggcaggtaccctggctaaagccgggccggagccctctgccctctcatgcccgcagccagcctgggctgtgcaacatgtacaaggtaagacgccggcgggtcctcacccatcggggccaggggtgacctgccgtttcctgagctctcagccactgtccctcggggcaggtagtgtcactgccaggggcccacccccagcctccggggcatctgtgaggccgtgaaagcagggaggcaggcctcccccagggaaaagcagctgcaggaagagacaaatgcccaagaggggcatggaggacctgcctttgaatccttggagggaatcctctgcaaagggtatggctgtcagctcaggatgatgggcagccttggtgagagtctgcctcactttgccgaggcctgaagtgcgtggaggggcccgggagtggctctggtattgagggctggcctggtctatggccacgtgcatacccgagtttgctttgaaaactagtgcctagcagacatttagtactcactaaacatgggttgaattgagctctaaacgatgagtgtccttgggacgtctggtctctctgggctctgtcctcacctgagctcagctgggctctgcataggaagtgggctatcgctgtggcctgtcctcttctccttgtgtggctgccacggcttctcaaagcacataggtgccaggagcactcacaaagaagaggacagccaggaggagaaggggaaggggacaagcccagagctggcactgccgtcaccgtgagcagggctgccgtttgcacactaggagcggtcaccacaaacctgcatccaccaggcccccctccagacccaggccaccaccgtctgcaccgtggcacctggctttttaagcatgggaatgtgcaaaagattggaaacagctgctcaagtacctaaatagcgagaacatttcacagctatgctcaatggcgcaccaagtttgagggagagctggggtacccctcttcagaggccggcaaggggggaccatttacactcagcaaggagcacaggagcacgggggacaggacgcctgcggatgccaaaacttggaggccctgaaggggaagcgtccgccaggtgcggctgcatgtcagacatcatgctagtgcctggctgtccagggctgcaccgccgcgggccaggagtaggtttatgaggaatgaggatgtgcctgctggccccgggatggccagtccaggcagtggctgaaagtgcagcagaggaagccagggcttgggggcagaagggccctgggggagccggggccagacaagggccaggtgagagccccaaggtggtcgtgggacttggagtgactggcggctgcggctggggagaaggatttcttcctgaagccacaggggtggaggcaaccatgcaccctgagggggtctcagtggtttggaagcccatcctgagagtctgtgtttaacttgaatcgtgtcctggttgtgaagccgcacttggttttcgagggctctcttggtgatggaaaacaccaccactacccgcaggtagtttctgagggtcccccgtccttctgggaggcctcttctctggggtgcactggggctgtggccacctgggcttcactgagaccaagatggggctgcatgcaccagcccctgcctgggaggcaccgaccctgccggccccgccctggagagcagtgctggcgagaaggaggattttcactgtgtgtgcaggaatatctgatgtgtgggaggggtgagctaagggtggcacagcacccagtgtgtgacgcgctggcaggtagcggcttggcccctaccccgttccctgctccacgagaggcacgctgtcctcagtggaccctggccacagagagatggagcctctgccagaaaccccgtgtagccaagcagagtggagaggatgagagtcccaggctttggtatccagatcatagtaagaaactcaacagaatgcttcattcctcttctaaaaaaaattatttagcagggaaaagcagcccttctgttctccacagtttcatcctagacaggttttgcatatacctttaaaatcctggccaaagataagtaaatcctctacacaacgctttgtccacgtggctgcctgaggctcacactccaggacacacgcggaaaggtggttaaaagtctgcaggcttccaggactcagctccttgtgctcagcacttgtgcacttgtggacaccccattctggtccagataggaaaagcagtaggggtgtgtgtgcgtgtgtgtttgtgtgggggtgtgtgtggtatttacatgtctatggaatgaagggaaaatgaagataagcgtaagttgaaactaaagcctgggcaggctgtgtgggctcccagcgttgctcttaatggacagagaaccctcccagggatgcgtgctagaggcctcaacttctccctccagccccctgagcaggggccggcgatgcctggctcacagaggccatctctgcaggaggtgcacacagagggtgcaggcgggctggtctgagagcccccaggggtgcccctgcccgaagacggtggcaatcccacgccatttgcatattgagtggaagaataagcgaggagcttccctctctcgtccctgagaaggagcttttgagttagaatgccttcctccggtactttgggatgctttattattgcaagaaagtggctgtgagggcaccagccacggaagaaggaattgcaaggccggaggcactaaatggttttaaaatacagagggattttaaaatgcagggattccatgacaaaggacccttgaagtcagctcccaacggagacagaagcagctgggtggaaggctcaggctgagcagtgccaggaaccagcagagtcggaaccaagaactccctgccctgcggctgagaaacgcgagctgaacagagggcctccgcctgggtccacctcaccctgtgtcctctccctccctgtctctctgtctgtctacttccccctctctccctccctcttcgtgtctctctcttcctcttccctctctctctctgtgcaaacacaccaggagggtaagggagacaccccagctatgaaataggcaacaaggcaaagaacagcctggctcccgtgctgcggtgccccctccagcacgggaccctgctccgagctccctgactcccagagacaccggtgctctcggggctgacagggctcttttctttgaggactggaaggcaggcagcgggagcacagtaggggaatattgcgacatgcgagaacccaaaagcaagctggggaagcaaggattctgaggggagaggagcaacacgcacgatggggaatggctgcgtgggaagtggacccactgttctctgcagttcctctgtctgctcagcccctgcctgcccgcctgcctgtccatcccgtgctgcaggtccctggaacccggtgctgggcctgcactggaggctggagtgagggcgccagtggtgcagctggaaaggtggccccgggcagggcggctcctctcggccccgccaacggtgccagctcctccaagctccaggctcggcctggggcccaggacactgacctgagcaggaaggggctgctctgggcttccagcagccactgtctccgagtcctcggacgtcctttctgcctctttctcacagacccttgtgctcctggcctgacttggaggacactgtccacccctcagccttggcgcccatggaggcttctggaaagacctgccctgcctctgaatccaccatcacccagcacactggcgtttaggaagcaaagcattttgtgccatgggaaagcacaggaggaagaaccaaaaatgcttggctcaggtctcatggcactgcgtcatagccgtggacctggggcaggtgtctgtcttctctgagcttccttccctctcctgtaaaacagcaatggtggcaaaagcgtcacctgtcctgcagatgctttggaacgttgtgctgatcaagcaagaaaagcaatgcaaaggccccacaggagcctcgtcctctgaaaacattggtgtcatcataaccctgccccagtgccactccacactcgtgctattctggaagaggcctggccaccctcagagctgctggggagggcagtgctggctctaaaagctctgctggccctggcccctctgcccctcaaggctgtagctttgggtcctctgtgtttctgtgctggggccttagtttccgaaactgtaaaatgaaaatcagagcggtgaacctcatatcaatccctgctcccaccattctcagaaggaaatggtaatcaagcctcaaaagccccatggttggggcagctggactagaacttcactctctggccatcagctccgagtcatctgcgtttgggaaacagacgtctctgagcctcccccgtgggagaggagtccctcttgccatgaggaagaggaattttttccgtgggtctctcgggacaaggaacagagaccctgcttcccggagctgtggtcatgaagggtgtgctcctgcatggagacgccatggcaacatggtacctgggggcgggctgccatcaaggtgccaaccagagaggccatggcacagccacccggcggaaagcacacaaccattttaaggacttcctcgccaatctgacagcagctttcgcctctgacaggtgccgtttgtccacctccgttgcttctccctcttcggcacactcaccaggatgaggaagctggaacccggcgtcaaagctcttcctctttgaggttaaacccagatcagaaaaatgcagccactgaaagggtttacttaatggcagaagcacaggctgccgaactttgatttgttgtatccttctgtgcccagagccagagccccaatgtgggtcccacaaggtttcgtgccaagaggtctctgataccgacccctgtatcaccagcggacagaggcaaaggcccccaaaggaggccacgggagcttcacttccccatgaaacatgggagagaaaacacaaccagatatgccccgaccacatctacaaaagcagtatctgaatctctgcatccagcctcacagtttgctaagaggagaaacgctgatccttcctgtcatggggcaaagcaacaacctcccgagtagggcaccagaagggaaaccacacacacaagccacgggcgccagcggccgccaccctgcagcgctctcattcccagtatctgcaaggagctgcatcctctgcaaggagctgaggtaacagcctcaggttacctgaaatctgcatcagaacgaaaggcttgtctgtgaattttttcagacatagagaaaagcccgctattctggatggtgcacagctttctgtaaagaaagtaaatgcccgtgactttcattaactcgtgcgagccgatgattcaggaataaacataatcttcaacccggcaaagggcaaaaacacaggaaaaactgcatctgtcattcagacagaaaagaattctctccaaactgcaaaatctaaaatgccctgatcttgcttttaaaaaaaaatctaacatactctcctgaggcatggtaggagctgtttgaccagaaatcgaataatagcttccttgcggcggggagtggggggggacacatatatatatatgtgctttttttcagaggaagctattatttaactagtattgtaactagtatttaactagtattgaaaagagaaccacagtgttctgtgatttctcggaattgccagagcattatgaagtcagggggatggagagtaagaaaaggggagacagcatggcccaccatttacagtcggatgtgtcgtctcatctccagccttgcagactttgacacacatgttctgtccaataatactgatttcactggtgcctgttttagctgctgggccagtttccatgggaaacagataccatgaccctaagcttcagatagtttgcagggggtctgctgtttcccactcccaccggtttttaggtagaaaatacgcacgcattgaaacagaagatccctggagagaaaggaagatgctgcgtaggtgactgtctcctttgagcatctttaaggaggatcatttaatcacttaaacaaggtttctggggatgtcaaggatctctgtgagccacaaaagaagtgtgatgtagggaaaatggcagaaaaggtgcatctatttcatctagaactacattttacgattcctaattcaaaaaatatactgaagaagcatattatcactttcacaagaaaaaaattatatcaaatatacctctgttctttcttatcatggcagctcagaaaaacagtgacaccactatcttctgtggttctgaacaggccacacagattcatccctgagctctctgtctctgagttttttcagattaacttctgagctctctggtatctgcacttcctgagagtgccagaagaatcaaatattactctgggaggtaaaaagagtaaaaagcaaattcattcgcccttcactctcagggccactgctgaaaccgtcgaaatgaacagcagaggtcccgaatgccgctttgtggatgtgtgcaaaaacccgccacgtgcaacctggaaattaaaggaataaggaccaggagatatgttggttggttggttttcagtcacatagacaaaataggacagtccagacgatgccatctgtcagtcctgaggcatcactctccactgaaaggaggaactgatgggccctttgttttaattacatagaaatgcgtcttttaaaatgacagagaaaattgaaaaatctcatctcattaactacactggcatttattgtatccatcagtgtttactagaaaattagttcccaattattttggtaaacagcagcaattgaagcttccctcattccctagacactaactggcatatgtcattgactttgtctacagatactagtttatttttctcgtctgtgagcacactgttagttctagccaatagcttcataacttactacaaggtaagtctacaaattcttgtaataaaatacaatttaaaaatccgttcttctcccttcccttttccctttctcctatgactagccagtgaatttccccataggccgctgactttcaggtgggtaacgtgagcctctcatcctacgttcactccacaagagtctcgcttggcatgcagtctaaagttcaagccctagacagctagcagcctctgcgagcagctccctgaacctctgtgcatctcaatattcaaatctgtaaaacgagtggtgacgtgggagcagtgctgaatgatatttttggtttacgatcacacctcgtgttttaaaaccaagacgccttgctttctctattctggctttgcattgaatccttttggggacacagggaaaacatgtacattcctagaacttggaccacttacttgattaagacaatgcccataaggaaatccctactgcatttagccactggatggtagatgctgctctctgggcatattgagatacattaacaaagagacatttttctaacgtgtcattctgcaatgacatcatggaccacacgacaaagggaagaacaggtgcttgctaaggctccacagccgagtgctgatgggtgcatctctgtagcaaaggccctaatgggaggcccaggtggagagagccaggtgcatgggaccctgccgtggttgcctccatgagaacgcaccattccaggtttacgagaggccagaggtctccaggcggcaactccacatggagccaacttcctgtgctccatcccatcaggtgggaaaatggggcagatgttatcaacactcagttatttgacccacttccccaaaactggcacataatcaatacaaatggggaaacaaaatgtactgtgttaatatgtgtgatctgaaaggaggcagatcatctctaatgatagttagaagatgttccaacacgtggctgtgtcagtaagaacactatcatgaggggagggtgtagatgagcaggaactttcttacaggctttttttcttttcttttttttgagatgaagtctcactttgtcacccaggctggagtgcagtggcttgatctcggctcactgcaacctccgcctcccaggttcaggtgattctcctgcctcagcctcccaagtagctgggattacaggtgtccgccaccacgcccagctaattctcgtattttagtagagagggggttttgccacgttggccagggaggtctcaaactcctgatctcaggtgatccacccgccttggcctcccaaagttctgggattacaggtgtgagccaccgtgcctggcctcttacgggcattttcttaagtaagtcatccaagttctaggaatgcacacttctccttgtgtctccaaaaggattccatgtgaaataggagtagagacctccaatacctcgcccatctgttaaaactgcagcgtgggtaccctggcaggctcattagctgccgtggactgctgcggagtggctggagactgtcaggctacgctgggccgatcttctgggtaggtgtatctacacccgtgtatctagtgatttactctcctctggaagagaaacgcgggcacaccccagcctgggatggcaggcgaggaacccccaagccccagccctgcatggtcccacctggaggctgagatgagcttcagggtccgggacagtgagcggggaccctatgagtgggaaccgggtgggcggggacccggtgggcggggaccaggtgagtggggaccgggtgggcagggacccggacaggctcagaaccataaactcactaggtcttcacgtattgaccttatgatcgttgattcagggaagcaattaaattcctctctcagacaaagaactaagagcttgaactctttttttaccaactccaggcacccgtgaatattaatcttttttcaaattaattgtaaacatttcttctgagagggagtgactccatcaacgtatctcctttaataaaatccgagtggaaatgatgctgccaagaaatgccttggccctgcagccgctgatcttcagatgcatcgggcggcaactcatctgttactgcttcccagtttcagaacgcccagctccccaggccttaaaacaaattggaaagcaggggaataaaaaaacaaaaacaaaaacaaaaaaaacaacaacaaccctcttcctgatttctggagagaaacaggcggcgggcagcagcctgggtgctgtgcgcaggagctccgcctgctggtgatgggtatcatcgcaggttgaggaaaataattcttcaaaaatcatgcaatcaaacagcctaatggaaaaaggaatttcttttacaaataaatggccacccgtggtcttcctcccgtgattttaaaaacttttcagcaagttatttttatttaccaagcaaacgtttgtcattttgttgttgttgttgctctatgaatcgtgatgaaaagctctactgataggaagaggccccaacactgttgagtaaaacaagaaaactcagatgaagaaaacagtgtgtctagtatgatcacttttaacggcatttgcatattttgtctgtgtttttgcacaaagccagatctaacaatgtgctcatcaaagtgtaaaccagggtcatccttcggtggtagaatttttccacaaactttcttatttcatgggatatcttcatatgagcatgtattatttttctaaacaatagaaaatattagtttttaaaaatcaggtctttttttaattcttcagctgtcccaggtattcagctccaaattagccaaaaattttgcagaaatgtcctggcctcatctctagctggcaaaacacaggttgcaggatgccccccagcatctgagtctacatcacaaggtgcggccctgtgtccatttcttcttttatagtgcaactgacatcctagctcttcctcgcttttaatcacccacaaagaaagtgcagtacttgaaacaggttggggatggcccagaagacacaaatctcaatgaataaccaaaaatgttcacagttttggctttttttaaaccttagtgagtacaactaaaagtatatcagggaattactaaatgtgtgtcctaaaaactaagcaggccatgtgtggtggctcacggtggctcacacctgtaatcccagcactttgggaggccaaggtgggtggattgcttgaggccaggagttcaagaccagcctgggcaacatggtgaaactcgtctccactgaacaaaaattagccaggtatggtggtgcatgcctgtaatcccagctacttgggaggctgaggtatgagaatcgcttgaacccaggagcgaggttgcagtgagccaagatcacgctactgcatttcagcctggacaacagagtgagactgtctcaaaaaaaaaaaaaatacctaaactaaacagcaggaaccctttctgtcctagagagctgaagttcagctctcagttcactttcaggatgaccttatacgtcacaagtgttcctggggccgcagctcagagcttctgatggggttgacgggggaagcggaggttgcgaggctggcccaggccctcagcggtctcctccgggaaggcttgagggtgcgccacccgcttcagcgtcccccatggctggtctgtgaagtgacttgagttcaccttcaccccctaagtgccccacccagcttgcgtcttcccctcacctcctcccgttgtttctttaaggcctagcatcttctcccagctcctcccacctaggaacaggtaacctgtttatcataaggtgtgacagaatgataagtgcccactccccataaattgaaaaaccccccaaaacactgctcttaaacccccaaaacactgctcttaaacccccaaaacactgctcttaaaccccccaaaacactgctcttaaaatccgctgacaccttgcatctatcacatttcctgcaccactggaagccgtggagtaggtggtgcgtttctacaattgagctgagccgggtttgtggtgagcaaggggctgtggggtcaacgaggaaggagccaaggggctgcatgaaaggactgcagacccagatcatggccctgcaaccagccacccacaggagagcggggcagacacagggctgtacttctcagccaagccaccctaacactgtgtgtacgtctcatctcataaatgtaaatgcacgtcgaccttcaaaagagcagcaatgtcccgatgccgcgtgctgctattccttcaaagaataagggaacctcggcagcttcacttcaggctgttggggaaaggagggtggggcgttcgggcatctcttctgcgagtcacccgagggcatgggaatgtcatggccaaatcagatcagcgtggctccggggagcctgggtcacttcaaaggtgactgagaactagagccagaaggtggaaacaacccagaagtccccggaagggtgaatggatgagcagaaagcaatccgcgcatacggtgccgtggatgtcgttcagcctaacggtggaaggggattctgacaggggccgcagcacggggcgcctggagggcactgcggtaagtgcaccaagccgtccgcagagaacagacgctgcaggctccatgcacaggaggcccctcaggtggcccgttcatagagaagaagtgacttgaacgctggggccagggatggagagtgagtgtttcatgggggccaggtttcagttcgggaagctggagagggtgtggagatggatggcggtgatgctggtacaacagtgcgaatgtgatgtgtgccactgaattgcacacttaaaaattgttagaatggtaagttttatgtgtgtttcaccacaataaaaaaattactttttaaaaagtggctcaggccgggcgtggtggctcacgcctgtaatcccagcactttgggaggccgaggcgggcggatcacgaggtcaggagatcgagaccatcctggctaacacagtgaaaccccgtctctactaaaaatacaaaaaaatcagccgggcgtggtggcggagcctctagtcccagctgctcgggaggctgaggcaggagaatggcgtgaacccgggaggcggagcttgcagtgagccgaggtcgcgccaccgcactccagcctgggcgacagagcgagactccgtctcaaaaaaaaaaaaagtggctcagatgcagcatccgtccacgcgggccacgcagtcccctgcccgaggtcgtcaccagcctgacaccgaggcgtgctcctgggcttttcttcccgtgctcagcacaaaagctctttaggaacataaaccaaaacccaggtctggagtctccggaaacaaccaatataaaagctcaccagaggctgatctcacacgctttgccgcttttccaaggtggcttctcagtaaaattctagaaccgaagacttggagactctctgtttcagtcccatcatttcacccgcgaggaaccagaagccccagggccccaggggactcgctgaaggccacacaggtggcgtcaggcccgggctggagcttcccagctccctgcagcaagctcttttcacaaggctgccatggaaggcttttgttcctctggtcactttctatttgctgagctccaccttgtgagtcaaatgccgggagctttggggatcccacagaagtttttcttttttcctctgaaagattaaaatctagctggagagggaagatgcttgcagaaagctaaaaaggacaatccaatgccagatgagggttgcagccaaaagaggctatattttcccaaaacagagacatttggagggggaggacgctctaggcaaaggtcggggaggcagtaggagccccgaggcggaaggagaggccaacactttcaggggagacctgagactgccaatcagaaaatttgcacagtgatacgatgcacccatgaattccatctctggctgtacaatgacagctcatgttaaatggccttattctatattctatttcacaaaataatgaacaaaatgggcttgctttgggggtacacttctatgagttgtgatgcacgtatggatttgtgtagctagcgccataataaggacacaaccccaaatcctcccacgtccccctccctcgtggtccacactgcaccctccctccactccctgccccccagctctgacctcccccaatataggtcagccttttccggcatgtcatataaataagaccacacagtatgaaaccttttagaatggcggcttttactcagcaagattccttggagaggcctctaagctgttgcctgtaacaagagtttgtatttttattgccgaacagtatttcatgcctggatacagcacagtgtgtttatcccttcagcccctcaagagcattcaggttgtttgaaggttttagtgaaatctagtgggtttagctgctatgaacattcatgtactggttattgtataaacataagtttttattaaaatttaaattacttttccctcaaaagattggtggccaatatattcattatagaagccatttccaaaagcatgtaatttatcctttagtatttaaagcaggaaatggaattacagggtcatatggtaagtatagggttaactttctaagaaactaccaaattgtttcaaggagtgacagtttgcgttcccagcacttgggaatgttggcattttttatttcagccattctaacggtgcggtatcccctcgcggttttgatttgtgttttcctgatgctaatgatgatgctgaacatcttttcatctgcttattcaccctccctacgtcctctttgctgaagtgtttattcaagggtttagtccatttttaaaccaaattgtttgttttcttctggttgagtcttgagagccctttacagattctgctttcaagtcctttgtcagatacgtaatttgcaaatattttctccctgtctgtagcttgtctttttcttctcttgatggtgtcttttgtaaaacaaaagttttgaaactttgatgaggtccaatttatccattttttccttttatagatgatgttttggtgtcaggtctaagaacttgtctactcacaggtcatgaaggtttttctcctatggctgcttctaaaattttatagttttacatcatagataacgatctatgatctattttgagttaaatcttgtgtaaggtgtggattgggttaaagtggtttttcgtggtcgttgttttttttaacatatggatgttcaattgcttcaatgctgtttgttgagaagacagtgttttccattgaatgatctttgccaggaatcggctggtcagatttgggtgagtctatctctggactccattctgtccattaatctaggtgcctgtccttcctctagcaccacaggtcttcagttaccatggctgcatagtcaatcttagaaccaggtaatgtgtttttctcactttatgtgtccttttcacaattgtttggctatttttgctccctcggatttccatacagttttagaatccacctgtctctagctaaacaaaactttgctggaatttgatttggaatttcattaaacctgtagatcgatttggggaaagaatcaacagttttactatgttgagtcttctaattcatgaacatagtatgtctctctataagttcactttgatttcttccaccagcattttctagtgttagctttaaagttctgtacatttttgctaaatgtatacctaatattttgtttccttgatgctattatatgtaataatttttaatgttttttaattgttcattacttggatgtagatatataattgactaaatgtccttttagtgataggtcattacaactatggtataacaatacagatataagactgcctcaaattatctaggcaactgatgatttatggctaaaagcccaagtcaaagccctagttcagtcactcttcaatgcatctataaccaaaaaatgtgtatgatcctatgaaaattattccattcactgaagaccagtgtcagttctgtattaaaagtgaactaaacagcctacatgttaattcaacaaacagttgctgctcactgcattctttgttctgtatgaggaccaccaataaaccaactgcctttttcatagacatttctgacccccgataatagctccaagagctcaaataaaacctaccaacatcatgtgtaccttaaaagatttaaactaccttttcctcaccagtgtagtgatcaatatattcattataacagtcaccttcaaaaatatatcatttttcttttatcattcaaagcaagtattcataattcacatgtgaagcattatctatgtaatgctccgttgaatctctgacagcatggtaagttgtaaaatcctctgagatctgcatagcgtgactgagcattcatttctttagaaacctaacctaaccctaagttttttctttagaaacttaaaaagtttaagtcatttttctagtttaatcacaggatgagtgatttaaaggccagaaatgtttatgtgactcaaaaaccaaagttcagcatgtagagaaatggagaaatgctatccaaacaccgaggcggtgtggcttgccctggactgtgagctgtttcagtgatttcaggccactggagtaggagctaataagtaacttcgtctggtagacacagcacttaaagatgtacgtcttacagtttaaagagtttcccgtctcttccattttgttttttgattcacgatttcacaccccctctcatggaggagaagaacgtacaaggctggttagtggtgactaaatacaactggtcactgaacgcagagaagcattcgataaaatattacatgacacaaggagaatcagagaattacttgagttcttgcagcattcatagacagaatgagttggaatatgaagaatcagggatttctactaggactccgatgttcctggcccttctgacatcctcacgttcaaaggcccacggcacctgcctgggaggaaactgagcgtgcaaactccactcctctgtgtgtgagaaggtggaggtgtcagtaaacagaggggtacccgccatgaagcgccggccacaggcagagcgccagtggccttctgtgaagagtatgggagctgcgctctgtgcctgagggaggttgacagtctcatcaggaatgagaatcgttaaccaacgagggcacaaaataggaaaaacaactaggaaaatatggagttgctgattactaagaaatccaagggataaaatgggatcttttgttttttttttttttttttggagacaaagtctcgctctgtcgcccaggctgaagtgcagtggtgcaatctcagctcactgcaacctccgcctcagaggttcaagcaattctcctgcctcagccccctgaagctgggactataggcacacgacgccaagcctggctaattttttgtattttagtagagacggggtttcaccatattgcccagggtggtctcgaactcctgacctcaggcaatctgcccgcctcggcctcccaaagtgctaggattacaggcacgagccaccacacccagccaaaatgggatccctctttcattcctcatgcattcaaaacctctcaggcaggaattttgtctgcttcacttttgtggtattttcagaacgtggaccatgcctggcccctggcatttagttgggaagtaatgaggcccagtgcagagaaggacaagcagctcatggttacgccctgctgtgcctgcaactctgtcacaggggaggccacgagcaaggggtgcagaaaacagagctcgcagtgctgagtaggccctatgcatgggagatgcctttgccctgggccctgcggaggtttcagacagatgggagaaggaagggccttgtggacagaaaggaccctgcacaaggcccagggcagaggatgcacagcccatccacatggaagatggtcggggccagggcataggggcacagcccagggcaggggatggatgctcagcagccagggcaagtgggaggagagctggggctggggctctggctcctggcagggctgcagccagagggaagggccctcagaagcacccagaataacagggctcctgctgcaggcaagggcggccacaggacactggaaggagagggacatccatgttgcttctgtttcacgaagcttgctctgctctgggtgctgaatgctgggaaggtggacaggaagcctcaccacgttagggcccaggggacaaagagctttggcttcaccctgaagggtgggcagggcagggagcctcacaggcagcaggggagctgttagtagtctgggggtgagggcaagaaacgtttaaagaaggggtccccagcccccaggccctggaccggtaccgctctgtggcctgttagaaaccgaggtgcacagcaggaggtgagcagcgggcgagtgagattatctcctgagctctgcctcctgtcaggccagcggcaccagattcctataggagagcaaaccctactgggaatggcatgttcgagggatcgaggttgtgcactccttatgggaatctaatgcctgatgatctgaggtggaacagtttcatcccaaaaacgttcccctacccacccccatccatggaaaaactgtcttccacaaaacccatccctggtgccaaaaaggttgggaaccgctgctttgaagaggatcgagtagggaaggagggcagaggaaagagtccagtgccagcaaaacttcagacctgatgtgtgccgtgtggagacccccgtctgggctcagacacagaggtgaacaatgtcggtgctgggcgaaacgcagcacactctgcaaacattgtcctttgtggctgcagcatgcagttgtcacccactgaattccaccattccgtgcactaccataaatcccagaaaagcgcacttttcagggcgagttaggcctttggtggcaaaactgtcttctgaacaacaaggggtcctcccaatcaatgtgcatagagctgacagactggagggaaatacttcaattgacttccgtgcatttaactgatttgcttccgctgcgttctgtgtcgacggggcgcagccagcatgcctggggccagagctcctctgacctccagaaattcattcctgcctgaggtgtgggctctttacatgcaggctatttctgaacaagtagcatctgggagcagcagtgagaaagcgaggggaaaactgacaaaatcaatctcgcaagctcccccgagtccctttcctttgcttttctgagaactcacaatcagccctcttgcctggtgcgcattcaccgctgttgggcctttgcagttgagctgagagccgagcagacaatgcatgaagtctgcaaaagccgcagcatcccctgcgtcgcctatgtcccctgtgtcacctgcccccgtgtcccctgtgttcccctgcccccgggcgctcatggcttttcccttccctccactgtgagctaacctctcgcagtgcttaccactctgtatcttctgtgcgatctccagtgacctggagtgttctggttctgttgattaccagctggccctgggcactcatgcccagccattcttccctctccgcttcctcttactcaaaatgtggaagtgatattcccaaatcagcccggtgtcagtgtggcgtgagacacttactttgagaagcagagaccagctcatgttatgcagccgcgtcaaagcccatgagctgcctgcctcatgctgttgtgtgtttttctgtgtgtatttcccgagcattttcctgtattcagcccagaagcctggggataagtaatatttttctctcagtgctttgcccaacctgaccctatctcagatggaatcccccttgaattaccgtcacttcccctctatttgcttgttcaccttcaggagagccgcacactgagtcggtgatagaaatctctccccagcaagtcgcacacccaaacccgctgctgccagcccgtagctgccccaggtgtgtctggtggctcatctgtggcttcctagtagaagcccttaaaaaatccagatcactagttgtacacctgtcaacctaccatcctacacgcacacacaaacaagcacacacacaccctaatttgcatagacaaagtttaaaaggtgacaaagacactctccttgactgaactttagacaggctcttctaagccctcttttcaactaagcctcctccatgggccttgtcctcaagcctgcctagtccagttttaccaagaatcctgctaagctagtttagacaggatcttcccaatcttgatatatgatcaccctccaaatctgatcaaatccctcatccctcaccatcccctgagtgatataggatcatcttggcctgccttctgcaagaatcatattaggccagtttagcaagaatcctccctaccctttatgtctcttcttagtaattttccacccaccgagcaatgcacaccatcccaccttcctacccctctaactcttcacctcccaaccccatcctcacctgctgctttgctacaaatctccacttgttcttactgttcgtggagttgaagcccatctctctccccattgtgatagtctagataccatctatcacaatagtccttaataaagtattcctgactgttaaaaaaaaaaaaaatccagattacaaaggaggagagatccagcttccctgaggaggacaagccgcagggactgtggacttgtcctgaggtcaccgcgcctctgtgtttcaggactcacaccacccggcaagaactgctcactacggctccctgccccagaagtcacacggccggacccaagatgaaaaccccgtagtccacttcttcaagaacattgtaagtgacgatcgatgggaagaggtagcaactgtgagggggaggaggggtgctggccactgctgtcatccacacaggacgttcgtacgctcgggggtggcaccggggtcatcatcagggtgaggccggccggggaactcccccctcgcacctgatcgcgagttccaggcaagcgcttcccgactgtatctgccacggattgcaccgtgcgctccgtgcgttctccagagagctcacttctcttgagattaggctcccatgtaacgcttagcctaaaaacacaggctttgcaacctatggagagtgcttgccatgggctgggagcggagggggcagcagagagagcacagggcatttttagggcatttttcgggcagcgaaaccgctctgtcgaggctgccatggtgactgaagaccacgcacttgtccaaacccacagcgtgcacagcaccgagagagccctaaggcagtgttgctaataagggaaactgttcggggtatgtggaaactaatttctgcacagtttttctgtaaaccgaaaagtgccatgcaaaacgaagacgattaaaaacaagaacaaaaccacaggcttctaattccaagatctcagtgcagcagacattttatgctcgtattcgataagtgcacttaggagctgcagacctggggacatccccttggaagctctgaatgtcagagggcccgctactcctagccccggaaagggctcacggtgaagcaaagtccgccgcctccctcagtgtcccaagatgggcccattccccagctacggagcctctgggaggtgttttccatcctctgaaacacttcctgagtgctctgggagatctgcatcatctagaatattttcaatctcaggtctatacttcttcaccaactaggacagaagtggggaggctgggcacccgggtgcttctggcagctgatggatgctagccaccctcagcaggcaggagcccgttaggaaatggacggcggcacagggctcccagtgcagcccacggttctctgtgtctttccaggtgacgcctcgcacaccacccccgtcgcagggaaaggtaagaccttggaatgttttgattgatcatcacttttctgatagaccttctctaaaatcccataatgtaccaaagagagagttaggctccgagctaccagaatccatcccaaaacgtgttgccaggcagctcccaagtagaacaggtcggcagatccatgcacccctcctgtccctcccgcacctgcacagccgctgtggccctgagcctgcggcccccctcggagctccgggtggaacctgtttttaccacctcagctccactgtgctttgactgtgtttcctgttgattgaaaggactttcccttcactgaccaccatgtcattatttctctgtcttcctcatgcaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaaggtctggtctcttgcttctgtgccggggacccagccctgcaaggccagatcctcttctcccagagggttcccaggcgacgtgactggtctccctcccagggagggagcaacaccacgtccgagaaaatgtttaacttcctccaacacaaccagtgcgagaagccccaggaacccgcatgtggaagtgggactggctggcccgtctcagtgaccccagatgctgacactgggaaaatgattctgctgatgaacagaaaaagaggctaaatagagttgctcgatttataataacctcattaatccaaagatttttgttttgtatgtgtttaaataataattaaaacatagatatcaagccatccagaaaatcttccttaggaattttaggctggttaatactgaaagcaaactttcaaggaaggtttaaaatggccaatttgaactttctagtgaaaaaatttggtgtctgagccaaattaaaatgccaatcattatattctaaccaaacttacagactttagttactagcaaataccagatatgattcttactgtataaaagttataattttagaataaaatggaggaataaccaccaacgtattgtagataggttgtgtctgtctccgaaactgcaatgctctcatacgctagaacagagcctacctacactttctgctcaattaataagcatcatataaatgaatgaatacattttaaaagaaaaacaacaaggagaaagaacaggaagaaagaacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcaggactctctccttgtctggagttccagagagcccccactttctctttctaagctgtgttgtgtgtttcctggtacattctaggttccccaaagataaacatgactaaggattggaaaggaggaaaggccgcgcagattgttaatctgaaagtcaatccccggatttagctctcaaaaatgctttatttttggagaaaagcaatagagtaagacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagccttcccacagacagtgcacccaccgtgggaggacacttcgccccccattgttaacgtccaccgcgcccagactcccacagcgagctccttcccttcctccccatgtttgcagtggagttcccactcgagaagacagcacagtagcaagtagaggctggtcctgggacactcgcacccatgtgtgtcaggaagcccctgcggtcacacggcccatgaggaagccagaggggctgctggggctgatgaggccagggcagggcggcctgctcttccataaatgacagctggcaccaaagcccagagctggcagcctccacctgaggagtggcatctccatgaacggcttgtgttctcgcacagccccattgcgtagatgaggaaactgaagctcagagaggttcctgcccttgcccaaggccacacagccggatgagctagaaaggtgctaggggactgggaggtgggggagctgagacgctgtcccgctgctgccaggatgcggccgccccccgtgccagccaggcctgcctcctccctctgtccggctcagcagccccggcctcctgttgctcccagtccgagctatggccaagggagactgattcctgctcaccctgggagagagctcaggattttgtctcaaaaccttataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatttgcttgatgtttgctaatcttctcttgaacaccccacagcgtgaaggtaagcaactgttccctaaacgacttagatccttaaaatatgtgtggttgggccgcatatctcatgagagagcctccgcccaaaccagagccctcctctctctgcggccaacaccctggtagacctgggggagcagcctctcccgcccccaccccctcagcgtggtgctggcccgtggctcctgaaccactcaccagtccagtccggggcctgggcccttccccggggccctggtggcagctcccagtggctcaagcagcgtgcccagcaccgcgggtggaggttgagctccgtggtcttctcttgcagggggccgaaggccagagaccaggatttggctacggaggcagagcgtccgactataaatcggctcacaagggattcaagggagtcgatgcccagggcacgctttccaaaatttttaagctggtaaggtaccctctgctcagctccactgagcggggactaagggctcccagaatccccaactaagctgagtacaagggtggctgccgcctctggctcagccgcactgtaccctggacgtgctctgtcccagcaggcgtgcaggggctcaggtggcattgcccacccgcatttacgcgtggatttcctccgagatgcatgtgaagccggaggtgcttgaggaagggctgcgcctgggctggttcaggggccctggagcaggcgactgaccttgactctggggcagggcccagctggagtccaacttgctcatgcccaggggttggggccctcagggagctaaagcaggagtcaagcagacgtgggtgtcggggggagatccctggagccacgggaggggatgcccaggagacctccagggagtggggagtgtcccgtcggctcatgaggacctggaaccagacccaggacgaatgccaggcccgctgtttataagctctgtctctgagacttggttttctcatctgtaaaatggaggtaacccgcccactcagctcacaaaatcgctgtgaaagtaaaaggtagtgacaaacacaaaacgcggctggcaggtgcgcggctcggattccttagataagcagtcacctttattattgttaaacgtcacccagaaaacccttaactcttagacagcggctctcattaagcaaaaggggaggcacatgaagctccaggcagggccgggagggaaccgtgaagccaaaggctctgggagcccccaggcacctgcgtttgcattttcatcctggaggagaccaggcctctggggctgctccccggggtgcagagaggaggggtctttcttggtgtgtaacatactcattgattcagtcacctgacctttgactccatgtattttgttgagtctggatgtgtggtgtgctctgcccagcagctgggatccacatgagcacagacatggtccccccgcgtccttggtgagtgcagaacctctgccgtgagcctcgattctgggaggttctgggaggttctgtggacaacaggcaattcagggcacagcccctgctcttaaggatagccggtcttaggagaagcttttaatatgtgaagtgagcagggagtaactgagctgctaagtaagcagctttatgtcagatgaagtggtaggcaggatccactcctcaacgtaaattctgagttaagaaaaaaattctccaaatattcaagtctcagggccatcatgctgtacattgccgcagttctgggatgtggccacaagagggcggagatgaggctccccggggagcagtgtctgaacccagcactgcagtcaggacggccccgccccacctggccagcacgtcacctgcctctgaatcgcctgggatgcacgcccagacccctatctgcgctccgccacagcctcactgagtcagaatgtccaagggcgaactaggtgttgctagttgtgatgattttgcagacaccgtgctcacctgggaaacacggattcatcccatctggaaaactaattactccactaccagcttaaggactgttagacacaccgggagagctgagtgctggctcagagttgatgggagggcccagatgagtgaggggccccatttagcaaatattgtccttgcaatatatgcaaggcttacaaccagtcactcaaagatgcttgcaaggccagagcttaccaagaccaccctgaggaacagaaagctgcatttagatctgcacatttactgtgtgcaaatataaccagtgtactatacacatgtgtttcctgaaataagttcagtattttccctgaacttttttgtaagaagcttttaaaaattatttaatttctgtagagttcaagggaagcttctatgtatcaaagcaaatttcaaatcatatggttgtaattaaattttactgcataaaaagttcataactggcctactatggccgtatggctgaattagttgacttggagcacttccaatagattaataaatcagctcccccagaaatgagggggtctagaggcaggcagatggagaggacagggacttcatagcatttaacatcattttaccatctttccttcctgttctttttggtgctgttggaaatcagtagtgagaggaaaacactcaaatctggaagtctagcgctgtcggtaggaactgggtagaaaaaactatgcatgtccccccatcactcggaaactacatcagaacatcataggagcatcctgtttccatgtgcattagtttccacgaacatacatgtgaatgttttcccacctgtagtgttgctgtggagttgtgagatgtcaaagtggaggcaagagtatctgccttttgcagtaggctctgttcttttcctgtcctgagagaggaggtcagtctaaccctcaccttgtgagttcagccttatactgacctgagcccagggtggatcagatgctgagatcatgtgactccaagttgcaagacacgtaatagagagaagcgtgactgttgcatccatgcaggctctaatcctggctccttcgggctggctgagctttggctcctgagctataaagagaggatgataggaacacctactccaggaggtgctgtgagcacaaaagagaaaacggggaaaaacgggtttcctgcatggtcagtgctcaacaaattgtagtttcaatgataaaaagtaaaaccaatacacccaccattttcaatgtcaaaagggggcatcaagaaagttaagattgtacctcggtaggttaccttgccagaggctgcagggaacttactccatttcagcacagaagcactttgtttcataggacagtggttctaccactttccaggaagtccaaaggctgatctcttggaaatgcagcaaaaggtgaggtgagtgccaacttctgggctactccagagggcagctccaatgccagagatgttcaagttaagccaggatcaaacaggaaaaacccacgctcccgagggagaggctggccctcgaggggcagggccctgcacctgtcagtccccaggccggcaggaggcctccacggtatgtgagaaagctgcctgtcttgggagggaaatctcactagatggttcctgaagcggcttcgcaggctagcatttcataaacgttttcacttgtgaaaacaaaaatcccttgagtgagttgtgtaagcacaacatagaggcttgtttataatgctacgtatgtacttggaaaaccccccaagaagtcagaactgtcaccttggtctgttagctgcgttacttggaaggattcttggcgtctgcgctctggttatttgtgttactgggcagtgtggaagacgtagaattagatgaggacagtgttggttcgttgctgatcggccacggtaaagagcatatttcttttctatcttgctttctgggggctcttcgccaaaattgatcatttcataaaagaggggaaacccaaggagagagactaaactttgaataaaaatttgaatgcaaaaaaagtgcagttctgcttcgtcgatctaagtgacattctgagtgaccaacgcattcctctttctagagggatggccacgcctggctacctccacaccgtgggccacagcacacctgtgcaccatctcaattagctgccaactctcttttaaacatcgaaattatttgtcccccaaacgtgtaaatgcatggttttaagaccccttcaagtcaaagtttgcagacaaagctctctgtgcatttgatttgtctggtgtggcagatgagatggcacataggagggacgtccccagggatggacacgtggctttgctctttgctggcgcgtgtagcaaggggtgtgctagggtcccgccgaaaaagaagttgctcctgttgtcgctggcagttcccctcggctgccctggcacctctagctgacgagaaaaagtgctcattcaaagcaaagcaatggagcggctgcactttcacccacagaagtgcagcgttgttttgcagagcagtggttatgccaggcaccactccctggggcctgggaatccgattccagttctctctcacagaactggaaattcaattagcatttgctgagggaggtcgggagaaatggaatgaaaagaccagctctccggggtgccatttctattagcagatgagagagacacccaatggctcagcatccacccgggaccacagaagaggggatgctggtgtgggaggaccctgcggcactctcgtcctaactcctctctcttccttttcagggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtatttgcatgggtgtcttcttttgtgttccgggctgtagcacacaggcccacatcaagcgagagccaggtgtgcagagcaaatgtgactcggtgcctctgggtctccaggcagggctgcctggcggtgcctgttggagggggcatcctcatcagagggtcgatggctactgaagaaagtggaacagaggtagttgttagggcactgattctctcaccaggaaaaaaatatttagtgtctctgaagacaagcttccaagtctgtctgtgttctgctgtgtggctagtgtacacaccctgcagatgtgaacccaggagtcttggacgtgttccccttgccacctttttctctgaaagcatgaaagagcgtgaagcaatgttttacttatagttacctttggttacaagaatttttcttcaaaaagatagacgaaagtctcttttgttttttctttttcttttgagacaggatcttactttgccacccaggttggagtgcagtgctgcaatcttggctcactgcagccttaacctcccaggctcaagctatcctcctgccaaagccttccacatagctgggactacaggtacacgccaccacacccagctaaaatttttgtattttttgtagagacgggatctcgccatgttgcccaggctggtcccatcctgacctcaagcagatctgcccacctcagcctcccaacgtgctaggattacaggcgtgagccaccgcacccagcctttgttttgcttttaatggaatcaccagttcccctccgtgtctcagcagcagctgtgagaaatgctttgcatctgtgacctttatgaaggggaacttccatgctgaatgagggtaggattacatgctcctgtttcccgggggtcagagagcctcagactccagcatgataagcagggtgagaagcttgagaatatgattgcattcattgcaatagcaggaaaaactgccgaggctggaggcatggccacctgagctcgcctggcaggcgtggcagacagaaagcccacgttcactggctacacttctctgcccagaccccttccaactgaggaatttggaaaatcatgcaaagataattacattttaaaaattgtattcttttcattggcaagtctaaatgtaacatatgtggaaaatgcattaaaaggcaaaccaagggtacatcataagctagcattcaccatgacagtacaatacttgggtgagtattttaaaataaaacacagcaagataggaactgagccagggagcttgtgtgctcactgaacgcttgcctgaagaggcccgcctactttctcctgaaggtgactggaaattaacttaccaggctgagagccaagaggaggggctgctggagccccagcctcatggacgcagatgcccttccccaccacccgcgcagcctgtcaggaccttccccatggcctgcgcaggctgtcaggaccacagtcagtagaggctagaggggccgtgagggtctgtggaactgaacatagaaagccgtagtgatcacgcttccaactgccagccacaccctgccattcagagctggcctgcccgtctgtaggggcagggaacgcgtatgaaattgatagggcagcctctgagcttggtgcgtgaagtacctggcacggaggaaatgaaatctctgcagagggctgatgatgagcagccagtcaagaagtgagcagagcaggtgctggtttagctcaggagatgccgtgatgaatgactctgcctgggccatgaactataaattgaaattgggattatgtgagaagaaagaaccagggactgagggagaaactgcaaaacagtgagtgaaaagttctctcatagcaatttttacagaagacagcgaagccatcagttaattttgggtgtttgtttgttagtctgcttaggaagccataagagaatactacaaactgggtggcttaaccaacagacagttattttctcagttctagaggctgcaagtccaagatgaaggtgtcggtttctggtgcggcctctccttcgcttgcagacggccgccttcttgatgcatcctcacacggcagagagaaggacctcgggtgtctctttctcatctaaggaccccagtcttactggataagagccctggccttacgacctcattgaacctgaattccctccttaaagcccctatctccaacctgaattccctccctaaagcccctacctatctatctcatctccaaacacaatggcattgggagtgagagcttcaaaacacacattgtgggaggacacagttccatccataacagaaatatattttccctcatgcaacaacaaatattttctaagccaccatttggcaagatgttataattaaatccaagactctgcagtactcttgcctctttgccaaaaaaacataatatgaagtgaagcacgctggcatatttctctattgtgattcctctattgtaaatagtaaatagtcactgaaatcctaaacgataggatatgaaggcaaggttgacccaacagcacaggcaaggctgtgtggcttgttaaccaccacagctcactccagcacaagatgccggagcaacttcgtgtgaccgcacctgcgtagaaggaaaatgagtggtctggtttttcagaaacagcctgattgcaaccggcactcatccaccttctaggcacctccaacctcgtctcagtgatgcaggccagggctcctccttctacagcccctcacctcgacttcccaccaccgggaaatggcttgtttatccagctccagaatcttacaagttcctggagctcactaacaggtcaagactcgagggcatccataaaacagtgactccttccactaccgccagcaccagccagggcccctccacctctcagctaagttcccgcttctgatttaaagttcatgtgaaaactagagatgatcctgagtcggaatctaccttccaacgtggtggccaggctgttagctcaccaggggtcagcggcctgcctgcctgctttaccacaggttgtggcaaaagcccttaagatcatgtccccgccacacaggttgggcagctttcaggtctcctgggagacagtttcatctgtaccgtggcaagcaaacttcagagctataagcagtaccgggctatggcaagtgtggtgtgctaggaagacaccgtcactcagacatgggcagcgcgtgactggggtctatggaggcctgcacatgaagagttctcagttcttgccttacagcttttctgtaagcttgaaactgcttaaaaaaaaaaaaaaaggctgagcacagcggctcatgcctgtaatcccagtactttgggagaccgaggtgggcagatcacccgaggtcaggagttcaagaccagcctggccaacatggtgaaaccccgtctgtactaaaaatacaaaaattagccaggtgcagtgatgcgttctgtaatcccagctactcaggaggctgaggcaggagaatcacttgaacccgggaggcggaggttgcagtgagccgagaggacgccattgcactccagcctgggcaacagagcaagactctgtctcaaagaaaagaaaagaaagaaaagaaaagaaaagaaaagaaaagaaaagaaaagaaaagaaaagaaaagaaaagaaaagaaaagaaaagaaaagaaaagaaaagaaaagaaaagaaaagaagaaaagaaaagaaaaggacaaagacttagcgttactaaagttgagaagcatgattgaaaggtaactagaaaatgcacatggtgaagagtatcttcagccaggagcagtggctcccacctgtactttcagctgctcaggaggccaaggcggggagatcacttgaagtcaggacattgaaaccagcctggctaacatagcaagacactgtctctaacaaaataatgaaaattagctgggtatggggtgtgcaccggtagtcccagctactcggcaggctgaggtaggaggatcactgaatccaggaggtcgaggctgcagtgagccatgatctgcactccagcctgggtgacaaagtaagagcctaactcaaaaataaaaggagcatctcaaggtagatggccagttgttgtccatctctacccagaactactaaaaaactggctgagataacatcaaagtgagctgtctcacgttaaatgtaagaatttttcttatagagcttggttaccaaggtaaccaatgatctctttgttctaattactaaaatagtaacgtaaaactctcttcattggcccagaataacaacactggggaagcatctgttaattggtagaaggggcgtgtgaggcgtctccgtggatgtgcactgtgtcatctgtcattctttctgtagtgccttaagggattgaatgtttcaaaggtgccaggtcacaagagaaggtcctcaatgatgggggcagcactgtgggcagtgaggaataatcagtaacatttattttaacaacttccaggcatattgtaggctgagccagggctgaccacggtgtcagcagccatgaagcatcgcaggttctccccactttcctttcaggacagcctgccagcctcctggctgctggcagaggacgtgggctccggggtgacaaaggggatttcagtcacagtaacaggagcagtagccagagggtcagcatttgtttgaacatctgagcccccagccccgaagtgggacgcaaagtgggccaggagatgcctgcacacacagtgggtggtgtggtggcggaggggcctgagcttgaggagcggactttcagctgctcaggaggccaagacaggggggtcacttgaagtgcacctgcctggcctttggtacggagggcaacagtgtcttgattacactgatcagtaagcaaacgtcccttcgtgctggagaaagaggccatcgccatctccccaggctgcgctctgtacaaacagcccaacaagagcatgtggatataacacaaagaaatgcaaggggcccatggagagtgattcccaataccatgtggtcggttaactgagaatagaagtagaaggcagagctggaaagaaagaaattcaatcaactaaccccagggacgaggagccaggtctagagaatgtgactggctggcccagggacaggcagccgtcagaggcagagttcgtctgagtggggcccacgccacctccctcgcagcattgagagcgcacagcacacttgcaggtacaagcctttgcttgtgcttaagggacagcactctattcgctatcacagggagtccagcctctgggcaaaactcacctggaaaagcactgccaatagttgagatgatccatcgtagtgggatccaaagcgcttccctcacccactctatttcaaaatctatcagagcaatatgcctcctacaacgaaagaaagaagcgaaaagaacagtaaagcaatttcttaaccattccctcttagccaaattcaggaagtcaacatcactttaattttttcagtccaaaactacgtggagtccctactcagtgccaagaaaacgtatattgaaatctcttgtttcaacaggatgatgactctctcaattaccaacttctctaacagtttggaaatgtaaggcatagtaaaatagatgaatatatctttacaaagagcccgacgacataaaataactccatggatgcttctgggaagtccaggatctggcatctctcataaacagacacactgatattatgatggatgcgcacggcatttcaagtcactttaatacctttcaaacgagagaaagcagagagcaggaatctgggacatcctccaggatttaaatgctctgggcttgaatatgttgccaactcagcattgctctattgtgttaagccatggcaaacgtgacctagaggaagtgtccgcctttaaacagtgacaactcacccaaaacccaaagaagtaaatatacaggagttttaaaataatacaaaaactatttttattatttttaaagccagcacggtggcttttggcatcactatccatttctaatacaaaactggattaaataaatatcatccaatgtataaatagatcatgaaacaattgtgaagataaaaagagaattcttctgtaattaaaaaaaattaactttaaaaattttctttagtggtgaatcaagaacaaatccctatgtcacttgagaatttgtcaattatgatacaaatattgatagaatacgtcttcatgctgtaaagtgttacacataaaagattaaatagaaaaatctcttctgactgcctgttgctcctgccattcatactaatcttcattttttcttagttgttagtcatccatataaagaactgccccgatgcctgtgtagggagggtgagtgtgagggtgtgtgggtgagtgtgagggtgagtgtgtgggtgagtgtgtgagggtgagggtgagctatgtgctcatccgtgcatgggggtctgaggaggggaatccgttcggagagggccagccaccaaacaggacatgttgtggcaagccacaccatgacaaagaacatgtctctgctaggaatatgtgggcatctggcccacgaaaagctctgtggttcccactttctccacaatgaagaagatgccagctcagtggcctttggcgtacgatcttttcattagaatatgggaaaggtgtagaggccccaagtacagatacgacattaaattgggtggtgcgtgtaggcgcttttgaaatttcattctaaaaaatccaaagtgcctaagttacgtgaacacagattaagtgacacaaaaagaacgcttccttcagaagtatccgccgcataatctcatctctgcctcacttacttcctatgcagtaggtcttggaaaagggatacattcgcaacgatcaatccttggattaactttttttagtcagggaagggcacggtattaattctgaaataagcttcagaaaaaaatgtaagaagcaggcatgagatagccttaatatacactagaaagcagttctatatatcttacctatttcctttaaaaatcttatgtacataaatcttgaaattgatttacatgccaaactattttatcttgaatatttccaaacataaatctgtgtgatggtcatttcatgttaaaatgtgtatcttaatgagttacaaatattcttctaaaatgaggaaaacccacagcaagacaagaaatccacttctacttctaaaaattgtgtagctgtgctaacacatgcgtctcttgtaataaatgtgatatgagttcaaaggaagacacagaacactagctataatttcaaagatcaagtttccttaaaatattacaacaggggagtagaaaatatgcacgaaggaaacatcccctagttaagtgccagacaagcactgatgttcatgtcccaccagcagaacactgtcaggaagaggagagtggcatttgatgagcctcccactgacctggctgcaagctgtcagatgccatgtcatagcatttcctctatttagatactttctaagtgcctcaagtttttcaaaggggaaaaagtagagcttgatgggggtggggtagcatttcaatctgcatgtttgaaaacatgtcttcattttcatctattgccattctatggaaacgcagccgcttgggcattatctagcaggtgggactccacacatgctacatgcctcctgcttcctcagtacctgcaccccaccttcacgtttggtatctttgcaaaggcaattcattctttcagcttcagtgcttcatggttacttgagcacacaagcaggatcaaaacacttaggaactttcaaaaggttcctcaatgactgggtgccgttgaataaagcagcaaatgaaagggaacaggaacagttctgacacatgcacagggcactgtgctgacgcccacggctcgctgtcgcggagccatgccctgattttgaaagtctgaagcctttccagtggacactgcaggggtaaacgcctctgaacttcacagaggtaaaggaaaataccactaaagttttctcttaaaaatatctgaacttgaaattaatttacatgccaaactgttttatcttaaatattttcaaacgaaaaaaattaatcacatttcctaacttcatcttttatttatagttattccaaagcagatatgctatgatgagatagttctaaaaatacagttctttatcctcaaaaccctggttatacatgaggcctagaaatctcttttctagaatttttaaaacaaccagtaaaatataaagatcaacctgtaccccacaaagattcaagtaaaattatgtcttttcaaaaccttatattttcaaggaatgttctgcaaaaaagcagcttttataattaggaagtaaatcgaaataatacataaaatgtcttgtgtttgctaataaattgagaaaagacacaaaattgaattattgatattttctttttctttaaccaaaataaaagtaggctctagattcacctgttaaggccttaaacagtcaattaaccaatacaattcaccaaactagctttctatacaattaggaattaaacaaccccttttagagatgtcctgagatgacatttaatgctaaaatcaaaataaataacccagcaagaacaaaagtttaaaattccaataatttccactttggggatattttttcaccaaaattaatcaacatttctaaaatatttcaatacaaaattataaaataaaaagtgcattaaaagcagaacctttaaaactctagcacaattacagttattctgcatatgcggctacagccaggtttacacactgacattcaaggaaggaaacctccggattggtaagaagtccagtatcacaagcataagtcaaataaggcttttctttttcttaaaaaaatatacaatacacaaagcagtttggaaaagaagtaatattatttaacaattttctgacttaaatatcttcacataacaaaagttttcatatcaccgtcaatattacttatatacata

SEQ ID NO: 1469 - DNA, 1231 bp, Homo sapiens
cctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctg

SEQ ID NO: 1470 - protein, 189 aa, Homo sapiens
LDVMASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 1471 - DNA, 27332 bp, Mus musculus
  misc_feature (1)...(27332): n = A,T,C or G
ctggctctgacatctagtgtgttctaggtaaacagggcacctggttcctcacccctagaaattccctcccttctttgacttccaggggttcagctaaaacaattgcttagcttggggagacgagcaagccccacccagactaggacaatgatggttcctggagtgtggagagggaggtacagcgctccttggaacagctttggtgtcagtgacagttgatgaagagggaaagagtgagacttggagagctgggcaggggagagagagagacagagagagacagagagagacagagagagacagagagacagagacagagacagacagagagagagagagagagagagagagagagagaggagacactgaggaagaagggccactcctggaagcacaggagtgtaggtggattggggagtagagagctgatgtcagcccctgctcttcattgctctccctgtgagtggaagaggactttctagagggccccctgagaggattttccactcttctgtgtcttccccactggtaaaggcaagactcgaaagggtgcaattctgtaattacacttacactctttgtgaggggaacggtcctcatggaattttctggttaaaaggagggtggggaatggcccagagctccaggttctgcttgttactaatcctatcttggcccaagttctttggccttctgggtaaatgagagtccaggaagttagcggtagggggcagaagtggcccgcagcattgctgagttgtgcccttctggaagcagaaacaaacaccaggtggcagtagcgctcaggggacagtgcatacaaagtgacccagtcaaagctaccccctgggcaccatgcaggtgtctgttactgcgtttatggcgcctacattttcatgtgtttagaaactgtattttcttgctaacccttctgaggttagacgaatctgaaaaacatcacacatctgatctgtgttcacattgccgaatcctaactgagtgccctccttaatcatcatttgttccctaagagtcttgctgtgtgtcccatgctggtttcagactagctgtccttcccctggctcttgattgctgagatcaaaggtgtttgccacaatgcttggcccaacgatgttagatttttaaggcagttcttgttaggccacttagctatgtccaactcccttgatatagcttaaaacaaacaaataaacaaacaaaccacaaatcattagaaagaaataaaaatcactaatattatattgtagatttatctgtagcacgttatattgcttcaaagtcacagcgtggtccaagaatctcacaagacctgaaatgttcatggagagataacctagacaccaaattttaaagtttcaacccgattggtttaacagaggtctagatatacaccgtcagcccctctcctccccactccttggcacagtctccagcatccttgggaggaacgcctgcccaagaataaaaggtattggtgtcagaaggtcaggccagtgcagaacacacccaagccatgttttgatgaagactaccaggatacttccctaataccgtaggtgctcttgtgttctgtagctgcatggggtggaagcctcaaggtccgtattgggtcagtggcaagtggagtgaccatcttctatggatttctttctgacctgatagccttcatcccagggcaagagcgacagccctatcgtggtgatccatgataaacacgctatccggaaaactctcagtgctctgggcttggagcacaagacggagacgatccagctcatcactagagacatggtcagagaactcatgtgagtccccgggcacggctgccactgtgcaggatgactgggccaccaggatgcttccatccagacagcccaactccatctgcattcctacccatccctcccccttttcttttgtcttgtttgcctgtatagatttttcttaaattctcttttgcttaacgtacacaaaaccggatttcgttgacattttattacatctatatactttattcttctttgtcctttcctctgagacttccctctcctcttctcgacggtccctaactcctccaaatagtccctttttgctgccatgacacacatattccaatgtctgctatagtttctgtctcctactttaaacctcttcttccctctaacagtcccctctctctccctctctctgtgtgtgtctctgtctgtctgtctctttctctctctctctcacacacacacattctacatgtaaaagaaaaaatcaatatgcccatctcgtttcagcattttctctcctccatcttggccctcctcctctccctttggtagttagcatgccactgcccttcattccaaagcttgctgtaggctctaaaagtaaagggtagaggggcaatcaatgcttctaagccctcagcactgcttgggggggggggggggagaagtggaccaatgagtcacttccttttgggtacaaggagaatccaaagcaaagggaaactgaccagatgcctaattagcactctggctcctccccagactcgaggctatcagaggaaattcataggggctctctgggttcctttggggttagctcagttttactgccctactggaacagtgccatcaggctcctcctgcagggcacaggcagagctcagctaagtgccaggagccagtgctgtgtttggtggcttagctcttgtgtttagtgcttcgaactctcagactgtcctaccgctctggctccactgctgaatgacgagtgacgtcagttcacagaatttgaagcccttggctcagggcttaagctgaagagacgcagctggatccccgtgcaggagctggacttgacgatagcctctgtttagccgaggccgaccagcctgagcatctgacagccagatgtgggcagtggcctgaggggtcctacttcttgacctccctgcagacaggctggtcatgcttcagatccactgtcttagattcaggttgctcttggtcacttcacagcctccattgttttgggccacaccacttggtgcagtctaagaccttgctaataagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttggtaactcaccttcctagctgtgtccttggtgggcgggtggcagaataggaaagtggagtagggaggccagctttccatcccaggcaggataagctcagttaaggcatgctaaaacaaggtgtgcacgtgcatttaataaacaaacgttgcggtacgcgggccagtgggaggatgggaacaaagccgggctgtgagacctctcagctctgataagtgagggactgaagagaattcttgccgggttacgtgcagcaggtgagtttacggagaataaaccccaccaatccgggctggtctccccttaggaagccgtcacaattcgcaagaagattatgaagcagaaggagatgacttggaacaataacaagaagctcagtgacctggaggaggtggccagggaacgggcccagaacctcctgcagagagccgacaagctccgtatggagcaggaggaggagctcaaggacatgagcaaggtgggggcctcttccttccctccgagggctccctgccgctccctctgcgctctcactcagacccgggaccaggagagggactgatgtgggcggggctcgcgtggataggaggagactcgacctgtttcccggatgttgagagcaagtcgctggcccttgagtccacttgtaagatgatgaaggcagcactgcttagcagctgaacaagctaagatattgggaggggctttgagaaccgtgattgataaggatctcactcctatttctatcccgttagttcaagtctggccccagatagtggtggagacaatagcgttctttttgaaatgcccagagtactttagctgggagtagaaggatcaggggttcatttgaaattctattctgtaatccattcacatgtgtcactcccttgttgactaatagaaaaaaaaaagtcgactcccccagtccttcatctctgattttcatctctctggtaaatctctacgtgtaccagctcttattattccaacgcttttactttctggttcttaatgagggcacatggcttctcatttcttttatgcatgttaggctcttctagattaaaaaaaaaaaatgcaccagttgaatttctgctggaatgccttggcttctctacacacaatgcactgttcatgggtcctcggggaaggaattgcaaagctctaacgccttatggaggttatgtgtatgtttatgtaggtgaacacgataacaccgagttcgttcatcatagttccaaaggccgctccattatctaccgaactctacaatgccctgactgatgctgtctctccttgaataaactgtagtgcctgataagaaaccagcaaagggtctggagagatggctcagcagttaagagcactgactgttcttctagaggacctgggttcaagttccaagcaagacagcttgcaactatctgtaactcacagttccagggcttctgacaccctcacacagacatacattcggattaaaacatcaatgaacattaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatggttgcacgcttcacacaagtaaacatagggatgttttacagtttgtccctcggtcactgggggaaattacacactccattgatgagcatgagtgctttggtttcctgctcccccgctgttgtctcatttagagtacacaatatcccattgtcattaactgtgttgggaagccaaaccttttgtccctattagcttagataaaactagtagggacatttaatgaaaacaaaacaaaacaaaacacccgatgacacacctgtgtgaacttcgcaaagctaagatggtcttctatttgccttatctggcatgttgcaacacactagaagatcatagcaaaggcatatgcacacagacaggtctgtggggatgcatgtgtttgcatgcagatggacacgtgtgtgtgcacacacacattcaggaagcccaaagctggtgttgggaatcacctctgtcactcttaattcaccaaggcaggcctctctgtcgagcctagtcttgctagccagtttgctctggggaatttctttttctgccttctcgggttataattataagtggagcaccgcacccactcagcatttacaagatttctagggattcgaactccaggcctcacagtccttgcacttgtttggccattgagccatctctctagccctgtggcaggcatttgagctgtattcattctttggcaatgttgtacactgtgttttgaccacattcacacctttgcccactttttatttcattttcaaaacgctacccacaaacaaaagttggatgaattagaactctactggtaatacttggttaaagaacttttgcctttgacattttgacaccccgctacgaaatgcttcatgcccccccccatctctgaagagcaaagcccacttacatagcctccaccaaaagctcctccagacaccctgtaacgtcacccaatgttaacctagattcggttttcttgaatcggcaaaggattttcagttattcttctgttttccaaacctgtttctaatcaaggctcgcacgccgtatttggttaagtctcttagtctgatttgatctagaagcatcccctcatttgttgactcatattgtttcttcaatatattttcatttttcacggacacctagcaaatcgtgagcctttgtggtctacagtgtaacggtcctctatgtaggatgtgtaatggtcatatcagggagaccagcatattcatcccctttagagtccttagtattgggaacacccagaatcttttccaccagcattttgaaatgcaaagttggttatgattggcagtaattgtcccactgtgctatagaacaccagaaattattcctcttacctaatagcattcctgtacccgattccttttcctcccgataccatttaactcatggaactcatggttttttgttttttgtttgtccccctccaacccccctgccttcctgtgtatatggatgattcagttgtcatcagccaggacaccgggtgttagtgagtgactggggatccccaagattcccataggtggtcagtcagaggttttcctagctcccacaatgtgagggccaatgtgaagacttaggttgaagactcctgtctggggcagaagataaggcttgtagacttgcggaagactgcaaaggagacctagaagatagacagacacacctagctaggacactggctctgggagaagtgtgggtaacagaggtatagggaaatatgcagggaacgaagtggtagaccaagactggacacttcagcttggctgtggggagctgggaattggtgggctcactgcggtgctccagcagtgagtcaacaccattccactggtgtgtcatggtcctttggatgtccttccaaaagacactcccaagtttccaggaagtagtattaggcaagcttagggtagaatccagcatctcagcagacacagagctgcttgccaacatcccaggcagcagggcagcttttccgcgtggctatcgagatggagaagagttgagtgaggttttctttcttttcccccttggtctggttgctttgaagggcttcagtggcaagaaacaaggtaagtcccttccgttccttggaagtcaaatgagccaacaaaaacaaccacccgaagggtaaatacacacgtttttcatctgttcaaggccccacctttcagaacttgggaagcagcctctgctaatgcccagtgagcggaaaccagccattgtgagccacactttcatcactacggaatgggatctcaagtttgagtttcaataggagaaggaatttgaacactgagggtagtagctcatgaggtcacaagagtagactttagcgtggcaagagggagaaaaaaattaagagcctccatttccagaaagcattgagagataagtgtcaggggccatcaccaagctgagttgggtgaagatgcaaagaggctatttggttgcaaagttgcttattgtccattcttttttaaaatatttatttatttatttacctaatgtatgcaagtacactgttgctgtcttcagacacaccagaagaagacatctgatcccgtttctgacggttgtgagccatcatgtgattgctgggaattgaactcaggacctctggaagagcagtcagtgatcttaaccactgagccatctctccagccccttattctccgttcttgaaagacagcttgaatccaggctagtgctggtcacactgtactacctcctgcctctgtttttctctataccagcatgtcagtagctatatgccttgccttcttctcctctgaggatctcttccttttgctggcaggatctggaacgaagacatcaggaaaaactgaagatgcaagctgaaattaaacgtatcaacgatgaaaaccagagacagaaagcagagatgctggcacaggagagactggcagaccagatggtgatggaatttaccaagaagaagatggtagggacttggtgtccagtgctggaaccactgtccaggagtgacatgtctataatggacttgagcaattgtaggactctagcaggagacagccatgccttcattttaaaatacatagggctggctttgttttctcttcatcatggcctgataaattgttcagtaagagtatagattttagagacaccgccccccaaaccagtgtgtcattatcttcattgatacagtcatgtaaaagctggaatcagggtcacatgcagtaaaagaaaacctaagtgattggtgaaagtaaagcttatattaattcttcaagggttgagaagcctagaaaccgagcattggcttccccatacatttaaattttttttttttttttgtaaaaactcttatataggacagcttgtattgggtagttgagatacctcactgtagaatgactgtataagaagaaatagatgggaaaagcaatatctgcagacagcttgggatgggtaaagctcctaaatgtgtggactcactctgggtcaaaaatgagtgatggggtgattggggtatgtagggagtagaggatgaaggagagaaaaaaaataaagacttttaagtatagtttagagtgaaaatggaattattttaaaaacacagaaatactcgagtggcaggggaatgattcatgtgcacatggatccagtctcttctgtagatttggagctcctgatgacagttaacttagcctacttctcttatgttgcatttttagacagtgtgctgatcctctcagctttgccccttcaggactaaaggcagagagtggttgtggaagcatctagaattttctttcctgctatccagggcaagatgaggcagaggaaccagtgttatgaaatatagtagggtgagggggtacctggcaggtccagaggagtagaggcagcaaacaagccatgagggagggtattgagagattgagagaggcagcagagagggagaaaaagaaggctctgaggacaaaaggggtggggggagatccaaggggagggagggagagagagagagagggggagatgaggtaggaattcagcgctatacctagcgaggcaggtgtagcgtaggcaattgctaggtccttgagggcagaagagctggattgcctgcaagctaacaatcagcttgactctgtggagcataaccccaaaataggcaactcccggggattcttggcagtctgggaaggtagaataatgagggataagggacagtcttcatgggacgaccatggcatgccacccaacatgtgcctgtggtcatgtgactgctctaggcgtagtggttgagaagccttggggtttattcactcctgttcttgcccagaggtggtaaaagggacggcattttgatggtttactcttgaggtatctgctaagcactgtggggttgcccaaagcacagttggcagttttcccaggcactaatgagataacgtctacctgctgcattttacaaggcaaggcagggaaccacagttgttacttggctctgtggccttgcaacttgaaattatcttcagtgtgacagaaggagtaggagcgccagggctgaggattcctgcgttcaaaacagtttgggcatccatagcttctgtctgatgagatgctgcctgagctctctaggataaggcccgagaaagctttttgtaagccacggctgccttctacaaaggctagttttccttttgtttgtgcattgctaaagtcccacccccatcttagatctagcaaggaagtggaagggaagatgctggaaagcacgttccctgtacagattgcatttctctgtgcagagctgcaatggtgtgcattatcctgaagcctttttcttcccggcaggctcgagaggcagagtatgaagctgagcaggagaaaatccggagggagaaagagaaggagatcgcccgcctgagggccttgcaggagaaggcgcaggattatcaagcagagcaggtatccacgtcctctctccctcccactcccgggggaagctatcccttgacagcctgtaaagtggcctgcagggtggaggtatagaagagaggatgcctgctgtctagccttcaaaaatataaccgcagacaaatgtcatttaatcataggggatgtcttttggaaaaagcacctaaggaggaagggtaggccctttcccattgtccacggcagccggaagagagtagaagtatgtgcttaggttccggagaaagcttttggctgctatataaagaggattttccaacctttactgactaatgaaacgtcaccaggggaaatgtggcatctctatcattagcagtttttaaagttaaaagcaactccagggctctgaggaggtgctcaaggaaccgggaaagaataaggatgggggataggacaaggtgaccctttggggaaattttctgaccctaaagaatctatgccaggattccatctttccttaggcagaatggagtctgtacgtcagtgactatctccagttcttttgtatcctcatagctcccctgtcttcgcccccctccccccctgcctgctttcttaggatgccttgcgggccaagcgcaaccaggaggttgcagatcgagagtggcgtcgaaaggaaaaggaaaatgcgcagaagaagatagagacagaggaaaagctgcgcaaaagccggctggagcaagtggcattcaaggaacacacgctggccgttcaggttcagcgtgaccgagatgagttcgagaggatccttcggtaggagatgcggagagaaccctggcttcctttcccgtgttgaaggatgacaggagtgtgctcaggggatggtgtgtggtggatggagaggagattcctgccacggtaccagggaaggtgcacatccgtcttgatcacgttgctgcagtcatcctgactagatggatggctgaggtatttcaaagccattcgagccaggaaaatttcctgattagagaattggaaaagaacatccggaagtgtttaaggaaccgagggttatttttcctttatcagtaacggtgtaaagaaaggtccctcctgccgcccttaggtcccacatctttctgcaaactagggagcctgagtaggagaagcctagaggagatggaggattcatccagacgctaaggattgtgtcattagagcaaggctctgagggagtctttgccattgatttgactcatagctggtgatcaacatgcgttgaagactctgcctgggtatcatgaagctcattagaagtgagtgaacactgtctgtgcctgatccacccgaaggctgccagagattcctgctcgggtgggcatcttctacgtctctctctgcggcgtggcagctagcatctctttactgtttgttgtttccgttcagtgatgatttcagcctgcacgcaagggccaaggactcatagtgcctactcttctggtcctccctcagagcagcttccttctctgttctctcctcctagtcagatgtaccaccaccagacctggtccgactggggaccacttcctttgtgctttgtttcaacttctggaaaataagatttttaaaaaggaaggggtgggggaccgaaccaaagaaaatttgcatttggagaacttgaaattacagaaagtgtgctcagatgaagcaaaattgaccagcacccagtcatcttggtgtctgggccttgggtccttactattggagctgtctcagtcaggagcaagccaggccaggctcctgggcctcaaaggaggcagagcagaccttctccccaagaacaacactcctggattctcataggatcttgaccctgcttgttcccactgactgagatgccttttggctcttctgcctttcttgcccctcaccccccgcccccccgccccttgggttgtgctacggtcaccagacacctggtaatgaagagagcccccgcaaccccccacagagcctgccattgggctccagattgccttccaggtgtctccccgtgcctctgtgcccttggacagctgtgtgcctttggcaggcactaataaacattaatgggatgaattccaagccctacttttgctcctgacccacttgactctgctttgctgggtctgcctggagcataggcactagccagctattaaactccattcagctctttggagaagtcctgctgtcctggcttagcatccagacctagtgtctccgcaccaggtgacttccatgatagatgtctttactcggggagtgtccccgccacagccagcaatccagattctcttacttcaaaagcgtggcctccagtgcagcctgcatatggacgtcctgcttctgatcaggagatcctgaactttcagactgttgactggcggaatcgagacctttagaacaaaaaaaatactgccatttaggtgacacccgaactggttgtgattcaacagccaggggcaggcagcttctgaaatgccttaggtgactccaacatgcagccagagcccgagagttaggtgaccccagcacgcagccagagcccacgagtgttgctttgcctttgtggcatgaccggtgtatccactcacttggtttgtttactgccatgacaaaatgctcagtgaaagcattttgagtaagggcttatttcggcttatggtttgaaggggcacggtgcatcctggtggggaagccatggcacggaggtgaccagtcacaccacattcaagaagcagacagaaaaaaaaatgcgctggtactcagctccccttctccattaaaaaaaatccaaatatccagtctaggatcccagtccacaggatggtgctgtccaaattcaggaggagtctttcctcctcagttaaacttctttggaacccccaccccaagccccacccatagacatgtccaaagacgtgtcttcttctaggtgagtctagtgcctagtcaagctgacaatggagattcactgagaccctcctcatttggatttttcagctgcccaccaacaccagcagctctctagtaacgccgccagctttcccttttctgttatctgctcactttgatgcgtatgaacaataggaagctaatctacacacagtgatcacaagcagggagagcacacctgcctgagatccgtgtgggctgtgggcacttgacgtgtaactatagaggtgtgtggtcaccagcgcttcccttcctatgtactgggaaaggctccatggggctgtgggatttggggaggtgtttgcttggccagaggagctgctcagacttgggagggctcgccatgtgttggtggagtttggaagacactaaggagatgaataagtgactgaggtctttggcaatgggaggaggggtgatctttgttttggtgtgagcaagcctgtgggagagaagcaggtaagaattccccgcctgagatagttttacaattcggttttgattgtattgagaagaaatccagtattaggttaggtggcctctgaccaaatttctttgagatgtaaatatatttcatttgagcgtcctctggatgccattagagatttttctacctgatagtagactaggaagcattgttatggaagacatccatagaaggaatgtgagaccaagaatcagtaagagaagagtcagcctgagttcttgccttcttccagcaaccaaagtagggctaaccttacagacagtgtttccttacccttgtttggttttgttggtgttgtgattgtaagggaggcaaggaaggaaggtaacttagaacaggctggagaggagttatgtgcatcattagaagggagagaagaaatagctctcggtgggcgaaatcctggttgtaggacccagctatacaatttacagagaccagtgagtgttttgaatgtggagatttttatttaaaataaactaaggggttggagagctatctagcaaataagaccgttggctgttttgttttgttttgttttttttgttttgttttttttttgtttgcttgtttttttttttgttttgttttttttgagaggatccaagttcaacatacttgtcacccacatggtagctcacaatggtctgtaactcagtcccagggcatcggatgccctcctttagtatccgagggcatcaggcatagatgttgtgcacagacacacgtgtaggcaaaacacacataaaatgaaaaacaattagaaattagtaagaatgtcaacactgtggcatatgacaatgtatttgggtctgtcccgggagaggagcacgccgtggacgcttttagtctggggcctgagacctcgaggttggacggttgtggaccttgaagcatgaccactgaggggtcaacccaggagcccagccaatcacattccttttgtccctttcccagggctcagagagagcagattgagagggagaagcaggaacaggagaagaaagccaaggggtgcctccagcatgccaacgagctccgacggcaggtgcgtgagaaccagcagaaacacgtgcagaaccggctcgctaccttcgaagagggccgccgcctcaaggaggaagccgagaagcgccgcgagcgcatcgaggacatcaagaaacagaagctggaagagctgaggtgcgctggggtcctttctctttcttctcctctttcccaaagaggtggcgtagcaggctggaaatgtcaggttggcagggttttcggcccgaggcttgccctctgaagggggctctgacagaagcttctgggactgggactccttggttcactggtagctcattggcagtgtgttaggatcttggctggaatgtacttggtggtacatcagcggtgccaatgtgccagctagaggcaaccagtaggaacggcttggggtacagggccccaggttctggaagcccagggcatgttttcttctgtcacacctttggtaagtaccctacttacatatgcctgtcgtttctcccggcagagccaccggccttcctgagaagtactgcatcgaagttgagcgtaaagccaacatcctgccagccacttctgttaactgaaggggaacctctatggtctctgggagagcacagattcagcttgctccccggggcatccaaactgctgctaacctacacatttcatagttacagattaaagctattctattctctaagggacagctccacttcactgctgtggggatgggggatgggggataccaatgggcactgaaggtagatcaagataaattaccgtggacctggatgcgggagggctgtcgctcatgggtaagaaccagatggtgttctggtggggttttcgatcctaaatgatgggacccattttctctgaccaggggctcctggcctttttgtaatcatatatattcttatctctccactgaccctgtatccatgtcataggaatttggggccactgagacaagagttggagctctgcttttgtttgagggctggtgaaaggggtgcactgggctgagctggagtgggaggagcatgagtagctgggactggcttgtcctgggctcctgactatgactcagaccacatatatggagggggcagtgtgtgagcccggggctcaacgctctggactgcatcctttcctgcttagatccctttcagttccaggcagcagtgcagcacagttctcatggaggcacccccaggacacagctcctcacccaaatacagctgaccctcactcatggctctgctctcctcggttcgctttatcccatgagtgggcctcctcaaatccagttctgttggaaaatcttcctgccttgccccagtctatgcctatttacacatcaggtacttactgaacgcttgttataccacgagccatctgggtactnnnnnnnnnnnnnnnnnnnncctccctcccttctttctttctttctttctttctttctttctttctttctttctttctttctttcttttagacagggtttctctgtgtagccctggctgtcctggaactcactttgtagaccaggctggcctcgaactcagaaatctgcctgcctctgcctcccaagtgctgggattaaaggcgtgcgccaccactgcccggcttccctcagcttttgtacatctttagaacatctcaaacatgccctttaggatggccccagcattttcagaaggcaacaccacctttcaatgatggaaggaagggcttccatttaaaaccatcagtgtagtgcccatctccccagccccagacccttgctctgtctctcagacttagcctagtcttgtctccatgcagtccgcaccaaggaggaaaggacagtggctgagtgcgtcctgggtgtttacaagccaggttacaagggcctggggcaagagtcctcttttcatagtgcccaaggagagtcacaagctgcttcctgtgtttcctcttcctcaggacttccccagtcaccctctccaccttcctcaactagaagactattgcttttatacaactaggcaggaagttccactggaccgggggaaaactcccctaactcaatgacctccaatctagagatgtgtatccattccttcctaaaggtcttgggagatgtggtacccagcccacgataagagagaaagcattgatgctatcaccaaggattctagtctgcctctagctggcacattgacaccgctaattgttcggttgatgctgggaccacagaacaagcctcatctatttcaaaggactttccttctcaagaatgtcagaaccatcgttggtacctactatttggttctatgcccactgtctgcagagctgaaaagaatgggtctgctctgctgtgcaagccagggaggaaagaggtgtaagacaagcctggcaattaaccagggtggccgctgggagacttgcagagcccacagcccccgagtgagacagactggaaagggtttaggcacagggataaaggtctggctctggagaaggaactatagccaactaagagtgtgaagatggttgggtctgtgagagatggttctgcagttaagagcactgattgctcctctagaggttcaatttccagcacccacatggcagctcaccctggtgtcttaactccagttccaggggatatatggtaccaggcatgcatgcagtgcacacatctgtgcatgcaggcaaaatacccatacacataaaatagatggatcttaaaaaaaagaaactaaccatatatatgcatatacacatgaacacacataacgatggtttgggagagaatctcaacacagaggattgcccctctagtcccatgaactttttcaaattggcccatgatgtggaggaggggtctgataccttctctaaggattcatgagagacttttcacaggctttggtaggctccagaatcagctggctcattgcctggagcccagctcctctaagcgggacagttctgagagctgttggggtcttgggtagttccacatttatcaccttgtataatcttcctaccccctctttctaaggtgctttgtggcggtgatttttttttttctttttaaattactggtgaatgaatgggagcctcacatatgccaggcaagcactctaatatcaagctgtctctccagcccctctctagccctcttaatgatgattggcagtaggactagttccatacagaagtcagtcacccagctgaagtaggtgggtccttctgtggcaacagtggttgagtcagtaggaagtgaggtgaacacacagtctacggggcggatgtgtgtgtgaagtgaggtggggtacaaaaaaaaacgtgtggtatcgagggctctcaggtacccgcagactcagcagtcaggagtgaccggcctcagccttgcccctaaaggttaactcttgaccctttgctgagctctttctgctagggaagcttccgctgaccttatgctcagaggcacaagtggttttgtgtttccctccaagccacagatcaaccttggggttttctgggaggctgcagagggcagtgggcggggctggggctggggctggggctggggctggggctggggctgggggtggcaaccagtagataagtaggaggtgtcctgatgctagtgtattttctttgttcatgtaaagtttttctggtttttgttttgttttgttttttgttttgagtgctcaaactattagtaacttagttatgacagaattttttttttgagatagcccctctttctgtagctgtggatatcctggaactcactatatacaccaggatggtttctaactaacagagatccacctgcatctacctcccaagttctgagattaaaagcatgcactaccacatcaggctcagactctttttatttactgcatttatattgtcttatatagaaaggtacagattagcgcccaaggatctcacagcctgtcttatgcctctggaatgcatcagactggattggtccagccttaggaaacccagtggttgggtactcgggtagaacacacagtcagatctgcaagcagctgtgtctcaggcatatatgccccagctcctgcctgggctccatgccctacctgcccatgtgagcctgttgccaggctctgcagtggcttgggggatggggggtgggggtggggcagtctctgaacctttgcaactgctccagctgggtgctgccagctctggtggcctagccacatagtccctgactcagtgggatgccaggatgtcctttggtgctcctgaaagcttcagtacccctgcgtgtgacttgggtcacagctgggcattaattggtctcagtaaaagcactttgaataggctcggatgaaaggggctctcagagttcaaagctctgcagggttttgggggtgaggaaaggtggcagctgtttaggtgatggaagaaagaagacgctgaagtctcagacaagaagtctgggtacacaggcttggaggcttagggacagagagttcctcactttctgttctttcgaccacacccctcctgctacattcttgtgaagcctggaagctcccgtggtcaaggcaactatttagtcaagacctcaggtcccttcctatcgaaaagtgacccacatctctctccgtgcactgagatgcatcccaggaaatcacgatttatctatccttaaagagtgcaacccctttcctctgctttaacgctcacagctcttgccctgcccttgtcctcacggctcttgaggctcaaactcctgcattcgtgccaatatccttcttcaaaagggtggccactgtctcagtggctttgatgactttggtgctgggacagtgctgcagctgaagctgcgactttctcagcctcccaggaagaggaggaggtgaagaagggaggtcggctagggagggagggcctgggagaaactcctcagagtccgtgaatttttccccctacacggctaccggagaatgtctgtgtctgggctaatgggaatgagcactaccaaatcacgagaacgtatggctggaggagaccttggagaactgccggcgttccagtcttctttgtaagccttaggcaaatggttgcagaacctggcttgctttccctgagagacaaggcgcccactacctacctgctcagaaagcccagtccaccagtgtcttcgtgtgtgtgacatgcacagccttagtcttggggccgcgctaaacaggtgcacaatctataagatggaaggaagctctctgtatccatccactctgcatggtgagccttacgtaggacagtgccggtgttctggaaactgggctttgcagaggcttccgggggaagtatcggaaggaggaacctggaggaggaggggaggcgtcctctttactcttgggcagggcttatggctcccctgagagttaacacttccctctccagccaggcctggctgagctgagacaagccccaccttctctcatccagtcctttattcaggtatccaggcaacaggaaacaaacagggagggcagagggagggcctgtctgttcaggcttagtgggaaaggctctgaaccccacacctaagctttcttccaaagcctctctgggcagttgtttagagcaggccaggcctgggaccaccctgggggttgaggggaccacagcttctctttgaagatacgtgatgggaaagtccaaatattgaagcaaaagcaaattttattcctacaagtccaaaagccaaggtcccactggacagatagagattaatacatcacaaaatctgtctccacacatgggggcgcatggttcaggccaatcaatctgagttgcagaatcagtcccgaggacctggctatgatcccagtgaagttctcgtaggtttcgagtcgaaggttccaagaggtttagtgctcaaggattttatctactctgttcaaaaataatcaccagctgtcactcctggtttcattttttctgaattgtgtctggcaggaccctggcttacttcccaagcaccgagacacagctctggccacctcaggggttctctctctctctctctctctctctctctctctctctctctctctcggctcatcatgatcagtaaccttttcagtctctctttaaacatcatctccaccaagcaggaccttgtgattattatcagcacacctcatcacatcgtgggctaagtgtcccttcccttggctctgtctcccatccacggggatgctataggagaggagccgagactcttcgctctttccccacattccagcatgaagtccagatgaaggtccatgagatggagatgcagctgagcttcgtgctgtgaagatacctttagcgtgaaggcttctcggttctccctcagctctgtcattaggattccacacactctttacaagggattccctctcacctctgcttgccctcctggcacttcagtcaatgacattcagtcaaccttctcacgtccctggagaccaggtcgatcttttagaagtcaagactgtgtgagccaggtcagttctgggatactgtgtgatgggacagatctcggtacatccaggctccctcttgcagtccccctctttctgaggtgagccagtggaaatgcagagtcttgggaggctggatgacgggcccagagaatatgtgggtcacctgtgtttgaagttattgcttacggctctgatttgagtttcaatctacagctgcgctgcacatcttcaaacttaagcactaacagatctgctcttctccaacgtgactctgatccttcctgtcagaacttaagagtgatccttcatccaccaacaccatctctgaacccctgcccttggcctcacctggtagtactacatcttattaccttcactgaaacctgctgcggagtcagcggctgtggtggtcccttggtttccagaatccagcttcttcgccaccaccttgctttgagacccacatcataccatctgtctccctgtggtagttcctaactcctgctctggaacccctctgaaacttgctcaggtggttaaactcatccccgagtgttctggggtgagctctaggtctacatggggacacagaaaagggagtggaggggccggccatgagggaggctggtctaaagggggtcaggttgaagtcccaggtcagctgggggtcttgaagaactaggggtttgtgtggattgctgataggtggttttggaggatggttaggctgcctgtcctccacagggatctggggttgggctagagcacatctctgaagctggctctgattgctggtcatgcctcttccatcccccacagtctctgttcactctcttctaggactttgtctttaactttttatttctgtcctagaatagaagcaagagctattgtcctctcctagcacagaagtccaagattttctgatgtcagcctggacctttatgggatctgaaagggaagtgggggtgggagtgtgtgtgtgtgtgtgtgtgtgtgtgtgtgtgtgtgtgtgtgtgtgtgtgttagaaatgggaagtttagggcagagtcagatggtgaaggaaaggcaagggaagatttagagcagaatgcctctcaggagtggggccctcttcttttgctgaggcagaggcttaaagagccactgggctgcaggccagtcttagaaggtaggaacactaggctggatctatgactggtaccctctctcctcctccccacccccatggcatagggcagggagactgacagcttcttttataggctccaaattgcaagcaggtgacaattagccttcagtaggtcatgggggatcaacgataatgctgtctccttttccagctttgagaaaccctctgtgaacccctcaaaagtgtttttttttctaattaataggtcctgattcttccctagccccccaacctcaacctctctggggctccacaatcggatccctccccccagcaaatctctctgaggggcctcatcttctggttccgtctggcgacagaatcccctggttactcatagcttctggcatctgggagcttcctcaggctgtgagcaggcggtggagcaggacttcagaagttacatttgttatgggattaagttgcttcaccccctctcatatgggctcgtgcacttttgaatccctccctcagaccctgggtacctcactatgctccagtcccgtgcttccagcattgagccaaacctggatttggcaggtgtgtgtgtgtgtgtgtgtgtgtgtgtgtgtgtgtgtgtgtggcgggggttgttatctttctatatcttaaaatctctcccttttggttaccttgaagctgcttgatcatgtatttttacttcctatcttaaccccaaccaccctctcctgacttaaatcccatactcagttcaaattcatttgtaacaaatcttaaatcaacttcaaccgggcctttgagttacctcaacctgtacgcacacgcagatctgtgaatgacactgaaaacagatttctttccatagcacaaagtcccgccttaacannnnnnnnnnnnnnnnnnnncgccaatggatccctccatgtcagtttagtggaaccacaggttcagccctttctattcattttccctcttcctgatcctgtctgtctccccctccactcaccactggccttccatgcttcccctctgatatgtagtagtagtagtagtaggcaatatggccaccaggctctcctttggaccacttgggactgagtgccaggatgcctggctatccctagttggtcagtagctgcctctgaactgaatctttgtttttccgggcttctgtttccctatctgtagaacggggataatgacccctgttttcccgaaggctcaggacaaccccataaatctcaaaatagataaggaaataaggatagtcactgtgtgcatctggcgggccccggagcagcctgttattgttggcagtttgggtagaggggtttagaacacagagctgcgtggactccgtgtgcttccttattgtcttgtcctattcttctaagagggtaggtcttggcagcattcctgagccccataactctcctgtggactcttccccctctgcccttcctaagccccaggtcagtagtggaaaaggctcccttaagggcccaagctgttgaatgaggctcctcataatttgtgtcctattggatagtcctggaatccagagaaggttaaggattgaactgaatgcatggaccaaccaacagtggctggctttcccctttctgctggctaagaccctcccaccctgcctagatctgtgctggcttagttactgtgatggttggatgccctgtagatggtccaggctttgagggtctttgttcttaggggattctgactcctattaacactgggcctacattaaaccttcagggcctggctgagatgccaagaataaaaaaaaaaaaatcccagaataaagcacacagagggtcccagtccttctcctacccacatccccgtgagagatgtacgcacatgacctcctgtcttgcctacctcaaactttctctcacagtgcacagtccctcactccctccacatgccttgatccttcttcttcaggcttcagtgaactgatagaggtttgtgtgggaggtaaacccatcatagcacttcctgctctctgggatccttgaacttggggatgacctttgtgccagcaaggatggagaaacagtagcgtgggaagaccctgttcttacacaaaccccttccttctctcttcaacccagaagcttcactcccttgaaagggacagagaaaagctacgttcctgttacctgggctttccttctaggtcccagcacagcagagggatcccttctctgatacactatcttttagacctgacctggagggcaaaggatgcttgaagggactgggacccggaaatctgggtcttctgcaatgggagggtgcatgagactcagggatatctttggttatgttaactcttcaaatgctggccatccttcctctggaaatctggcttctccttcctctttcccacttccccccagggaaggaggcagcaaatgagtggcgagaggagctccgtggacgctagaaaatggggcgactgttgtcaccccgaggacttggccaggaggaagtggaggtttaacaggtgcctaattacaagtcccgctggtccccctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1472 - DNA, 880 bp, Mus musculus
ggcaggatctggaacgaagacatcaggaaaaactgaagatgcaagctgaaattaaacgtatcaacgatgaaaaccagagacagaaagcagagatgctggcacaggagagactggcagaccagatggtgatggaatttaccaagaagaagatggctcgagaggcagagtatgaagctgagcaggagaaaatccggagggagaaagagaaggagatcgcccgcctgagggccttgcaggagaaggcgcaggattatcaagcagagcaggatgccttgcgggccaagcgcaaccaggaggttgcagatcgagagtggcgtcgaaaggaaaaggaaaatgcgcagaagaagatagagacagaggaaaagctgcgcaaaagccggctggagcaagtggcattcaaggaacacacgctggccgttcaggttcagcgtgaccgagatgagttcgagaggatccttcgggctcagagagagcagattgagagggagaagcaggaacaggagaagaaagccaaggggtgcctccagcatgccaacgagctccgacggcaggtgcgtgagaaccagcagaaacacgtgcagaaccggctcgctaccttcgaagagggccgccgcctcaaggaggaagccgagaagcgccgcgagcgcatcgaggacatcaagaaacagaagctggaagagctgagagccaccggccttcctgagaagtactgcatcgaagttgagcgtaaagccaacatcctgccagccacttctgttaactgaaggggaacctctatggtctctgggagagcacagattcagcttgctccccggggcatccaaactgctgctaacctacacatttcatagttacagattaaagctattctattctctaa

SEQ ID NO: 1473 - protein, 253 aa, Mus musculus
QDLERRHQEKLKMQAEIKRINDENQRQKAEMLAQERLADQMVMEFTKKKMAREAEYEAEQEKIRREKEKEIARLRALQEKAQDYQAEQDALRAKRNQEVADREWRRKEKENAQKKIETEEKLRKSRLEQVAFKEHTLAVQVQRDRDEFERILRAQREQIEREKQEQEKKAKGCLQHANELRRQVRENQQKHVQNRLATFEEGRRLKEEAEKRRERIEDIKKQKLEELRATGLPEKYCIEVERKANILPATSVN

SEQ ID NO: 1474 - DNA, 47753 bp, Homo sapiens
  misc_feature (1)...(47753): n = A,T,C or G
caccctaacatctctgccccagctttattcacccctactcattctccttggttccaaattttttcctgttcttcagactctctcccctctctgtgccgcatgcacgggtctctcagaaggtagcaggaagccctgacagtcttcaagaatggaaaacagaaaaagttttgaagaaagagggaaggcaggaaatagttgaataaaataattaatgcatttaagtatttgtttatgttctaagccatactttgaagcagttttgagaattcaagtgttccaggaagaaggagaataatgaaaatagtgaaatagcctctcaggcctctatgcaacttggaggatttatgttctgattcctgatggtgtttatattacattaagaacaaataccccccaccccccctgccccaccatattcccatgctctgggggaaagaagtgcaaagaaaatagccagacactgtgcaaattgatttttccagcctggtcttatcttcatggtatctctctttggggctattaccctatctcacagattaagaaacaaggcccaggtggttcagcaagttacccaaggcctctcagctctaagtggctgagccagggttcaaaacctgctaatctgtctccacaattagtcaccacttctcttcttcactttgctcccccagggaacacaaatcagggagacttcttctaggatatcctagatggaattattgactaggaaccaggcctagaagaaatgatgctgtactgaggactgaatgggcattgcagaattcctttattgggggggtgggcacccctaatatgggagcagaggctatatagggcaatgcggacagttccaaaggaaggggggacccctatcctggagaattcccagtagttagcaaaggagttcagaggaaacatgagagaaatagaccaacattaacacaagttatatgcacttgcaaagactcttccacaggaatgtggaaaccccatatctcattccaactctatggtcctgctatccccatcccagtttctttgccttcttctttcacatccagcctcagcatctctgatccctgcactgggaggtgcagtttcctaaatgcggttcagagaaaggggacagggaagagaggaggggaaggcaggggacgggagggagggaaggggacgggaaggacagagcaagaatcagggaaccagtctcctttctcgttgttcttagacaggagacatgctcaagtaacaggctagacttttcattgtaaccatacggctgtgctggaccttgtctcccagactcctctcatttaaatatgcttattcatcagagggtcaaaattcctatccctcccacctccgccgtgcagggagaacctgggggccagcggggtgaccagcacccaggtccagtggctgtgaggtagaggtgccaggaccaagtccagcccaagattgctgggctctgctcctgcctcctccgcacccagctactgtcttggatctgagctcctggcccctggctgacaatcaggctttattctgagacttctctgggagtaggaagggtcagggagcccgaggtggggttagggttgggcagagaatctggacctactctctttctcaggcatctttagtctctaaacttttccccttgttctcagtccttggcttgctgggcagtgagaatgggttgaaaatgggatcaagaactaggaggagagtgaaatgagagcttgggggaaggaaagggactctaaagatgcacaaatagaaaagggggaaagaaaagctggaaaacaacagggaggagaagagtgagtggagcttggcctaggttgggaggtgagagtgaggacacccccgctcctcacccccagcagcaccagatatggctgcagttttgagccaagttttgctgagaaggggaaggttgcctccctacttatcagggtggaccttggttttgtgaggtatgaagcttatacaatttcgaaagctccatttgtgaaaaacaacaaaaaattattaagattaattacagaagtaaacatttgttttgaataataaattcacaacaaattacaaatttaaaaaaacctggcaaatactataaacatcataagatttagaaaagtaacacaggatttgtgtgaattaattgcttgaagcaactctaaaatacaatagttttatctttacattgttgcctgcatacactttgtctcttcatatgacaacaatgttatcatattatttgctacagagagcatagaaagacaattcagtcttttctctggcattgtaagtgtgggaaaaacactcaaagttcttttccttattttctcactcaacaacaatcaaggcagacagaaggcttctgtgatcaaatgtgggggtcttctccccaccaacaaacaagcagttgattctgcagcagataccagctcgaatgcaattcatgctacctacctggagatagtgtcagatcccaaaggttgggtactcagcctccaaaactgctccttgcttcagacagcagtcacaagtctgggtatccggaacttctgactgaccggcttaagttggggttcccacaacccccctttgggttcgattcatttgctggagcagcttagagaactcagggtgacatttacgttcactggtttattataaactatattgtgaaggatacagataaagagatgtgtagggtgagatatggaggaaggagtgtggagtttccatgccctctccacccctctccaaccaggtgttcaggttcagctgaacacctgaacctccaggtcttcagctatctggaagctcctgaaccctgttctcttgggccttttatggagacttcgttggataggcatgattgaagcatggacattgtgtagaaatatgattggaacaaaagggaataacagactgactggggaaaacctggcaggacctgtctgttcagatttttcttggcctctctgtgcagcattccttcatttaggtatggggcaggactctctggaatgagggtcttgtggcccacaaccagattagagtcttaccttgggcagatgaaaggagagcagaagaagatcaaagagagagagattctgtttcctgaggcctgcttctgaggcctagagcaccccaacattataacaaaagactatctatgggagttatgagccaggaatggtggataaaaaaattatatatatagatgattgatagataaatgatagataaatatcacaggcatggattgatcaacagttctattacagattagaatgtttcacttcacagttctttgtaaatcatgtcaatttttatgatagctgtcaatttgggaaaatctgtattaaaatttttaaatgagttgtatgatttcagaccattgttcagtaattaatcctaaatgttctcttttttttgaaatatggtcacacttggtcacccaggctcgagtgcagtggcatgatctcggctcactgcagccccgacctcatgggttcaagggttcctcctgcctcagcccccaagtagctgggactatagccatgcgccaccatgcccggctcctaaatgttctttgaattgatggcactcattaaccagttcatcataggccctcactttagtgtgctaatgtgaattttacacaatctccaccaatgtcaatgtttatgtcaaatcaacaagacatttagtattttcccaacatattcatggaatttccttcttcttattagattacaaacaatccaaatgcctatgtattctattaaaaatttgtctattcctttttttttttttttttttttgagatggagtcttgctctgtcgcctaggctggagtgcattggcaccatcttggctcactgcaagctctgcctcctgggttcacgccattctcctgcctcagcttcccatcctctatttttttttttaatgggggtggataggcttcaatttcatctaataatataagaaaaaaaaagtaaaagaaaaaatagagatggagtctcgctatattgcccaggctgttcttgagcttctgtgctcaagccatccccccacctcagcttcccaaagtgctgggattacaggtgtgagccactgtgcctggcctacctattcctgttattgaatgataggcacatctcattttattgcactgtgctttattgcgctttacagatattgtggtttttacaaaataaaagtttgtgacaacactgagcaagtctatcggcaccatttttccaacaccatgtgctcacttcatgtctctgtgtcacattttggtaattcttgcaatattccaaactttttcattattattatatctgttacggtgatctgtgatcagtgatttttgatactactattgtaattgtcctggggcaccacaaacagcacctgtataaacgccaaactgaatcaataaatgttgtgtgtatttgacccaacaatattgaaattaggctagttaataaccctacaatgtcttctaagcatttaaatgaaaggaagagttgctgtctctcactttaaatccaaggctgatccaggtgagaaggcatgcctatagtaccagctcctcaagagctgaggcaggaggatagcttgagccaaggagctggagtccagcctgggctatgcagcaagaccctgtctctctttgaaaaaaaaatatcaaaagctggaaatgattaagctcagcaaggaaggcacatcaaaagctaagataatctgaaagctagacctctcatgccagttagccaagtcgcaaatacaaaagaaatgttcttgaaggacattaaaagtgctattacagtgaacacatgaatgataagcaaaaaaaaccagccttatttctgatatggagaaagttttagtgctctggatagaagaccacaccagccacaacattcccttaagtccacctagttgggccgggcgctgtggctcatgcctgtaatcctagcactttgggaggctgaggcgggcagatcacaaggtcaggagattgagaccatcctggctaacacggtgaaaccccgtctccactaaaaatacaaaaaaattagccggacgtggtggcggatgcctgtagtcccaggtactcgagaggctgaggcaggagaatgtcatgaacccaggaggcggagcttgtagtgagctgagattgcgccactgcactccagcctgggcgacagatgagactccaactcaaaaaaaaaaaaaaaaaaaagtccacctggtcaagagcaaggcccttaactctcttcaattctatgaagggtgagagaagtgaggaagaaaaaagtttgaagcgagccgaggttggttcaggaaagaggttatctccataacataaaagtgcaaggtgaagcagcaagtgttgatgcagaacctgaagcaagttgtccagaagatctagctaagacaattgatgaagatggctacactaacagattttgaatgtagatgaaacagccttctacagaagaatatgccatctaggactttcatggctagagagaagtcaatgcttcaaaacttcaaagggatggctgactttcttgttaggggttaacacagccggttcctttatttttttattttttatttttttgagatagggtctcactctgtcacacaggctggagtgcagcggcacaatctcagctcactgcaacttctgcctcatgggttcaagtgattctcatgcctcaagtagctgggattacaggcacatgtcaccatgcccagctgattttttttttttttgtatttttagcagagatagggtttcaccatgctggccaggctggtctcaagctcctgacttcaaatgatctgcccgcctaggcctcccaaagtgctgggattacaggcgtgagtcaccgcacccagccagctggttcctttaagttgaaagcaatgcttacttatcattccaaaaatcctaaggcccttcagaattatactaaattggttctgcctgtgctccatcaatggcccaacaaagcagggatgacagcacatttgtttacagcatggtttactgaatattttaagcccactgttgagacctactgcccagaaaaaatgattcctttcagaatattactgctcattgacaatgcatctagtcacccaaagactctgatggagatgtagtagaagagcaatattgttttcatttctgctaacacaatatccattttgtagcccatggatcaagaagtaatttccaatctcaagtcttattatttaagaaatacattttgtaaggctataactaccatagataatgatttttctgatgaatctggtcaaagtaaattgaaaaccttctgaaaaagatttgctattccaggtgccattaagaacattcatgattcatgagaaaagatcaaaacattgagattaacaggagtctggaggaaggtgattccaactctcatggatgactttgaggggttcaggacttcagtgtaggaagtaattgcagacatagtggaaatagcaagagagctagaatcagaaatggaacctgaagttgtgatcaaattgctgcaatctcatgataaaactggaatggtgaggagttgtttcttagggagtagaatctactcctattccattgacgatggagctttaaaacaacaaacaaacaaacagaaaagagtttactcatggtgaagacactgtaatcattattgaaatgacaaaaaagaatttagaatattccataaacttagaggatacagcagcggcggggcttgagaggactgatgccaagtttgaaagaagttctattgtgggtaaaatgctatgaaacagcattacatcctacagagaaatctttcatgaaagaaagagtcggctgggcgccgtggctcacgcttgtaatcccagaactttgggaggcggaggcgggcggatcacctgaggttgggagtttgagaccagcctgaccaacatggagaaaccccgtctctactaaaaacacaaaattagctgggcgtggtgctgcatgcctgtaatcccagctacttgggaggctgaggcaggagaatctcttgaacccgggaggcagaggttgtagtgagcggagattgtgccattgcactccagcctgggcaacaagagcaaaactccgtctcaaaaacaaacaaacaaatacaaaactaacttggtgtggtggtgcacctaatcccagctactctggaggctgaggcagaagaatatcttgaacccgagaggcagaggttgcagtaagccgagatcgcatcattgcacttcagcttgggcaacaagagtgaaactccatctgaaaaaaaaataaaaaagaaaggaagagtcaactgatgtggcaaccttcactgttgtcatattgtaagaaactgctgcagccacctctgctttcagcaagtgctaccctcatcagttagcagccattaacactgaggcaagaccctccaccagcagaaagatgatgactctctctgaagactcagatgattgttagcactttttagcaacaaagtatatttaaattaaggtatgcacatttttttagacataatgccattgcacacctgatagactacagtatagtgcaaatgtaactttcctatgcactgggaaaccaaataatttgtgttgctcacactgtattgtgatattagttttattgcagtgctctgaagcctaatctgcagtatctccaaggtatgcctgtagacacatggccaagggttcttctctgagccttgacatgtgcttacgtaaatgagaggcctgaagcttaagcattgttagctttgagataaatttttattgtattttatttattttatttttcaagacagggtctcactcttgtcacccaggctgggtgcattggcacgatcatggctcagagcagcctcaacctccgaggctcaagtgaccctcctagtgcagcctcccaagtagctgggaccactggcatgtaccactatgcctggctaatttttgattttttgtagagatgggatctccctatgttgcccaggctggtctcaaactcctggatgtaagcaatcctcctgccttgggctcccaaagtactgggattacaggcatgtaattgcctgctgggaggcaagtcccttacactgcactctgtcattccctccttcctgccataacttttttaatttttctttgagacagagtcttgcattgttgcctgggctggagtgatcttggctcactgcaatctccccgtcctggcttcaagtgattctcctgcctgagcctcctgagtagctgggattacaggtgcctgccaccacccccggctaattttttgtatttttagtagagacggggtttcactatgtcggccaggctggtctcgaactcctgacctcgtgatctgcccaccttggcctcccaaagtgctgggattacaggcatgagccaccgcgcccagccctttctgcctcaactttgcaccttttcttcagagagttaccctgggctgagaaaagaatagattttcaatttggacagttttttcttggcttgtttcctctttggttacacggatagtaactatgtcatgcagatgtgcctgggagaatggggtgaatacaggaagcaccttattcacagtgggccggttacttgtcttcccttctttctgagctgcagggaacggggttctaatgccaaggcttagtaaggaaggttcccacgaacaaaacagccccttctctcagtcccaagcctcccagggactgtgctcctcctcttcaggccttcccttctccctctgattaagccttcaacacttggtgggactgggcaggggacacaattttgtactcttgatcccaaaggagataaaggctgggaaatctagggaaggaatgtgaagcctgttggagtaagtccttttaaaagcagcaagaagtgaccttgtctccctctttccattcccccggggcttgtgaatagccttcagtgcccaagttggagtaagagcttcagaaagactggctgtgagggtttggagagaggtttgagaaagcagctcagagactcacagagtcacaccaagagcttagctaatcagctaatcagcactggaggaagacaaatgtccttggtctggtgggacagcttcgtgaggcttggagcatgcagcctaccaaagtgagctcagtgccagccctgcaagttgggaggtagagaggccaaaccaaattggaaaaaatgacaaaacccctatgtactttctagaacaatacataccagctaggaagtgttaaaagacaagctccccaaagtcagttccttagcttttgacttattctaatgtagggcctccatttttaataaactctcccaggtgattcttagctgcagatttgaggcccgcaatttaagaaactgctcttgagactgcatagacatcctcagggctggaagttctttgttgacccgaccagattctctcctgctgtggaactggtttgtcctgatcctgctggcttctctgcagactacactcatcaggggttggcttggcgcctcctgggcaatggggcaagagtaatcatagcaacctaggtgaagtcccaggggaaaactgtgaccctgggccaggctcctggggccgctgacagttagaaccccctcggcccatagtaagttctttaggttcgggttctgacccaaaagtttggccaaagccaaagtggagagcagggcacgccagggcgggtcaatccttcagagccgcggttgggctggagcgtggagctgcaacggttggagcgacgggctccggttcctaagccaccagcacaaggcaactgcccgctggaggtgggaggggcggggccgggggcggggcctgagccgaagaacgcgggctagtggttgccaaggtaacgcgtcaacactagggccttggcggcgccgaggcggcagcagaagtccggagtcagggcgtgtggctgaggagatggtgagggagaacctcagatgggccccttgtgtcctgaattgggtgggggctctgagtggggaaagtgggggcctaggggaggtcacagttgggtctaggggtcaggagggcccaggagtaaggagaacacctctagaagaagcaagggagatcctgaggtgggttcaaaagaggaattagggatagcatcgataacgattggaaatgtggagcgcgctgagcggaggagttggggagaaagggatgccccaaccctctccccgttgccattacagcggggcctctgtggaccaaagattgtggatgtggtgtgggaaaaagcaatggtgggccgggcgcggtggcttacgcctgtaatcccagcactttgggaggcagaggcgggcggatcatgaggtcaggagatcgagaccatcctggctaacacagtgaaaccccgcctctactaaaaatacaaaaaattagccgggcgtggtggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaagcactggtgaggaggccagataatgggtcgtggtacctgtttttgccactaactagcaaggtgactgtgggtaagtcatctaatgtgcccgagcctcaggtttttcttctgttagcagggctttgtatccctcagtagttagtcaataaatatttggcagtgaatgaatgaatgaataaatgagtgagtgagtgaggagggtctcaggtttgcaaggcccgggagagagattgggacaggactggcagcctggggtttgctgggatggggagggctgtcagggtactgagggctgagaaggccagcaaagcctgggaggaaccatgaaggggatgcctgggcttgagtgtgttggtcccagaggggaggggaagggcagatgataagtgttggagtcttgggttattggaactgacctagaatgtctggggcacaacaggtggcaaaggttgctacttggatgtacttgtggacagacttcaggcccaggggctgcattgcttttctggggctcagtggacctcagaagaattttgttaattattaaataagtctccaacaaagagcagttcctgactttcgaggactccctgcagtgttgtaattggggtgggggagcgtcccctttcacttatgtattctatttgattcagtgtcccatcttctctcagcaccttacaaacacagtggcgtatgtatgtatgtgagcacctactgtcatgcctggtgtctaagggcatatggtaaatgttagttccccttttgtcctcttttaaaaatttcctatttccaagctctcatagggcataagttgcacctgggcaagacctgtgggcttcagagcacccagatcagggattccccatccaggagccactcagggcaggggtttgactcactcactgagcccctctgtaattcctgggacaggactgggcatatagacacctttgagaagcagtgggtctaagttagtgatctctggcaggccagctgtgtgtgttcgtgtacgtatagtgctactcactaggtttggagaatatttaaaggcatgagaagagatagtagtggtggtgagggtcacaattaggcagacttccagaactcttacaaaaataatgattaaaatcctgcagaaggagagatggggacctcagtactgactaggatgttatcttctggtggcatcctacagatggccaacttggtcccaattgaagaaagaggataattgcgtggatcactcagagtaaaaggcaaggggtctcgtgcatgggaatctccctttcttggtaaccaaagtctacagaaagggaagtagaaccaggccaagagtttgaagcctgaatttgccagcctgcggagactgtgcaaaagaagaactagatctcagaatgggtaagacatctaggaaaagacatatctttcctgaacatgtcaacctgtttagttgacaggtgttgaagttacatcagggaaacttcacactgacctattctagccccattccagctttgtcttgctgaatttgagtgaaacattctggatcccagaatatataatgctatggtttttttgtttgtttgtttgtttgttttcttttttaggtctgtactctcttgctttcagagttcgggcaccaggcccattgctatgctttgttttcaaataaaaattgttttattgttttttttttctggtcataaaattggtatctactcattgcaggaaattattcaataaagaaacatcttaagatggtaaaggttcctgacatactgttaaacatttttttgaacatgctttcagtaatacattctgggcacatacctgccatacaaacatctttacaagagtacttctacatttctttttctttttgagatggagtcttgctctgtcgcctaggctggagtgcagtggcgtgatctcagctcactgcaacctccacctcccaggttcaagcgattctcctgcctcagcctcctgagtagctgggactacaggcgtgtgccaccatgcccagctaatttttgtattttttgtagagacgagtttcaccatgttggacaggctggtctcaaattcctgacctcaggtgatccacccactttggcctcccaaagtgctgggattacaggcgtgagccaccatgcctggccaagaatacttatgtatttctttattattattattttttgagacagtgtcttgctctgtcacccaggctggagtgcagtggctcaaccttggctcactgcaacctctgcctcccgggatcaagcaatccttccgcctcagcctcccaagtagctgggactataggtgtacgccaccgtgcctggctaattttcatattttttgtagagatggggttttgccatgttgcccaggctggtcttgaactcctgagttcgatggatccacccaccttggcctcccaaagtgctgagattacaggcatgagctactgcacccagccttatgcgtttcttacagtctgttttctttacaacttaacaagttatggagatcatcctatatcaatgactgtaagtcaaaattatcatttgtttgatcagcaaatctttctgcatcagagtctctcatagagctcctagctgtggctgaattcttgtgctccaggagttggatggcttatgaagagagggggagtcagctgagtcaccaagacgaaaatatcaaagcagggctggcatctttatctgtccccagtcctcatcttccccagaccccctgccttctcagctgccttcccttcaagagttatcttcctgcaagcaggactggatgtgcttctccttaggcactgttcagcttcttggcaatatttatttggtcatgcaaagaagaaaaccagcccgtcacctccttaaagaacttcttcgctattgcctctggcccagagggatccagctttacatttgtgcttgattcttcatttttttctagtatgtttacacagtgacctctctaatccttgttactcttggcaaaactgtttattctaaccctggtgtaaggctgcggcttcaaagtcagcatttccccaatgaggttttctcaaccacccaaccctagagttcagagcttccctctgtcctgctcagtggccacttttctgtggtcatctgtttttcttcctctgttctggctcaggcagtccttgctgtgacttcctcttgacctgggtaccaagggcataggaaacaggagatgcaggctcagccctggaggaacctgcagtctggcggacacttcagcacaagggaaaacctgttggagtccttgaaaacagacaggaaaacaaatggaaaacaataatactttccatctgtattccaaagccctttcacatacgttattatccacagtggagaccacatacgtgatctggaaaacatggaatggtggagtgacttggagtcaggcagttgtattccggaaaagtatccatctcaatctggtctgcagtcctgtccttgagaggtcaccttgttcggttttattcattcttcatcaaatgcacattgctatattgttcctactacatgtgccaggcactgcaccttttcccttaattacatacaaaactcatgatccaaagccatccaccttttccagttattcccaatgcttagcctcaatcccacctactgaagtttctattcatttcctcttattctatttttggtggaaaggggagccgtagctcaccacctaccatataataacccttcagaggctgttattaggcatccttggggctgctatatttaccttttaataaatccaagcttttctgctctacagtattggggctggctgacgctgtagagggagactccctgtgtaagccttttgctggctgtgccgggcagtgagggaaatgcacatatagcattgttcaatgtacagcacagagacagctggaaaataattgtccaatcgagtgtgaaaacctgatacaggagtaacaggtgctggggtgtctggttggtaatggcagatcagagagagctttcagaacactgtccagggcttagggacctggaaagcatggtatatttccctgtctaccctgttcctttatcagctgctgattcccaggcttggggagacccaatgtgcctggcctattccttcaaggtagcccagtttagagaggtgtggggcatgtgggctcctccaaagtgaggtttgaatcagctttatcataagcctggagtcatccagtagtccttgtagacactaccttttagagatagacgtctactcttgggactgagatgaagctgcctgtcctttgggaatggaggttgtgttcgtcagattcttagttacaagcaacagagccagaattccaatttaagtaaaagagaatgtgttaagagggttttggagagctcacaaataggaacaaaagaagtttctgcagctggaaccaagaccaaaatcaaaacctagaactggtctggcaaggaccctgatgcactgttgcacccccaaaactgccaattccttacatagggtgccgctgctggtatcgttatcagtgttgcccagacgctgggtctggctgccagttctgtttgggtcagaaaggttttccttgttctgccttttggtccactagttccctagtcattgtcagtccagggccatctcattggctaagcctaggtcccttggccaggctgaggtgaatatttgatgttttcagcttctgtagttggagaagagcactatctcccacaactcattagatggggaatttgccaaaataggaagttagtagggggttaaaaaatgactaaggcacactaaaagggtcttgggagagaaacagccaaatagtgggtattatgaactggtttgcttgattatagctagtaatcatttatcattcacccactgcctcaagtttattgggcatcaaccacatgccaagcagtgggtgaggcacttttccatcctttatatcctgtggtcccaccataaccttgtaagattgtggagacacgaaggaggtcaaacagtagcgtcatttgtgagaaagacttgaagcacaagctgaaaagattggaggcaaaggggacactgtgcgtgtctcagggggcaagcccaagttgccccacaagagattgtcctcttgggaaactggtactaggcagataatgagaaactgttgcttctctcctcctgccattcctgcttcctttatccttacttccatactatgtggccgacttggccttcagcttcagggactacagaaatgctcttaaaaaaaccccacaaaaaacaaaacagttttgtttttaattgacacataatgattgtacacatttatggggtatagtgtgatgttttgatacatgtatatacattgtgtaatgattgaatcagggtagttagcatatccattacctcaaacacttgtcatttctttgcagtgagatcactcaaaattctctcttctagctagtttgaaatatacaatgtaaattaatatacattgtatacatgtatatttatatatattattgtatacatgtatattaatatacatttatatatagtaatatacattattgttaactctagtcattctattgcgctatcaaatactagaccttgccatctcatttaatcttataacatttatatttctcaaaatcctctcctagatattgtgtatctcttttgagatatacagtacattattattaactatagtggcctttctgtgcaatagagcaccagaacttattcctcctatctaactgtaactgcgcactcactgaccaacctctccccatgcccctccccttcctctcttcagcctctggtaaccaccattctactctgtacttctatgagatcaactgttttacacaaatgctgctttatgcagagctcttttttttgcagagacccttccctgctctgtggggatgccctccatctgttgctccttgtcccctatggttcagagtttacacagccgctttccctaactgtttctttttcacatgcccacccactcccccagcatgggctggtgaattgttgacttcccagggtctggatgccactcagtactgatgacccaaactttctgcctcttcctgcagccactaagcacagctggcatcctgagctcctcttctgccgcttccaacaggtcaaggaataaggctcgctatcggaccaaagccgtgagctctgaggtggatgagagcctctttggagatatcaaggtaatcctcaacaagtcctttcaagttgatgccacctgcaggcagaggcccaaaaatgtagctcagggcaaagcttctgctgagtaaccttgctctcgtaggtaactctcagactgaagacaaaggggaattctgagacctgagctgcagagctttgggatctagtggggcctatgtaaacagggacacctagcttcttccaccctagaatctctcatgtcttcacagtgtttaaaatctgttataatgtcaaaagggaggctcagctgcagagagtgcaatagttgctcagttgagctccatgatggaaacattgcagggctgatgggctaagcttgcagacaatagcaacatcttccccgctccatccaaggataatagcatcagagtacaacacaaaaccatcctcctttcccagttgctcaactaaaacaattacttagctttgggaaacgagcaggtctttatttgcaagtgttatctagaccaagaggtggacaactcctttagtctagataaagagagctagatagtagagctttgactgattttggtacatatggagtttagtaggtaagaaggaagagagggaaggagaaaaagagaatatgacatggagagaagggcagtgagagattaagagaaggggaaaagagaaagagagacactagtagtgacctgaatgcctctgccagtggggaaggtggggagaggagtgttgatgtctgtccctgctcttcaacatcttcattgtgaattgaagaggactctccagagggattgagataggcttcttaatccatttagaagactctcgctctgcagcagttttcctgttggtaagggaaaggatcaacagatgcatttattttttattatttttttaaagatagggtttcactcctgtcacccaggctggagctggagtgcaatggtacagtctcggctcactgccacctccacttcccaggctcaagtgattctcctgcctcagcctcccaagtagctgggactacaggtgcacaccactgcacctggctaatttttgtattttttgtaaagacagggtttcatcatgttccccatgctggtcttgaactcctaagctcaagcaatctgcccacctcgacctcccaaagtgctgggattacaggcgtaagtctccccacctggccaaaatgcaatttcacttacagacatttgtattgttgttgttgttttgggtacatgtggagttttctagtcaaagcaaagagagatttggaattggctgagttctccaggagtagtcatgctggctggcaaaagggggctatcagaaaaatgcttgtctcttgtccagtttctttggcctcattgatgggtaagagttcaggaagtctctcaatgggcagtagagggcagaagtggcctgtggcacgactgagttgtgcccacgtgaaagcagagatgggcaccaggtggcagcagcacacaggggactgtgggtgcaaagtgaggtaggacaagtggggccatccccctgcctctggtcaggagcacagtggctgcattaatgacacatcctttcctgtgtttagacattttctgaaacaggtgatttcatttaattgttatctaactccttcagggtcggagaattttgaaaaaaagaaaaaatcacacagttagtctgtgttcttgctgaattctaactcactgacctcctcaccaccaactcaatgagctggcagagagctacccttagatcttaagggtaggcctctgcaggtcatttagcgatttctaactccctgaatatggctttttgtgggggttaaagtaatttaatcgtaagaaagaatttaaaattaccaatatcaaagattgtaagagtctgtaacaaattatattgcttcaaacccactgtgtggtcctagagagataattatttcttctttcataaaggaaaatctttcatggagagaggaaaacctagagaacagaaatttactttaattcctgatgattttagactaagtatagacacacactagtgacccccactccttgctatccctaccattctgcgaggaatatctgtataagaacaagagacttgttttcagaaaagctggtcagggctgggcatggtggctcacgcctgtaatcccagcactttgggaggcccaggcgggcggatcatctgaggtcaggagattgagaccagcctggccaacatggagaaaccccgactctactaaaaatacaaaaattagccaggcatggtggtggtcgcctgtaatcccagctactcaggaggctgagggaggagaattgcttgaacccgggaggtggcggttgtagtgagccaagatcgtgccactgcactccagcctgggtgacagagcaagactctgtctcaaaaaaaaaaaaaaaaaaaagaaaagaaaagctggtcggtacacatccagccatgctcagatacagggcatcacgctgctctatccttgaagttaggactgaccagcaggaagtgggggtgacaagcttctaagctattctttctgaactcatagtccccagcccagggccagagcgacagccccattgtgctgctccgagataagcatacccttcaaaaaactctcactgctttgggcttggatcgcaagccagagaccatccagctcatcacccgggacatggtccgagaactcatgtgagtacactgtcccctgcccttctatgtccagtcctcatccttttgctaaggatctttgtagggagatgggtaaacccacctggtttcattctgtcagtccaatccccacttctttcctattcgttttcccctttttgtttgatagttctttctttcttctccatcctggcctctcttgtttctcccattgttgtatctattattgccactgtcctttattctcagcttcattgtccttccttacttctagctggctgtgtgagctaagggactggtagagaggaggtgcttagtgagtcctctctaagtccccattagtaccctccctaaagggaagtgatccagatgagtcacttcctttcggctgcattaagaatctgaagcaaagggaaactgaccagatgcctaattagccccctggcttcctcccagactctaaggccataggaagaaattcacaggggctccctgggttcctttgggattagctcaaccccacttcctgactagagctgcccccaggcttgagcccatcctgtgggacttaggcctagctcaaccatgtgccatgagccaacactgtgctcagtggtttaactcttgtgttagtgcttcaccctctacaaccgttctccctgccctagctccacccactaaaagccctaattcccagaaaatcctacctgtgtcacaagctggagaggcacatctagcacacaccccgggagctgtgtcggactgcggccccttactgagcatgtctggtcagccgtggcatcaagtggccagatgtggctagagccctgcagccactcctggagccagaggaagggaggaagggttccttcttggagccatctagtcctgaaaacacattggaggacaagtggctggttatttttcagggatgctgaaagcagtataaactgctgtcttagattcggatcactgctggtcactccagatcctaggctgtttagggccacgctgctttgtgaaacacaaggtcttggctaagctgcaaatctactcactcattctgtccatctcctggaccaccctcccccaacacacacacattagttttattagatgaggtttcacttcctgtctcagatgtctgtgtcttattggcatgtacctgtcaaattggcatgtacctgcctcacccagaagcagctttcttcccacccccctaactactccctcccccatctttaatatatgtcatttgcttgtaatcattataattagcgattggtttgttgaatgcgttggatagctagaaaggagaggtctatagacatgtctctggctattgttgatcacagattttaattaatatttacagttcaaagcttctctctaggctggatgggcagggaagcttaggtttctaactagcatctatatcaaccttgtctggcgtccccttgccgtttttatgtcatccttgaggaataatctgtttttaaaatttaattcaacagctttgttttgaattctcactctgtaccaagcgctatgccagagactaggctaccagtgtggttaagacagagtttgtgtcctgaaggagctcataaaggaaacagagctgcccaattggctgtgatacaggcagtaagaacagagtgcagtgtgggctcagaggaggaggtgatctattggtccttggtgggggggcagagtgggcacatgtggacatgatggggggtctcagctgcacagagaaggtaacatatgagcaggacctaatagaaaaaggacttaaaatgtctctttttagccttcaatgctacctgaccccccacttggaacatctactccccagtggacccatggcacacttgccgtctcttctgccattgggggagtccactggcatgatgggaagaggggaagagagcagagaagcctgaagtgtggtgctgagagctttccctctcccctccctaactctgtttattcttgtgacagtgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggtagttaacctccctaagccttcacctctgcagatgggtggcagaatcaaaatgcactggggaactctcatcaggggnnnnnnnnnnnnnnnnnnnnnnnnnnnnnnnnnnnnnnnnnnnnnnnnnnnnnnnnnnnnnnngagcagccggggccaaggggagggctgagtaatgaagccaggctgtggaacttcttggctctgacatcatcactggccaaggcaaaattgtactgggtcacctgtggtagccaggctagcgcccagggcacagagcgcatgaaataatctcccactgagccagactggtctcccttaggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaaggtgggctcttcgtctctcccttccctctgagcattcactgccatccctccgccctccccttattcccgcactggacaaggccagggactggtgggggtgtgggcaggggtggggcgggggagagctgcacctgctgtggtagttgcagtgatcacagtgaggactggctctgccacctgttcgctgtgtgaccatgggcaagtcacttgccctccctgagcctcactttcttcatttgtaacttgagggtggtaaaactactttgtggaatcattggcaggatgaaataaggtagtagatgggagaggctttgtgggctgaggattggtaaattaaatgtgcagtgttacttttattttcatcctgttagttcagttctggccacgtatggtggtcgaggcaattggatgcttttggagtacccaaagcttttcctttggctgagagcctaaagaccagaggctcatttgaattctgttgtaactcatttgcatgtggttcacttccttaccaaatgaaaagtgctgattccccaatccctgcacctctgatttctgtctctcaggtaaatcttctctatgtatgcctcctttaattttctaaaggttttacttttgggttcttattcatgggcccgtggtttttcatcccttttgtgtcatgttgggctcttccagcttaaaaatcttgtggcctggcctctgcaagagtgtcttagctcccctgaggagaacaaggggtccaacctggagttcatgggtctctaagtggaacaatggacctctgaagttttatagaaattttgtgtgtacatgtataagtgagttttatggaggagagggccgttgctttcatcatatttccaaagggtgacccattaccaccaaaaccctaagatgtagctccctgaaagatgctattccaggcccctccttgcacagaccctggcacctagcaggaggccagtaaatctttgagctaaactatattaaggggaaaggtaaatataagaacattcttatttccccggacttgtgagcagtcatgcacacctccagcatgctcagcagtatagcattctgtttccatttcttccccttaaacttacacatccctaggcctagtgctacagtttaatctccactctccagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattaggtaaagatgtggttttggcatctccctctctaagctatttccatgtatctttaggtccatgtagcctagcaaagagggaagagatgagaaatggtcattattgtcatctacttattatctcaaaactttacgaagtgatacatagaatcacagaacttttttttttttttagagggagtctcactctgtcgcccaggctctggagtgcagtggcataatctcggctcactgtaacctccacctcccgggttcaagcgattctcctgcttcagcttcccaagtagctgggattacaggcatgcacatccacacccggctaatttttgtatttagaagagatggggtttcaccatgttggccaggctggtctcaaactcctgacctcaagtgatcccccggcctcagcctcccaaagtgctgggattacaggcgtgagcccggccagaatcacagaatttttagaagcttatttcccaaatcctaggaggcacttcacagtctggctgcaatcaatctcgtttctcacccctacctgccatctactctgtgctttttcccaggcccccaacatgccaggccttgtgacaagttcttaatttttttttgttttctcttttttgaatacccttttctttccttttcctcctggaaaatgctgtctccttccctttatatatagctttgctgtcacctccctcatgtcactaggcaggcttagtggctcccttctctgtgcccatcactctgtgtttatgctccagcatcccactcttgtgctgtggctttctgaccctcctagatgctacgctcattgcggacaggtcctttcgtatccagttctgtagcttctgagcctagcagagtgtttggcctgtaataggtgcttaattcatgttgggatgaataaattcagtctccccttcattttgtgcagaaaaggacaagtcccagagcaagtaaattatagaataatagtgtcctagatttagaacgccaaccatacaatacatgaattacctttataaataatctttgtaccacactgaatggcagttttatctccccaactgtatcctgttctctggaaccattcatctctgtgtcttgtgtactatacctggtacattcacctctgtacttctggtaggtacctggtatactatagtaggttcccagtgaaaggttactgagtggctaagtggctgtccatcttctgcataaacagctccagcaaaggaaaactctgtcttgttaggcaactgtaatgatttgagctggtccttgtattgagcccaaacttgttttcatgtaacccttttactctttactcctgtttacttcatctggagtcatgaagccattcgagcactccatctgaatgtggctctcatactctttcccctcaattctgatcctaatatgtgtcttctcccgttcttccagcctttactcatatgtcatggggtctatgcttccaagtttattgacatcccactaacacatagggaatcactgacaacattgcttgtacaccctgggtttgtttgtttgtttgtttgtttggctttttactattcagctagcttcctatgattactctgggaagaattgggaggtggtaggatttcagaaactctttatatactggaaggtagaaggtgttttatcaagtggggtacccctcttggacaaacaaataaagaaggagaatctcaggaagagtgagccctggaaccaggagctcaggagaaaggaggccaacccttgaggtccttcctgggggagggactttggtctgggctcatgaagcatattcatgtttagggggcacttgtcaaattgtttcggtgacaccacccatcttgggggttgtttaggtggaggttggactctgggagatgtggacccggggtttctaagacactgtggcactgttctctccaagaggaaggcggcaaattgtggaacagatggaaaagaaccaggaggagcgatcgctgcttgctgagcagcgggagcaggagaaggagcagatgctggaatatatggaacagctccaagaggaagatctaaaggtaacaggccagacagacaatgccacgtttcaccagctgcagcatcaaaacccttcaagactctggggtttcagggtgttgactgattttctgccaggcacatgctcatttcacaacatcatcaccgtcaactttttattgccatgttaaatatttatttcaccatggtgtcacgctgcgggatgagcagtgatttggatagatattgtcccttccttccaaggacttgaggtccaagactgacatatcactgtgaatagacacataaaggaaatatatggctgcatgctttgcacaagtaaacatagggatgttttatagtcttccttcaatcacctagggatattatatactttgtagatgaacagtagcaatatcttagttccagactccctgctgttacttcactcaaagtacatagcatcccattgtcattaactgtgttgtgaagccaaaccttttcttcctgttagtccaaataaaattagtaagcatatttattgcaaaagaaatgacaacatacctgcccaaactaagaagacttaaaaagtcatcttctgtatgccttctctgggctgtaacaatgtataaaaccctttagcacagtgagggacatggcaggcacttggataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccataatatcatctaatagttaatccacattcacattccccaattgttccaaatatgtattttctggctctcttgtttccaaactagactttaatcaaggtttgcacattgcattccgttgagcctctttagtttgttttgatctagaagagttcccccattcattcattcattcattcattcattcagttcttcattcatttttataacactgatattttgaagcatctaggccagttgcctttaagaatatctcacattctgaatttgtatgattgcctcctcatggtgccatttaacttgtggaacacgtattcttttacgattctctccctcccctgtgtttatgaattgtcaagttgtcatcagctagtgcatttgatggtggtgagtgacagggggacgtgaagagtgctgcaggtgggcagacttgtaattatgaagtcttctcatcacatctgcagtgtgaggagctgctagagaagtgcaatgaagatcacctgggtagttgggaaactgaaggggcacacagctctgtgaactgcatgagaaggagaatagcagggtgaaggcaatgagagacctggccaagttactccatttcctggctcaggggagagagagtgggaaagggccaagaaggaaagttatggggcaaatatgcaaggtagtgggtgagaagtgagggcaggaaaatccaactagatgtggggagtgggaattagtgggctcactgaggaagttctaggagtccatgagtcagcaccattatgttgatgttgtgtcattatccttttaatgtccttctaacaggcactccctgagtctccaggaagtattattgggcaactttagcaaggaaacctgtgccttcccagctttagacctactgtatcatctcatggtggtacgaagggcagcgtttcccaccttgctaacaaagggggaaagagtgaagggaatttatctggggttgctttggaagggcttcaaaagaaacagggaaagtcctttggtgtcttggaattgaaatgagccaacaaaaacaacaatccaaaaagtaaataaatagggaaagaagtaaataaatacatgattgtatgtatgtcatacatcagaaatcaacagcatctttagctttgagggccagtgagattaaatgatgtctgggatacaaatagcaggcctaaaatcagtgagaagcagttaggaaggaaaggaagaaagggagaagggggaaaaggagcgagagagttggaggggcagaaagggaaaagtggagtgagcaaagaaatgagtatggtgagagagagagggaatgtctgtgactcacgcaccacatggacctcagaggcagagagttgccataccgctctggttcagaagccttcctgaaggaagaagccttgaactgggcagtgagccaagctggcagagagccagcactacaggaagacacacagggagagttaccttggttagatgaatcagggcagcagctgggctgaggaagacctggaaggccagggagggatttagtctttggagaaatggagggagctggaaacagtgtgggaggtggggtgagttaatcaatagaagaacttaaggagtctgagattgattggaggtgattggggggccagctgttcccctaattccgatgcccctctgcacctgagaatgtgcttggctcagaagtggtctgatcattgagagctgttgaaggctcaggtctgggaaaggcagggggatccttccttaaaaacgaccttgttcacattggtactctgatctccgtcaaatgtttccctgtgtctaagaactttttttctttcctttctcacatgcctctcactttggtcctacctttcctgcctcatttatcaatggtttatcgaatatttgctattttccttgcattgggctacatgttgttggggaagagaggatgtgtgacacaaggtcccttgtcctgtaactggggcagagcgaacacatatgaaatgagtggggacctgcaaggcagtgtatgatcaccttgcaagaggtgtgtcgccaccttaagtgcagagagaatttagaaatggagagagaattgaaagttgaggcaatcaagcaagatttccagagaaggttgatactttaatttagacagaacaggtttcaaaattttagctctggagattataagctgtgtggccggtggggaagtcacttcaatgctgggcctcagtttctttattggagcaagagagataacaaggcctacctaccttttaggatttttggacatatttaggtattagagatagtctgtgtacagtgctcaagaaatagaaagcactcaattaaggcaatatgtattatttcagtcgtcactattgactggagagtgaaagttaggtttaaatgggagaggaacattgaaggcaggagaagcaccatgagcaaagccacaggggtaggatttagcaaaacatgtgagaggcaattgtatggaactttaagagcttctgcttcctgaaaatatagagatcaatagcatcaggggctgccacaaagtcaagttggatgaagactgtaaataggccatttggttgaagagggtatttatgacccttgaaaaaacagctttaacaaaggatagttgtggacactagactgcaggcaatgcatttgccccctcctctgtctgcatctctctatccctggatgccagtggcttcttgtcttacctctttgtactctgaggctctctttcttttgctggcaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggtagggacttggtttctgggacctttggttaggaatggaatgtctgtcacagggagaggagggcctgagaactaagggaactccagtggaaggcagccgcaccttcattctaagatgcacatccttagttcaagggcctggcttctttgtctcttcatcttagccagtccacttgttcgttaacagagacagcctagaaaggacaaccaaattagctttaacctcattaacacctttgattagaagttgggatgagggccatatgcaggcagaaaagaaaactgaaactattggtgaaagtgagtttttttgtggatttgtcatgacttgcgtaattatacccccggtaatcatgagtcagcggttacataaatttcttgtgcaaatgcctatattggacatcctgtattgggtgctagactcagaaaatagtcttcccccatctcccaccaaagaacctatatgacagagcaaatgcacagtggaggagagagccatacctgcagacagttgcagatggatgtagctcatgaatgtgtcagctcattctggggcaaaattgagtaataaaatgattgggatctacggggattggagagtagaagaaggcttttaagagtggtatagataaagtgaacatggatttatgtaaaaagaggaggaagtactcaaggtggcaggaaagttattaaattcttcatgtgttgatcttgtctgccctgctagttttgaaattccatgatgacagaaacacattgtacttctctatgctcctctatagtagtgatttttaaagaaggccagggggagggtgtgagtataatttgaatggcatatttggtacacctatatgttctgaatacaaaccacagaaaatgaagctcagcgaagctcacttattggctttagtattcttattggatgctggggacactctatgcaagcaatagagtgagaatgcaggtttggggacatagatgattcctacataataacaatcacataactatcatttagtgagcacctagtctgtgcataggctccgtgctaagtgttttacacgtgttatctcttttaatctttacaataatcctgtgaaatggtcactgatgattcaaaatatactggatgcttcaatatgtgtccagtcagactaggctgaaaatacctaggataatgctgtaccattggaactcaaccactattttcccaagtgaatgaaggtggggatgatgagctaattctgtgtaggagttagtgcacatattttctggctgcagcagagggttggtagtggatataataagaaatgagggtggtgagatgacagagagctaagagcagttgttggggtgtcttggacattgagtggagctggaagagtggaatgataaggagtcgccatgaatttctaagcaagagaggagtatatcttgtctttatcatggaaaggacattgtcaaggtgtagctgggagaggctggagactggccacggaatcaggcacttgggcatgtccacagtccaccgtaagtatctacgtatatcacaagcccttaccgacctcacggtggtatctattcttgcagccagggctgcccctgcagagctaaaagcagaaattggttgtagaaacacccagagttccctgtcctgttatctagggcagggtggacaaaggaagcagcttgacaacagccccgtacaacttacagggacaactcactgggcttcacggaagtctgggcaggtagaatgagggcaaggaaggtttctgtttttnnnnnnnnnnnnnnnnnnnntttttttttttttttttttttttttttttttttttttttttttcttagatgtagtcttgctctgtcactaggctggagtgcagtggtgcgatctcagctcactgcagcaacctctgccttccgggttcaagagattctcctgcctcagcctcccgagtagctgggactacaggcatgcgccaccatgctcagctaatttttgtatttttagtatagacactgtttcaccatgttggcctggattggtttgatctctttacgtcatgatctgcctgcctcagcctcccaaagtgctgggattacaggcatgagccaccatgcctggccgggaagattctttataaatgtcacatttgcctccaacctgcaccattcatcttacgattgctcaagaatggcgttgggaagcgggcttgggaagcttttaaggatatacctgttttttcagagaggtggaaagggagctaattttggtggttcattctttaagtatctggtaaccactgtgggactgcccaaagcatggttggctctttgcccagggactaatgagataacctccacctgctgtactttacaagacaggcacaggaccagttgtttcttggcccagtagccttgcaacttgaaaattgtctatgacatagtggaaggagtgtgaaagccagggtcagggtacctgtgttcaaatcctgttaggtagtttacttcctgtgcaatcttgggcaagacccttgatctttctgaccatccatttcctcatctataatatctgtctcaggaaatgttgtgagggctctccaggataacacataggaaagtgttttgtaaacaataaagcattttataaatgctaattgttttatattcatgcattgctaaattcattttaccttatttatttatttatttatttatttatttatttattttgagacaaggtcttactctgttgcccaggggaatgcagtaatgcaatcatgattcactgcatcctcgacttcccaggttcaagcagtcctcctatctcagcttcccgagtagctgggactataggcacatgccaccatgcctggctaatttttagatttctagtagagacagagtctttctctgtggcctaggctggtcatgaactcctgggctcaagtggtcctcctgcctcaacctcccaaagtgctaggattataggcatgagccacggcacctggccttattttgtcctattttaaaaggagtcaggaagtggtaggggagatattggaaagtctgttgtaggggttttgtttctctctgcaaggctggggcaatggcaactattctacaaggcctttccttccggcaggctcgagaagcagagtttgaggctgagcaggagagaatccggagggagaaagagaaggagatcgcacgcttgagggccatgcaggagaaggcccaggattaccaggcagaacaggtacctgcttagtctcgacttccctctacttttcccactcccttgcctatccatccctttgacagcctgtagaatggccttgagggtggagatgcggaggaaaggatgcaagttacctagacttcagtagtctgagaaggaaggggtggcctgctcccagggcctgtgtcagcagggattgggcagtgcagcctgtgcttaaggttcaagagaaagtttttcgctgctccataaagaagaactttcaaccttaaccaaccaatgaaatgtgtcaccaggggaacctgtggtatctccatcattagcagtttttaaaattagaagcaatttcaagactgcctggagatgtctgaggtacagggaaagaactgggatgagtgggttggaaggacaagatgacccctcaggttatcttctaacccaaaggtttgatgacaggattccatttatcttttcctagaataactagctgccagagaaattcatgatgcttttcaaagcagactgtcagagtctgtaagtaggtatcttcttaaagccacttggtctgtacttccagctattttgtgccctcactggtcccctgccaacattcccaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcggtaggaggggcctgggaaccttggattcctttccttgtactgtagcagggatggtccatattggatagagagaagctttctggcatgttaacagatgctcgtcgatcttgtctgggttggtgggatcattataactagatggatgattgaaacttttaaaaatcacttgagccaagaattatgtgattagagaattgggagatagcacctggaattgcttaaggaattggtgatgactgggattatttaccctggaacagtaaaagtataaataaaggtaaaattctggtccattctgctgccctctgacccatgtgcccctgcaaattggggatgaaactgcaagaggagtggtttaggaaagatagagaaaagaacttcagacactaagggttgtgagtcactggagcaggactttaagggagctgtttgccgttcatttgacaaatatatattaagcacagaaatgcagggctctgtgctggatgccatggaggacattagcaattaacaaaacactgctcttgcccattccacaggaaaggtattagagatttgtgtttggatggactgcacctacatcaatccatctttcttccttggtagctatttatccttttacttttgttttcccttttggctcaatgataatttcaacacataagtggaagctaaatgttcacatctctcactgttctgctccctccccaaaagcagtcaacagtcacagctcccattggtttccctctctgctctgttttccaccagtcagacctggtccctggggctgttctcctggtctaactgggaatgactctctttttgctctggttcagactctacaacattagaatttttcaaaaggaaacaagccaagcaaaattcgaattgaagggatacaaaattatagacattatgctcagataagtagagattaaacagtatagcatcactttcttggttcatatgctctaagtccttcctcttggcaatgggtagttagtggcatgccagaccaggctacccagacccctagttagaggcagagcaggtcttcgggagcctctatccttacgagagccagatttttggccttttattggactgcaggccccagcatgtcccccctgccatgataccctttggctctgtaattttctctgcccccagggttgtgccatggtcactggacacctagtgaagaaagtagcttcctaaatgccccccaagattctgcccttgggctacagactgccttccagatgtctcctctctcctccctggcctctatgcccttggacatctgtgttgctgttaacaggcactaataaatattaatgaaatgaaatttaagtcctacttttgctgccgacccatttatctttcctttgcatcatttgcctgaagcatatgcactagccagttattaaagctagaccagcctttttggagaagttcaacttcacctattgttgtaggttagtatctaggcctagtgtctccagggccatgtgaccaccatgttttgtgtctttactcagaagcatctctgccacagcccaaatccaactttctctgcctcaaaagcacagcctcctctatggcctatatgtggacttttgtttctggacagagggatgtccatacttctcagcctgttgactaagcagagatagctgtcttcctctaccaagtggtttttagaaatgtcttggagcttttgaaaaatacgatgaccaggcttcacttcctagattgtgatttaaatggtctgggattaggcccatgcatgagtctgtttcaaaagctcccaggtgattctaaaatgtagctaggctctgtgatcactgccctaacccgatggaacgaccaggttcatcctcatttggattttcaactgcctggcaccaccggggctctctagtgacacatacaagtcccccttttccacacttaccccttcactcagaagagggtgaaacaatagaaaactgttctaaatataggaaaacaatggcaaggcaaagaggagagtccccctgctatcagagatgtgtctgggaagtcaggatttggtgtctaaatacagagggctgaggaagccaacagtattcttcgggtaaactgggaagtctctgtagaaggcacagaattttaggagatgtttgcatgatggaaagagtttctgggagtggggaggatgccgcatgtatggtggatcttggaagaaagctagagggaaatgaggaaatgaagcagtgttgtaggtaccttttgttggggtatcggtgactctaggggaggagagcaggtgagaaattcctgcctaagatgattttacatttcattttttaaattatgttgagaacaaaattagatgttagcttaagaaggcctataaatgcatttttttctgagatgcgaatgcatttcatttgagtgttttctgagcctttcctgttgccattagtgattttctccctgatgtcagggtccatcaggtatttttgtggaagaggtttctaagggaaatttggagaggtggatcaggaagagaactgagcgatatcaggctgagctccttccttccagtaaccagggtggagctagcatgacactttatgcatcttttacatttccaagcatagagggagggagggagggaggcaggaaaggaaggaaggaagcaaggaagaaggaaggaaggaaggaaggaaggaaggaaggagaagaaatctcaggataagctggagaggagttatacattgttatcaggggagaagtaggaacaatagttcccagtgggtgaaaccctgggtgtaaggactggttgcataattttcagggcccagtgaatattgagaatgtgtagcttgggcaatgtaatgagacttcatctctacaaataataaacaaaaaattagctgggtgtggtggcactctcttgtggtcccagctactcgggaggctgaggtgggagaatcacttgagcccaggtggttgaggctgcggtgagctatgatagcaccactgcattccagcctgggtgacagagcaagagagtgtggactcccttgttcaaaaattattaagaatttcaaaacagtgaaagcagagcatcaaaccaagctgggggcccttctaagcatgcccatgacatacagtcatgcgaccctggagctagtcctggctgggtaggagaagggggcatgcatgtgcagcagcttttgggggctgatccttgagttacaaaatggggctggagcccagagggctgtggtctctgaggcatgtctactgaaggagcccacccaggaggctcccccaccacctttcctggcctgggccagctcagctgagttcattccattcctgtttccctcccccagggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgaggtgcgctggaatctcctcctttcccaaatcctcttccctcccgcaaagagatggcaccacaggctggaaagcatggggatttgggggtgaagggccatggcagagatgctcagggagaggctcttctccccacccagggctcatccctctgaagggggctccagcagaaagtcctgggatggggtcttgctggctctctgggagctccttggcaggatgctggagccttggcatgaatgtgtgtttcgggggtggattgtgagagcagggttggggggtgcaggcccccaggttctgtaaaccccacccagagcctgcttcctcccacctcctgtctggtccaatacctttccttatacctgcctgcgtttccccggcagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactttaaggaacagcttggctttcttgtgggaatgtggctgctacagggtactgaaggtggagtaaaataggatggggggaacccgagtgtgggtggtgtggggctgagggtaagggaatgggaagatgctcttttatgatggtttctcctaagccaggaggtccctttgtcctggtgtctcctggcctttttgtgattccctgggatcacaatcttgtctcagctccaccctgacgcccagttcagaagcatttcagggcattgaggcagagctacagttgcctctcagtgggggctggggcaaggcttggccaggcggagctggtgaaggaggcaccagggccaggtgaggcaaggctcttactgggatcacacccatgactcagatcacatctgtggagggagtgaagtttgaacctggggctcactctgcctgtctcagctctctcccaccagaaccctttcaattccaggcaatgctgcaacacagacacaggcccatgccccactagggcacaccaagagccctgcactccccaccctgccagtccagtcccctcacccgaactcagcccctcctgtggctgggctctcctcagtccacctcactcccataggtggggctcccaaaccattttcgtctgtttttaacttgtctcactttgccccaaactatactttaatcattcattcacttattcagatactgactgagtgcctaccacatgccaggtacatttcaggcactcactgagcacaacagaccttgctgcccactcagaagctgctcatttatgccggtctgctcctgttttctcccctgagctgctcccaccaaatttcttgtacctttggaatcatctctgcctttttggcctctcacctggttgtcaggtgcccctttggggctggactgctagcttctagggatggagccatgtaccctgtttttgtatgcctaggggaaagggctttcctccagctgctgtgacaatgaggtccctctctacccctggggatggattcatctctcaaatccagagcccagtcttgccttccctgatgggccctgcactagaggaggtgaggaatctgttgggtgcgtcctggatgtttacaactccaggttacaagggcctcaggcaagagtcctcttttcatagggcccagggagagtcagtaagctgtttcctgtgcttccttttcctcaggacagccacagcttccccaggtgccttctccaccttttccaccaggaaagattgttgccccgcccgaccaactgtttgggaaagaggctttctcaccgtccctgctcagcacctttaactgcaaccctccttcctagggaagctgatgccttcctccctaggggtcttgggaagatgtggtacccagcctcggatgggagagaagacatggcaatgccgctgaggattctgggactcatctgcagttggggcactggcaaaggttctctctgagcatcacctgttgcttagctgatgcctgcagggaccagggaacaaggctttgcctagttcaggagacactctttcccaggaaagctagaaagagcctgggtgcttaagagtttgcctaggctcacacctaagtcatccatctcagggctggaaaaaatgggccactatggagaaaggattgaggagaaagggggttccacacccactgctaacttctgagcccacttagacaaaaatgggccaacatcacaggttgacagtaaggccagcatttgaccagagctgctgctggtgaaaatgtaggtctttgggtccgggaagatcccaaagccttactaaaagtgagtgagactgtcgactgggcctggacacaggggcagttataggttacgtgaataaaggtctggctttggagaagagagaatatagccacttctgagcaagtgaagatggtttgggagagaatctcagggctctgcctcagggttgacccttttactctcatcaggagttctccatcttggaattggcccatgaagtagaagagagtttcaatttcttctcttgggattcctaagaagtcacacccaggctttcatgggctccagaactagtctgaaccagtaagaatctagttctaagatgcctgacactcttgagagccaggcaggtagttgggatctgaggccagtcaactacatctcggcaatcttttataaaccctctaccaatctcactcagaaatggcagtggggataattacagagaaatctcccagtgttaagtggggactggtggggttaggctgcatgatagtagtggcagactcagcaggacactgtgtgagctgagcctgcagagtaaggctagggcctggagacaaagagaaaatgggcattcttctgaggactccagtgggttcctaggctcagtcttgctgctagaggttggacctttagtggaggtgctttctgctgaggaggtttaagctttccccttctcatgctcaaaggtggagatggtgagctctgtgtactcctctaagccactgaatcaacacagggctgtgtgagaggctgtaagagataagtaggaagtgcagtttgctgcatcatctttgttaatataaagccttttttcttaattgccaacactattattgacattgttatatgggtatctgatcttttcatatctactttttacattattttatgtataaaggtacatattagcttcccgtggacttcccagccccctgtcttctgccttgggggtcttccagcccttataatgtcagactgaactagtccactctagggaatccaggggttgggctccctgccggggcactgagtcagatcagcaggcagttgcctcccaggcatgtgcctcctggctcctggctgggccctatgtcctacctgcccacatgtgcctgttgtgggttggaggcggtctcagtacttttgcatctgcggcagaagcagctccagctggatgtgactcagcagctgccctggtagctaagccatgctgtccctgactcagtggggtgctgggatgtcctttactacccctgaaagcctcagcacccccacctgtgactcgagtcacagctggacattacttggtctcagtaaaagcatttggattaggctcagatgaaaggggctgagagagttcaaagacagacagggctttcagggtgaggacaagtggccgtggtttcggtgatggtggaaggagacgctggaacctcagacaagaagtctggatttgtgggctgtggagactcagggacagtgagctcctcactctatctctcactctctctcctcctaactgctgcttctgcaaagagtggtagcctggcagagaactgtgaaagaagcagatggctcactgcagaccataggtctcttcccctcctgggctgctgcctatggcaacctgcctcccctaccagactctgagatatgtcaggggaaatcatgcccaggttacctggaaggtcctcatttctgacactgctgagttattcctgagttattcttgatttgtctggctttaaatagctcagaccttccctctgtcctggccccaaacctcacatccctcccagttgggacattctccttgaggcgcaagctctgtgtttctttttgcattctcacccatgtcctcttaagaaagggctagtcatcatctcaataccttttgacaactttgaggctggacaggagtagggttgagattttagagggctttctcagaagactcccagaaagaagagtcagaagtgggtgaatggaagtgaggagcagaagggctgggcctggaagaacctgtccagagccaatgaattttctgcatggtccctgggaaagacttccctgggtagtggggatggacaccaaatcttagaatctcaaagcagaaagggaccccaaagaccctctgatgcttgaatatcctttgtaaactctagtcaaatggttggacaatctgagcttgtacatcctgagagacagggcgctcactacctcaaaaggcaacccaaaccatctcagattcgccctgatgcccagaagtttcttaatattgagtcaatatgtcttcctgtgtatccaatgtgtggaccgagttctgctctttgtgaccacacaaggcagggccaggctccttttacatgatatttcttcagatatctcctaccctggctgctgtgcagcctgactctgaggggaagtgcctgtcattatagaaacacagggctctcctgagcatttcagggaggggaggaaactgggagaagtggggaatcttcaactttatcccttgggctgggcctgctgttctcctgccaggtaatacttctgctgtcgctgcagccctagcagcgctctgttgcctctgagccccgcccctgtggcaccaccttccccttgactccttctatcccagtgtgcaggcaacaggaaacaaatacagagggcagagcaaggattggtcaggacgggcttagtgagaaaggctctgaacgagacacacaccagctgcagcttcgtactgacgcctgccagctcctacacaccttcctgggcaactgccagcggggcaaggcaggcctggggccaccctgcaggtcaaggggcaccacagttccactctgtagatacgtgtttggggaatccagatggcaaaatcaaaggcaagttttatttctacaaattaaaatgtcaaagtcccattggacctgtggattaattcatctcaaagtttctctccccataaacagacagactcatggttcaggacaatcaattttagttgcttaatccacccgatggcctggctctgatcccagtgaggtgctctggtgttctgggtagaaggtcccaagaggttccgttctcaaggatcttccttcctcagttaaaaaataatcgtcagctgtcactcctggctttgctcttctcagtccatgtctggcagggacctggcttacttaccaagcccagaaatattcccctggcctcctctctccacccgctactcttttctctggcacgccgttgttagttatccttcagatctcggcttaaacatcattgccactaagtcaggggccttgcacgtattactgcatcttaccacattgcgggccaggagctatttccgtgtcagatggggtgttctgtgaggatagggactgagtctccttaattgccatttccccagggcctagcacaaagcctggctgtttgctgaatgaatgaaggttctgcaggatgtggttgatcttggcgaggtgaagatacctttatcttcaaagcctcttcattcttcctcagatctgtcatcagggaatcacatagcctttacaagcgatttcttctcgcctccactcattctcttgctaacaattcagttggtggcattcaatcgcctccctttgctcttgtgctttgttgatgtagtgacaactccagccactcctttaattgatggggactatgtgtgtgctgcttgctcttctgagtctgtcagcttcaggacattgcttgatgggagagatgtgggcatatccaggctcctcctagaatcccacttcttctgaagtgtaccagtcagaaccactgaggtttgggaaacctaagcaggagcttggggagtccctgtgtcacctgtgttcacggctcttccctgccagctttgatttgagccttagtttcgaacccaacccacaccctcaaacttagccccacatgtcgatctcatccctctctgtaaccagaatccgacgttgtcccatcaccacccatgcaacctctgagccccctacccttctcatgcaaccatggcctcacctggcagacctccacctccaaatcatcactgaaagctgggtggacagacagcagctgcaaggctccttggcttctctgtgactctttgcctatccattgtcactcacagcttctgctcccagagtcttacctcagaggtttcctctgcaggacagctcctccctgggtgctgcagggtgagccctgggctacatggggacttgggagagggggctgaggagcttgctgactgtgtggggaggagtttagaatgagtcaaattgcagtgccagccaaggcaggggttgtggggagcttgattgagcctgagcccagggagtctggcggccactgagaggggttggggtgggcaagtacaggcaggggagggcagggcttagaggagtggggtggagttgccatgaaagggactttggaggaagaataggctttggaggaagagtaggcagcccaagccctctgtccgtccttcccagaaaggttctggggctgggctgcacttcatctggtaagcaatctgtggccttctctgagtttttgtccagcctcttcctacctcctgtatctccctgtttactcctttctaagccagtctttgattttctgttactgtcttagaatagaagcaaataccagtcaaagcagggccattcttccctggagagtcatggatttcttaggaaaaagcaaggggcccttttggaaatttgtattggttcccagctcgtggcctgggccctctgcctcctctgtatccctctgagtctctggaggggccatttagaccatgtgtctttctgtctgcctctgcctctgtccctgtctctgtctttgccccttaactcatcactatctctcccaatctctttcttctctctctctggggtcacagggggaaccccagtagtctcctggaccagacctttataaaacctgaaaaggaagtgggtggggaaatgagatgtttgggctggagactggttggggaaaaatgagagggaggaattgggacggggtcttcctaggagtggggccctcttccactgctgaggataaggcccagagacttacacggactgtgagctgggcccagagggaggggactgtaggactgtgacatatgctttggaaactatgctgacaccccagtgccttcaccccatccacagcctccccactgctgccctccctgaaaaccctgcagggctcagggtttagggctggaaggctgacagcttcttttataggactcaaattgcaagaaggtagcaattaagcctcagagggtcaaggggaaacaacaatggcactctgccctttcaggctttgaaagacccccatgtggtgccccataaagtggctgttctaggagcatgtaggccctcagtttctcccaactcccatctcctaaggactccaaatccagaccacccctcctccccactcagtaagactccctctgatggaccccatcttctagttcggtttggtgtcagagcccaactcattgtcagtagcttcctgcgtctcctccccagatgtttttctggagcttggccaggtggtgagctttagtagtggagcaggacttcagagggtccattctctatgggatttagttgcctcataccccttagatgggctcgtgtacatttggcttcctcctccaagtcttgggaccccaatcaacatgtgccattagtagtctccccgcactaaggattgaaaattctagccaaacctggatttagcagatggaggctgaagtctttctatattagaaataaaacctcatctttgatccccatcaactcccgctgcttacgtgtctttaaaccatgttccaaccctaaccacagcctatttcaatgtgaatctcaaacttagttctaacccaatgctaaatcaatctaaacccagcctttgatttagccctaactgtattcccaggcagagctgtaaatgaaactaaaactctattccttatcgtaacacaaatcccagccataaacctgagcctcaattctagctgtatttctaaccctaatcccaaccttaactctaatcccaacctcaaatctgacctcaacctcattcataattcaactaaccccaaacttaaccccagctctaacattagcccacatccagaacccaattaaatctgaagcctgcactgtagtttagtggaaccacaatgttactgctttctcctcaatctctctgttcgtggtctgacctgttttccctcccactcaccctgaccttccatggttcttgttcgtgagtgggtctagtaatccacaggatcaccaagaccattttttggacctctctggactgagaccctgggtacctgggtatcccagcttaggcaccagccgcattggctgaatccccatgtttctccaggtctctgtttccccatctgtaaaatggggataatgatccctgctcttcaaagggagcaggacaatcccataaacctaaaaataaataaggaaataaagatattcattgtgtacatctggtaggtctcagagcgccctgttattgttgggagttcaggtgcaacggcttggaatgcagagacgcgtggactccttgtgtttccttaatgttctgacttatttttccccagaggggtgggccctggcagcatccctgagccccataactctccctaacactcttcctcctctgccctttctgtgccccatggtagggatgggggcagtccctgactcctttgagggagttgagctattgaatggggtcactcatgtcctgactcccaccatggagtccaacaaggcacatgcccattctgtcccccttagacaagccaacaaggggtggcccttcacttgctccccatgcctaccaggaccctccccaccccagcacgaacttacccagaactgtgctggtttagtcagcccgatgaccagtccaggttatgagggtccttggtctcaaggacccagttaatactgggactgcattaaccctcaagacctggctactctttctgggcagagaagccaggacaccaagcgatccctcaagaagttcactcagaggggcttagccatcctcacagagacaccctgacacagacatcctgcctccctcccacagacattgctgaggggtgcacacgcttacacaggcacccccttccctggtcctcttggcgctgttctctccaacactccctcactagcccatcagtcaccttactcctagcacacaccctggaccccccatagcacccctgctcccaggggtcccctacacttggggatggccttgagtcgagtatgggtgtggaggacagttccagaggggacagccaggaggagactctgttcctgcacacaccccttctcttctctttcagctcaggaggcctgagtccctttgaaaggcctgaagcctgggggaaggtgggctggacactcctggggaaccctatgccctgggatcaggattaactcttcaggtcctggccactctttctcccaagcctggcttctccttcctcttccccacttcccccagggaaggaggcagcaaatgagtggtgaggggagcccttggaagctgtaaatgaggtgactgttgtcaccctgaggatgtggccaggaggaagtgaagtttaacaggtgcctaattacaagtcccgctggctgtcctgtgccactcttaggacagggaagagcttgggtgagggctgggtaatgcccaggtaggccaccctgtcaccctgctaattagggttcctgggactcctccccaaggcggggaccaggccccctccctcccatagaaataactccagctgctccccagctgggcactcattgcaccttcctgccaccccaggcagtgtctgggccctcagctccccctcccttccacctaccccctcacacccaccactacgaccccacgggatacccagcccagacggaggaaacaccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1475 - DNA, 1824 bp, Homo sapiens
cggcgccgaggcggcagcagaagtccggagtcagggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgact

SEQ ID NO: 1476 - protein, 551 aa, Homo sapiens
MPLSTAGILSSSSAASNRSRNKARYRTKAVSSEVDESLFGDIKSPAQGQSDSPIVLLRDKHTLQKTLTALGLDRKPETIQLITRDMVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 1477 - DNA, 27413 bp, Mus musculus
  misc_feature (1)...(27413): n = A,T,C or G
ttagttctggaagtgaaggagctggaggcggttaccttgcgctgtgtggcccgtggcagccctcagccttatgtgacttggaaattccgaggacaagaccttggcaagggccagggtcaggtgcaagtgagtgggtcagctggattgggaggaccaaaggggaagaaggcaggagaggaacagaagccaagcccggggatgggtcggaggagggaggggttttccatcggcttccccgaggttgaggcgctgtctccctctgctggccagctctggaactgcagggtctgaggctgaccaaacaagaagggcctttccttaaagattccttacctaggtgcagaatggaacactgtggatccgtcgggtggagcgaggcagcgctggagactacacctgccaagcctccagctccgagggcagcatcacccacgccacccagctgttggtgctaggtgcactttggtggaagggcaggggaaccgggccacctatagtagaagacatgatctctacgggggtgggggtggggtgagggggtgagtacacggaagattgggaggaggctcatatttgagggacccctgtagggtgagagaaaggatgaagaaacggtcagcttagtgcccagcagtgcattacagtggaaaggaaggggtgctaagggttagcccatgaatcgtgggaccctcctgagtcctggttttgtgatctcaaaaaaaaacaaaaaaacaaaaaaacaaaaaaacagaggttcctatcaacctctcccaggactttgacatatcgcccatgtgtgctgagctcttccttttggaaggaaaggcaaatgaggcacgcgaggcagacatccatcttcatagcgcctgtgggcgagaaccgattaattgatggcccactgcagtatcgttctccttggtacttgagaagtacagccctgggtaatacagttaaagccagagaccctgacatgaggaaggcccaccaggaagtctcacctccctttctgacctccctggaccctccggcacatacagtttctcagcagaaggaatctgggtgggtaggcttacctgccatgcctcgtgaaacagggcagacttggaaaagcgagtggcctctggaacaggatgggcttttatcacacattccaattcgggtccttaaggtcctgtagcaacttggcccatgactacaaagggcagaaccaggaagaggtgtagaaaggccctgagggttctgggaattccggaatgggctgaggacacctttctgccttggtacttctcccaggaccccctgtcattgtggtgccccccagcaacagtacagtcaactcctctcaggatgtttccttggcctgccgggctgaggcataccctgctaacctcacctacagctggttccaggatggtgtcaatgtcttccatatcaggtagggcaacctatctcttgggtagtggaggcaggggattgatgtgtagtctctgggagagctccttgtctaaggactaggttcctcctcacacataccatattgcagccgcttacagtctcgagtgcgcatcctggtagacgggagcctgtggctacaagccactcagcctgatgacgccggccactatacctgtgttcccagcaatggctttctgcatccaccgtcagcttctgcctatctcactgtgctctgtaagtccccatgctccttccacagcctgctcctccgcactgagacagactgatgaccttgtcctccaacttgtctctgcattcctccagacccagcccaggtgacagtcatgcctcccgagacacccctgcccactggcatgcgtggggtgatccggtgtccggttcgtgctaatcccccactactgtttgtcacctggaccaaagacggacaggccttgcagctggacaaggtacaggcttgtgacaggggatgaaggtcttggctaggtgttgtttttgtcagagggccagctgcagctcagcgggaggctgagtttaattcagcgctgtggttgggaaacatgtttcttaccagatgccagtgttaggcagtgactgtggaggtgagacgaagtatccatttccccagaagaagtatccatccttggagtgttgccttgaggcagagctgccacagagactctgctgtcaggccagggaaggaacaaggcttttgtttttaggtccggttggggatagaccagtaacagatcctgggcctttggtgaggtggtaggtcttgaagagtgagctgtcattccatgcagaaatccctttgcagaggccgtacagtgtgctgacaaagtgatgaatcgggcagtgagggggagccgcagctggcacctgtaaggacttgagaggtgtagaaaaggctggaaagacaggttgggtcctagaggaagaactgcgtgccagcttaacatgacctcattccgagttgattgggatcttttgtttgtctgaggagactataaattctttgaggcatcgtgtctttccaactgagagtctctggggctgtaaagttgtagcatttggtgaatgtgtcattgaaagtttcaaaaaaaaaatcagcagtgaattttggctggcggtggtgttgtggtgttaggaccgtggttaggagttgttaggagcagagccccaaggctgtgaagtggccagtgtgagtccaggtgaggggttactcagtctgaaccagagagggcctgaaaacaagacaagacagagccaaagctttcctgctcggtccagaatgacagacaagttagatgcagagagcgaggggccacgcttcatctaggagcaggggaggttttcttatagaagtggattgggagatgcagaactgatcaacggagtgccgagagggacagtcagagtatccacatggctcaactcgagggaagccattcacactattctctgtgagtgacaccagagctgtgttgtcaccgtctcacatcccctgatggaacagacagaagtggaggaccagagtccagagagagggtcaggccaagacccagagccgatgggttgatttcctgaaaagagtttcctgtctctcctcctctctcgagttgcctctacccaccccagctttgcctctgttaagtttctctctcgatttgtcatttcctctgccctctagttccctggctggtccctgggcccagaaggttccctcatcattgcccttgggaatgaggatgccttgggagaatactcctgcaccccctacaacagtcttggtactgctggaccctcccctgtgacccgggtgctgctcaaggtgaggcccacagcaaacctgctgtggtacggccaggtggctgaatgtgtgttctgaaccatgtcagcagggtggagtgaggcagagagctgtgggaggggctcctaccgtctgtttcttgcggtggtcatagcaacagccagcagaatacacagagatgatactgggcagtaggacatcagtcactaacacattcacgaaatgagatatctgtctcgtctcagtcccacagggaatagagcaaaggggagagagagcatgatctgtagagattcagctatctcagagagtcctgctccagcccgccattacccagcagtcctatctgctgggggcaaagacacagaactaagagatggagaaggagactaagacattatgacaggcacctgggaatgggggacaccaaagcttagaggtggaagagaggctgtgaaagaggcccctcccaatacagatctggcctgcaggctcccccggcttttatagaccagcccaaggaagaatatttccaagaagtagggcgggagctactcatcccgtgctccgcccggggagaccctcctcctattgtctcttgggccaaggtaaggctccctggtcctgactcagctctacctgggtccgtgcccactctttccctggctgtgtttttggaaaggaggttcaggttttcacaggcaacatggggaggggcacaggttacttggagagatgagtggcccccttggtgaggggtggctgcctgtgtcttcagggctgaccagtggttctgtaggtgggccgggggctgcagggccaggcccaggtggacagcaacaacagcctcgtccttcgacccctgaccaaggaggcccagggacgatgggaatgcagtgccagcaatgctgtagcccgtgtgaccacttccaccaatgtatatgtgctaggttagtggcccgggagggggctggggctggggagccacagggagatgggagtattgttttgggggggggtgtatagatgggctttgtgggtatgggattcccctaaggtaatgggtggagaagaaaaatctccaacttattcttccttagccctacttcagggtcctgatcaccctccctccctccattccccctacccaggcaccagcccccatgtcgtcaccaatgtgtctgtggtacctttacccaagggtgccaatgtctcttgggagcctggctttgatggtggctatctgcagagattcagtgtctggtataccccactgtgagtgatccgttcctgacttcaccctggacctacctggccctctgccctttctcccgtccctctctatgcctagccacatgctagctctctggctcattttcataaattcttaacattcagggctgaggttctgagactttggtgtttgagcagaggggtgaggttggctctctggaccccacaccatcccaatcttccttgctgacgagatcttcctacatcccccagagccaagcgtcctgaccgagcccaccatgactgggtatctctggctgtgcctatcggggctacacacctcctagtgccagggctgcaggctcacgcgcagtatcagttcagtgtccttgctcagaataagctgggcagtgggcccttcagtgagattgtcctgtctataccagaaggtaagaggtccccagctccgtgcggtacagaaaaggacgaagaagtgcaggatgcatgggatgggtggggagacctgggagatggggcagagatgctgagcagcttggggttcacataggatacagaaatgctatagcagaatatgtgggtatttggtgttggggaatgacagggtggagggacaggatgcaggactctgagactcccaaccctcctatccctcacttgtctgtctccctgttccatttagggcttcctaccacaccggctgcccctgggcttcctccaacagagataccacctcccctgtcccctcctagaggtttggtggcagtgaggacaccccggggggtacttctgcattgggatcccccagaactcatccctgggaggctggatggctacatcctggagggacggcaaggctcccaaggctgggagatcctggaccaaggtgtggcgggcacagaaatccagctgctggtgcctggcctcatcaaggtgcgtgctggaggcaacatagcgagggaagggccagtctcctcttctttcctaattccgtcttctcatcctgacttggccattttcacctcctgtcctacctcattcttacctcccaactgcagtcttcacaaaagggactatggtgggcagtgctggtcctgatctgctccatggccctccacctctaattcccaggacgttctctatgagtttcgcctcgtggccttcgctgatagctacgtcagtgaccccagcaacgtagccaacatctccactttccggtgagaacccagtgtggggaggatgaaagttgcttgggggtcctatggggattctccgtccactgatcctctcgccccgcccaggcctgggagnnnnnnnnnnnnnnnnnnnnnnnnnnnnnnnnnnnnnnnnnnnnnnnnnnnnnnnnnnnnnnnnnnnnnnnnnnnnnnnnnnnnnccccagcctgtattggctggtgttgtgggtggagtctgcttcttgggcgtggcggtccttgtgagcatcctagctgcctgcctgatgaatcggcgcagggctgcccgacgccaccgaaaacgtctgcgccagggtaggtgccatcactcgccttgcctaggctgctctttcccttccaccctcatcaccggggtcctgaggtactcctaggccacttgaagggttggccacccaccggctgtctgtcccttttgcatggtcctgggcagcatccttccttccattctggtacctggccccgcataccctttcctgttagttgggaatggggctgagggttacattcccccggggctccggaggctctttacccaaatcacttgctgctcccccgtccttacagatccgcctctgatcttctctccacgtgggaagtcaggctcacagtaagtccctttaccttttgtggctaactcccgtcttcccaccgcttcccatgtttaccttcagaagaaattggaaattcaagggaagtgggaataggcgtgtgttggccccaggactagtgctacaccgttcctcttccacacccaccacctggccctgtctgcccttgcttgctctccctagctctgccctgttgtgcgacaagcctcgcaaagccagaccccaatcttctgtccttcttcagctctgctcctggttcaggcagccctgacagcgtgaccaagttcaagctccaaggctccccagttcccagcctacgccagagtctgctctggggggagcctgctcgaccgcctagccctcacccggattctccacttggccggggacccttaccattagagcccatttgcaggggcccagatgggcgctttgtgatgggacccactgtggccccctcacaagaaaagttatgtctggagcgctcagaacctcggacctcagctaaacgcttggctcagtcctttgactgtagcagtagcagccccagtggggtcccacaacccctctgcattacagacatcagccccgtggggcagcctcttgcagccgtgcctagccccctaccaggtccaggacccctgctccagtatctgagcctacccttcttccgagagatgaatgtggacggggactggccacctcttgaggagcccacgcctgctccgcctccagatttcatggatagtcagccctgccccacctcatctttccttccaccaccagactcacctcctgcaaatctcagggcagtgcttcctgggacactgatgggggtcggggtctcctcagagcccccttacacagctttggctgattggactctgagggagcgggtcttgccgggccttctttctgctgcccctcgtggtagcctcaccagccagagcagtgggaggggcagcgcctccttcctgcgccctccctccacagccccctccgcagggggaagctacctcagtccagctccaggagacacaagcagctgggccagtggccccgaaaggtggccccgcagggagcatgtggtgacagtcagcaaaaggtaaaggcagtatccactcgttcttgcccaggccctccaccctgccctgtcattccagatcaccgatatccccacccccatactcttccccttccattgtccactcccaccctgagaccagaagaccccttatcttggaagttctgctgaggtccaggaagtgcaatctgctttagaggaccctccgttcacacttttctggttaccggctactcctctgcccacgcttcccatctgtcctttataacaggaggaacacctctgtggatgagaactatgaatgggattcggaattcccaggggacatggagctgctagagacctggcacccaggcttggccagttctcggacccatcctgaacttgagccagagttaggtatgtggccctctaagctggctgtgctctcccacacccgccctcccatgctctgagctggtctgtttgtttcccaggcaattcctgagtctcaggctccctgccctgcagcgtctcttgttccctaggctccctgtgctgcacgcaaaggccttttggagcctcaggactcagcccttcagccagtgagtcacggcatctcttctcacacagtcctgtcttccccttgaaggtgtcaagactccagaggagagctgtctcctgaacccaacccacgctgccggccccgaggcccgctgtgctgcccttcgggaggaattcctagctttccgcagacgcagggatgctaccagggcccggctaccagcctatcagcagtccatctcttaccctgaacaggctactctgctatgagcccgcttagtgtgaaactaagaaaggcttatatggatttgcaaaggagtccaagactttggctccaagctggggcactgcccctacctctctgtgtctcggtggcctggtggtaggcttgagtgagcttggtatagagttggatgtactgactctttaattgagtctgggagctgaacaggaatgtgtgtgtgtgtgtgtgtgtgtgtgtgtgcgtgcgtgcgtgcgtgcgtgcgcgcgcgcaagcgcaagcgcgcgttcgaaagtggtgtttatggtgtgggtgcaggtttcttttttttaaaaaacaggtgaataataaatgtctggaaaccgtttctctgtcacctctctgtgtttaagagagatgaggaagtccctggatatgtacagagagggttctgaatgggacacattcaacagtcattcaagaaaaaagttgttgagtgcctagtagagatctgctgttaggccagaagccatgagaaaatagagaaatcactgggataatgcctttgtccttggggagttctcgctagtcactgaggccaactacgcactgtgataaagctgtaagctggttatcacattggcacaaagagttcagtttgagtcaatatttagtaaatacttaaaacatgtggggattcctgggacactcacaggagactgctcagagttctttccatgtcccgtccaccgcccggagtttattttgtagactgggcacggcaactaaagccaaaggtgcttttgtaattgaccagaagccacacaagcaggtaacaggcagagcaggtgacggggcagtgaaggaaacccactttcgggcagaggaacaccctaaaggcacaggggactgaaacttgacattctgtgggtctgagcgggactttggggaatagagaagtcaaaggtcagggtggaactggctgctgttcttttaaatatcaggctcaacgggggactccataacgtgaagaaagaaaaacactggtgggttttaaatggggaactccgctaactacagcctgaaaaagtaggtgttctggacacccctcaactattgctcttcactcttaaggggtagaaaagtgcctgccaacttcctccactaagcccccgcctccaaccctccaagatctaagaagaaatgtcaatttattaaatgggagatggaagggagagagagaactgggtctgaatcccaggtcccaagccctaccacaccctcaaggccccgggcaaggagtgacctcactgttcttttttttttttttttttttgcccgggcttgaagttaaatggcaagcagaaccacgtgggggtgctgtcccagcctgtaagcaccagtcctattactccttactctatcctgtaggaaggcgcttcctggacctgaatttacaaaaggccggcctttttgtaatagtaggcttctcatagaaacaggcctgcgatcctgagctagctagtctaggcagaaagtttcctattaggatacaagtctatggctggtgaatgcaggttgaggatcccctgggcggagaccttttgcagcggcgccaaggactccgcaggtcctttacggctcattcctgcctactgaccacctatcttaagcgctccagcattccacgcggcggcgcctttaaaccctcttggcccttgccccgcccctggtccgccccgtctgaggcgggaccccccagaaaactccaagcccggccgggtcttgagctccactcgccgctgcagcccctgtcgtgcgtgcgctctcatccagccctcttggacggtgagcaggactgagggaccaaggcagcggggtgggggttggggattatgtgtgtggtctgtagaaagcaagaagccaacacttgagacttgcttctgggagcgtgggggttgaagactggcggactctggggtcccaactgggtgccccgccccgtgctgtcaggtccggttcccaagccttctctgcattgttcagcagttaagcaaggcaagttttacgggtgcacaagacggggcgtccgtcccgacccaagaggtctggtcccaagccccagccgtttgctccagcgttgagttctctttggggggagaaggaaggagggcgtcggacgtccgcaggctgctgagtggccgcaagaactaggttctggcgcgcgctccggtccatgaatttaccgcgcgcccctttcacttcctggtccaggagcacgtgtgggtactgcctgccttctgtgaccccgagaccgcccttttgcccccctcctgctagttcgtttgtccgggtactcggggtcaccagctggggtcacaggtctccgggagttatttgcacagtagcctggtcttctgtgaaacccccttcttctcctggagcgcctttgacctcggacatctccgggctgcagccctgactgcactcggatgtgccctgtctgtaggggttggctgctatccaaactctcttaccctagcctgagacccgctgccccctcccgtgccccctgctgctgggaaagccggtggtggccgcgggcgggcgggcgggctgcccagacctgcgtcaccccagtggcgggagggcggtgggtgactcatccacattaacggcccaggcagggtgtggccgtgggggtggggggggacggccgaaggggctggaccggaagtagattacctcctttttgggctctgcaggcctacctgtgttcctatccgagaggttctgggatacgtggtatctgtggagcaaaagcagcggtgatggcaagtggaggtgcggtgtaggagaccagtggctggacgggtctccttgttccctagagcagtagtcagggatagctcatctataagcttctcccattttctcttccctgtagctcagggtacacctcaggctttgggccaaggtagggaggggtgagcaaggtgttaacgttccaaagctgcaaataatctttgtccttgcgatccccttgcacacccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtgggggagggtcttccttaaggcgtccccttaccacagtgccccccactggccttctgcctacccacgtggcgtttctgtttcagaagttgggaagttccctacattccacatgcccagggagaggggagagtcccattgtcttcccaacacgtagtcatgaaacctagagtccaaccctccagcttgtctcccttgccttcagcgttgacagtgaatggggtgaggtaaactgccatccatccatggtttgggtggaacactgggttggaagaccttttatgactcctcctttcccagttattgttgtaaccttgtgggcctggttgaggatggttcctagggctacagtcagcagtagagttcgtcactggcaccccccaggcaagctatccagttgtcttcacttgggatacccagttctaagcatctcccacacctgtgttccagctgaacacatctctttagcccaccccagaaggagacttgccattttctctttcactgagggagggctggggcgggtctcctgggtgtaaccaggggtgggtctctccagctgcagcagccacaagccatcagtcgcctgcctgcctgcctgaggggtgggtagggagagagacagctgctgtccaggcagggttggttgggagagcttagtctgagaatcccgtcccgtggctctgccactttgggattctagggtcatggcctctgagtggaatggagacactgcagctggaaatgaacagccctgccagctgtgtccagtctccagagctgggagatactggaaaggtccgtctctggactctcttcttcctctcaaccctggtctctggttaatcattttcttgccctttctttacctgtgcctgagcgctccaggcacaccagctccttggaaacagccccaggcagcaagaggaaagctgtttccagaagagaggtctagaaattgcgcaggcttgcgtgtgatagtggcctctagccccctccttttcttttcctgttttctggccattcctttgtagtcagaggttacaacacgcccccccccccccccacacacacacacacacagcctgagagctgagtagctgcggctggtctattgagggcgagcgtgctggctcccctttctgcccaggtctcagccactccactacctgcattcatcaagctgagtgcgtgtgtggcctgcggtgcggtgtgggtcgggaccgagcctgacatttatctggtctggctgggggggacgtctcctaatgaacttaaaaataactaatttatggggaaagatcctgccggaaatatgcagctggataaacccagagttagaaaggagcagccatgttggagggtgggggaagggagtgacccaccacacaacctctgcccagacatatgacattattagcaatggacttattagcctggcttctttggcggagcaccagagcccattgagggggtggtgggagcgtttaacctggggtgcatgagagagggagccagaatgacttcatcccttaagactgacctggcctgatgccagatgtgggctcccttcctctctctgaatggaggcgcttgtcctgtggataccattttatgagcagtcggagacagctggctctatttctgactagagaaaaggacccctaaacagtagcagggattagctaatgaaggacaatgtccctcctctgtccctggttcctctggacagcagaagctactcctgcactccctctctggattcctgggtgtggcacctgtcagtaaaacagtgggtggggcaggctgcccacagtgaaatgcctgcaaactcaggcctgtggtcagaagccagcagcccttcctaaccagggtccttaaggaacctagctatgcactttgccacacttctttcccttcccaggtttccttgaatatcacatccaaggctctgggttaatttcccctttctgctgtaacaaactatgaacttagccacacactggatgctctgatagtttagaaactcagcggnnnnnnnnnnnnnnnnnnnnggactgaggagctaggggagggtcccatttcccttttcttttctggcctcatctccattgcttggtttgtgaccctgcttgacacccaccctgtcttcacttctcccatgctgccttcccctttcacttactgagaatgagaactctcgtgacagtactgggcccacctggctgagacagctaatcacgccgtctgcaaatgcatgcacaccctgccttttcaactgtgtaagatgatgtatctcccatgtttgggaatcactatatgggcaccttcggtgggagagtaggcaagggggagggggggctagtctgccgatcacgattcctagaagggaaaggaaggaattcattttgtctgctaggcttttctcaggaagtcccccttgcccgctgagacgcgggcctacctttcccagcaagcccacccagactgcctttgtccctctgcttctattaattcctgtaagatgatctgaactgtgcagcttaatattcgttgtgtacagttcccactgccagcgctcctccctgtattcccttgataacactatagatagtgtagagccggagacttcactctcttctacagatgctccgttacaacctaagggttgacggagggtagtttactcgctcccgctcttggcataggtttcccatatgctctgtactctcatttcttgaatcatttttaaggcttcaaagaggagggttgggggctagacttcgcctctgtcaagcttcatcactccaaatgagaagctgaactaaaatcctttacctcatcctgcattccagtgggtcccaggcgtcattctagacacaggaccattcattcagacgaaatgtagtatctgtgtggcttcctactggccagagtccagagccctgctgcgctagctcctggccacgagtccctcccctgtcttcatagggaccctatgcattggattgtagaatgttgagcgtgggcctggttatgtcctctccacagctctttgccatcaccacagctgctcagaatggccaacaggggaccttcctacggcctgagccgagaggtgcagcagaagattgagaagcagtacgacgcggatctggagcagatcctcatccagtggatcaccactcagtgccgcgaggacgtgggccagccccagcctggccgtgagaacttccagaagtggctcaaggacggcacggtgagtgctggatgggtgagcggggcaagcagggcgagcagggctgatgctgggggaccagggagcgttttacacagtgaagaggagaaagcgagcatgcaaacccaagcttgccagcctgagcatcttcctgggggcccttagagcttccatgcttttctgtctccacggaggaaaggacaaggcggatgtgcctgttgcagcaggagctgataggtgctggtgatgtttgcaaagagggtgagaaggtaagcgccaggccgtggttctggagtagtgaggaaagactaaactctggccctttatctgggttcaaaggcaggaggcaccttgaggctcaccacaggaaaggcacctctctggctcactgtctttggttctctgaccttcagtagtcccatcctcacctctgcctgcctgctgcctcttccaggttctgtgcaagcttattaattcactgtatcctgaggggcaggccccagtaaagaagatccaggcctcttcgatggccttcaagcagatggagcagatctcccagttcctgcaggcagccgagcgctatggcattaacaccacggacatcttccagactgtggatctctgggaaggtgggccagggcccagggctattacctggcagagcaggagttggactgggccaactttaccaaagaaaaaggatagcttgtggttttcctgagggtgtgtgtttgtgagatcaaggatgggccatactgcaggttgaggttgaaacaatgaattaaagtttggatgccaggcttgcagacctagcgacagatagaatgctagcatcttgtaacttacttctgctgagatgatatcaccgttttcttccaggaaagaacatggcttgtgtgcagcggacactaatgaacctgggtgggctggcagtagccagggacgatgggctcttctctggggatcccaactggtttcctaagtaagtgtctgtgggaaagccagagggccttgctggtacagtattcttgcctattcctatctgtagataatagagtcagtcattacaaagcatctttaaaattccagaaggtggtggtggtggtggtggtggtggtggtggtggtggtggtggcagcaatggctgtccttttggagagacaaagaggtgcttttaggcagctcaggagtctcagaagcagagtgggtgtcagcttatacacctcagggaagaatttaactggatagctagcccctgaccaccccctaactagtactccctttctacccaggaaatccaaggagaaccctcggaacttctcggacaaccagttgcaagagggcaagaacgtgattgggttgcagatgggcaccaaccgtggagcatctcaggccggcatgaccggctatgggatgccacggcagatcctctgatcatactctctctccttcccctgccctccatgaatggttaatatatatgtatatatatgttttagcagacattccctgagagcccctggattgctgaactcccctctgccagggtccaggccagcctatcttgtcaccactggcagggcctgataattgcctctctctctctctctctctctctctctctctctctctctctctctctctctctctctgggcttactaatgcattccttcccccacaaccatcaaaactggaccaacaaaaaccctgggaccaaagttgcctccccacagcatctttcctgctttcctgatctcttcttttagtccatcccttggctaggagtcagagattctgccccatggcctgatgctgcaccgacccttccttctacaaggaggcctctcctacagctgtggctgcagggacttaatttatagggaggggcctgtggctgtcactccagccacagctgggctgtacttaccacacgtctgggcagctttccctagcagaggctctttggcttctttctttccattcctctctcactgtggctaaggggtggagcagaggtaggacggctgcccaccatgctctggggcttgacgaacacgagtttgctgattttaaataaaaagatctcattttgttttgcatggattctggctgtttctagggccactgcgcccatttcggggtaagggagtcataccaggcaggcagggaggggacagatgagaggttgccaggccaagctctgtctttattttccccacaattctctgtcatctggtttaggggaggacaggttgggtttgagaaggaaggattcagagctgtcatggggtaggagccttaatgcagattgtgtgatgtgtgtctgcaagatgggagaactttactcctcagcgacttgggcaggtggcctgctgttcctggcccgacaagtacaggcctcatctaacaggagatctttcagggagatggggcaagatggcccccatgttgaagcaggccgttccaacttgggttgctgaaggtgtgggggaaggggggggcgggggaggtcatagtggctggctggaaccaagagctggaaaatgagcaaaagtgagttggtggctgtggagatggacgctttgccccttggtcctactcacctgtgggctgcattccagggagagccttgcagcacagactttggcctgggacaagataatccacttggggttactgtcctcagcccaactcatgaatgaatgcttgcagcttgtaggtcttctgtcatctcaaggcttcctgtgctgtctctgtgtcttcccatggaggacttgagggactctgggtcacctagtgccccacccctgcccagtccaaccagccagtctcaggaccatgatctccattgtccctatctctgacaatactgtgcttgagattgatgataacagcagtttgtaaccaaaggcctctagtctcccctccttccatgcctcactgtggcagtctcttcctggaaacacctactgtgtgccaggcgccatgctataatttatagccatctgccccatggctttcagtctaatcctggcaccatgctatggaggagatagcattttcttgcttgctgcactcccaggggctgtggcacagataagacaggctgcagcctctgtataaatctccagggggttagctgtcagtcctttatctctcattcaggaaggctttgtggactgccagtgtgggagagtgatgtcattgcagacaaaacactgaatccacggaaattttttttttaaacatcctttcctgatttaactatttccagttacaactgttgtcaacacactgccatcttctgagatgtgtgtgatgtgcctcaggactgcctggtcccagaagattcttagagaagtcgaggaggccaatacaccttgtcattgcccacattctagtcactggctctcacaaagggcaagaaacatagccaaggccacctagaaatcacaggaaggcgccccaagtcggtctggatgaaggtctagtccagcctttgctgttatagccacaagtcgggatgtggagggactggagagatgtaatgggatgctgttcctcgttttgtaacactatagagaatgctttctcctaaggctccttggatgatcgtgtaagcccagagtggaaagggcagccatagtgaatgctcataagggcccaggaagtgcaagtgaggggataaaaagataggctttgtgtgcacctgggagactgctgctgtccactagggctacagacctctactactgcacagctgaatatgatcaaagaagctcccgctggcccgatccctctctctagagcaacatttcaaaggcagacaatcagtggggtccaagacatgctcattttccttccagctgtgatctccagctgcccaacttagagagggatcgaaaagtttcttagtccatttcagtaggtgttcaactctggcctggttaattagttagttagttagtttttgtcagcttgacacaaactgaagttatctggaaagaagaatttctattgagaaaacacctccctcagattggcctggaggcaagtctgtctatagggcattttcttgattagtaattgatgtgggagggtccagcccacagtgggcggtggcatccctaggcaaacggtcctgggtgatgtaaggaagcaggctgagcaagccatgaagagcaaacagtaggcagtgttcccctcgcagcttttgcttcagatgctgcctccaggtccccaccttgagtgcccgccttgactcccctccgtggactgggacttaggatgcgtaaagcaaagaaatccttttctcaccaagttgcttttggtcctgatgtcttcattgaagcaatagagaaaactaagacaaaaccatttgggggcctggcatcttaaggtcttatattgttattttctgtctcttgctatttagctctttgtccctgatgaagtcagtttcactcctgatttgactcttctaacttttcaacccctagaactcagttgggtccccatgccaagagaaacagctccattgtacaaagtcccctttgcttgtcatcgaccagatcccattctctgtatgtattttgtaactgatactggagcattctagatacctaaaacaatctccttcgagacctcgccatggtttgttcgctcttttatcttctcaaagctttgtccaaatatcacctttcctgaccaccctacttcaaaccacagaccacctcagcctgcatcccagcctgcatctccttccccggtgccatttatgactgtcccagaggcaatgttttacttattcatgttcagtctccacccatagaatctacactgcacagaggcagggttttattggttttgttcctggagagtggtgctacaggtgctggacaaatatttgttgaatggatgaacgaatgattgtggaaccaccaacttgctctcaaatcccctggcctagtaagatagggtccagccagactagggccacagcaacgcagcctgtcatcgggtctgagatgggaccaagctcagttgaccaagtctcccgctctttcctcgtgttaattttcgcaaagcaaaaccccaagccataaagtagacagagggtagtgtacaacgtgtaccctgggagaagggaaagctgaattgtgatttgagatggaggaggcggagcgggaggagcacgggaggaagagggcagagtcgactttggttcacttactttgccctccgctgtgaagctgggggtgtttgtgtgtgtgtgtggggggggggagggttgaggaagtaggcgtggcctatggtggccaatagaagggagaattagagaagggcaggagcagggaggagggggaggggcacagaaagctccgcccagtttagcttacctgcgagaaaagcggagctctgtgcggtccctgtgtgtgtgtgtttacccaggtgtttgaggaatgatcagacctaggctcagggacccctggtgggagagatgagtctgtgaagagactgcctgtgagtgtctgtctgcccagggtggaggataatgggagggtagaggtgtaggttctgtgtgcatgggcccccgtgtgtttgtccacggagaacaatagacgtcattcctgctcctattgatgtctgagaacctggcaaagggcctgaggcacagtggaatcgggagagggctgggtaacaggactccatcggagagacaataaagggcctgggataaaatttgttggagaaaaggctggacgaatgaattaggaaccaactgtctcttttcgaagaagtagattttagtcccagtgggcaaggaggtggattatacagaaaaatgccctgaagttgcatctagagaaatttcggggacaaggaaagggaaagatgatcctcttgccccgaaaggttattagcctctggaatctctcaagggtcagaaggaatgtcttcaataaataggacaaatctcatttcctaatggaggacgataggccgctctgcctggaaatgctcagacacacccctttccatgtgtgcttttcagcccttcccgggattctatgtcagactctacagggtgagtttacttattgatacatgacctctttactcaaagactctgtggccctgaagggaaacaacatggatgtgagccgtgatgattcttgaagcctttgacgaaaacatgcagggctctaaggaaggcctcgcttgtcaactcaacagcctggtgaattctggaataccacaggggtcagaggtcacccatatcagggatgatattctctcccatctgcccaaggaaatatgggagcctgcaagggagacttttgggataatgagcactcactggctttgtggggtcagaggtcaagtgtctgtgggtagagagagggtagtctttttttggagggtggacacgatcatagaggcatgagtaaggttgagaaggcaaaggcagacaggtcacatgactagaatctgaagtgtgtgtggagagatgatagaggcattccctcagacactggggctgtcattctgctctattccccttttggtagaatatgacgttttagatggttttctagtagggaaatacggtatggctcagtgtgtgatagaaacaagatggtggtgatattcgagattatattttacttcacccgatgctcgggactctgtgttttgggtttgccctttcattatttcaaaatgtaacctttgaacaggtgaggaacctgctgggtcttttggggtgtccgggtgtggtatctgcaattaacaagagaaatgatctctgctttcttccacttttcctgtaagaagagtgaggagtcaattataaaacagcatgacttgtggtataataagagggcttaggtcttagggtgatctccaggatgagtgccatggcccaccatcatcaccattatcaccatcatcaccatcaccattatcaccatcgtcatcatcaccatcaccaccatcactattatcaacatcaacagcaccatcaccaccatcaccatcgtcatctccatgcctctaccatatactgagccatatttccctactagaaaaactgattttaaaaattggattcttccatacacctagaggcatataaagggaggccgggggtggtgctacgtgccctcaggagatgaggctatgcagaagtggactatagactttccagatgatgctcaggaggtgaggatcagatcgtcaaaggagcttcaaagagaaataagtaccgtgggcagttcccaaagggaaatagtggatactccccccaccccccacagggtctcatgtagttggccttgaacttgtggcagccttcctgcctcagtctatggctggaattacaggagtttgccaccgtatctgatgactgaatgatcctgagccagacgacagagttacaggctgtgctttgtgtgaaagctctgtgaggctaccaggtaaatggtctgaaatttgggtcaggattgttgcagtttctcaggctgaagtgacagtcaccaagtttgagggtagaacatgaaggagagaggaagggattaagaaagacattgttcagtaactcacaggttagttactgccgggatgagaaacccacgaagagagggcactaacctaaaataggaatgctttttcccattgaaagtcgtagaataccagtgaacctagcccagccaaactaacggaacacctgaaatctaaactctagatggcgcgagtccgagttgtggggttcccctgtgaagcgactgaccctgaagaaggggttcagcctgcagctgacttgagctgtggttttcctgtgagtggaggccagggccacagtggaggaagggagaggtcgggctcggcaaggggcaccggaagttcatctccgcgcgcgcagcagccacctctctctctctatggagatctggctgctttgcatgggagctgacagagagccggaggcattgctcctggatcctgcttctgtgggtttctgtgctcaaagcagtctgaccttctcagacctctctcagatagccccagcaacagaagccactacgaccaccaagacaatacccaagaggtgtgctttcaagacacttggatatgtattgatcccagagaggcttgtaacctcctggtaaggctttagtacttcatatcctttggagagagcagaaaggcagaaaggcagaagcttatggagtacgagtgatttgcctggagtcctagggtttctgggaacagaaaagctatgcgttacatacagatctcctgttcgcttctggttctcagaaccaaaagtgttgcaaccagaaggagctcagagctcaggagtttgaactggctctgtgtgaactaaaatccagatgcctagactctggtcaccaatcagttgatattgaaagtcaagtgccctcagggatgggactggctttagacctcaaggaacacaggatggcgtgttctcctaaccaccaggagttccaagtggctaaacacgtctgttgtcaaaatgatatcctccagcacggggtgaggaatgcagatcccagaaggcttattagatctgtagacccggatcctggctggggattgaaccgcatctcaaacggactcttcaatctttaggcaacatgtcccagaagactggaaaacgtttctctaacaagaaaactgaggtcttgaaagggccccggcctgagccagaaacagttgtccctaccccctcaaccctagctctgtttggtgactgtggtggggttgccaggggaaccaggctgtgcaacttcctggctttggcgtttttcccccgatgttggccttatctcggcatccgccacccagtccagggctgcgtgctggtcacgtaggaggggaagtgggtgccaggcgtgttgaggacaccaagagaacactggcccaagtatcagatgggcaggagggtggtgaatgggaagttcgagaggtccaggagggtgggcacgggttcattaatgtctttctctatggcttgggaggttcctggcaaatgaggatgtggagaattgtgactagtcaggggctttttctgccctaactctcagctctcagctctctcacagccggatcccagcatcacctgcatgtctgctccactccagacctacagtctccagccccaagcacacccagtggtccctaccccaacaccaacaaccctgcttctgaagttctatgcacttcggctctttctgcctggttcaagattactttctgtgttttgggctctcctttctccccattgcagttcagtctcttgggcagtcatgaagaacaggaaagagaaagggggggtttttgaagacagatggaacgcagctagcagtttaagtgaagtaattcgtgcatttaagcatttatttatgttttgagccttactttgatttgaaaagaatttagggtggtttggagaatttaagtgttccaggaaaggcggcgtgtgatgcaactctcaagcttcatacagtttagaaaaaaaaaaaaaaaaaaaaaaaacaaaaaaaacaaaaggatcctttcctgagtcctgatgtttgtgctgcactaaggacaagacccccgagtggctgaggggaagaaaacactgcaaactgattttcaagcacgatcttatcttcatacccctatcccaatcccccagggactgggcctatccttctttcccaggaggaaaccaggcccaggccagggtcaagccttgggagactttcaaatcattgctgtccttttccgttctgttcctccagagaacacagcatgggagagcttcctcctggccctccaagactggattttggctaggaaccagactcagaagagacagctttgctgaggatcaaatggctaccccctaaaatggaagcagaggctgtagaagacctaggagatggaggtgactcctggcctcaggaactctgaggactgagtgtagaagttcagagagatcatgaggagttgccttatgcatgtaacacaaatccctctacaagaatgtagcatctcatctcagtctctgtccgtgagcagccacctcatcctgtttccttcctcacttagctacatagtgtcattcctcctagtgctgggaggctgggttcctcctagtgctgggaggctgagttcctcctagtgctgggaggctaggtatctccaggcatttcagaggggcaggcggaaggggaggacagggagtggcagaaagccagtgtccccccccctggagatatgcttaactgagaagccagactttaatagctctgctggactctgtctcccaggttcctcccactaaatgtgcttactcatcagagtcaaacttcctgcatctcctgcctcagctagtgttggggctcaagggccagcagggtgattggccaggcactcttcagggttccaagggatgaaaaggctgtttcagggtcaagtccaaaccagaacgaacaggctgggcttgccttcatgcctctcctggattctgacccctgggtagcaatctaggccttattctgggggctttcctgggagtggtgccatggtagaaagagttagacagctggaggtaactgcctgaagtctcaggagataagggtaggatattgctgtgcttttgagccatattttgctgagaaagctccttctcagcgcctgggtcctggctgtgtgaggcccaaagcttatgtagtgttggaagcttcagttgagaaaagcaatatgaaattattaatgcaaaattaaatacagagacaaacacttgtaataataaagctggaataattacaagctttaagcactgtggaaaatgtcaccaagatcgccactgcaggaggagtcatatgctttgtgaatggctattccacccccgcctcccagtctctttgaataataatgattttataacctgtaagacaacccagtcttctcgggatgtggattgaacaacacttttattattattgatagagtagagtgttcctcttcgcagcttgttgtgggcaaaatcactccggtttttattgttcttgtcaaatttggggaaatttgtattacatttctttcttacaggaggtgtaggatttcagagcatcatcggtgattaatcttacatgtccttggaattgacggcactcggtaattagcttgtcacgggtcctgctcttgctttgctaatatgggcttcacgcattctctatcaaggtcgacccttcatgttaaatcgacaatgaatttcccattttcccagatctttgtgtcattcccttctccttgttaagtggatcactacgcacaccagaagcatcatcttactccttcaaatttcatctgctcctctcccagaattacctttctctgtggtataattttaaaattgttttaatttgcctctcaatttccgagtaattcccaccgatttcgtggctcgcttttgctctttccactccgtgagctatccatcttaacttcatctaatgcccttggaggcatacacttaaagacggaagaagaaaatgtctgcatgtgtccaaatcagaaatcttctaaattcgacttgcctgattggcatctcaaaaagttggcatccttggatttagctcagtggtggagtcagtgaatttgattcttgctttaaggagattgctcagtgggcaaaagcgctcgctgcaaaattgtgcctgacctgagtctgatccctggatgtggtagctcacatctgcatttatgtggtagctcacatctgtatttacatggtagctcgtatctgtgttcatgtgtgttcgtggcattccttttttattttttttaaagatttatttatctattttatgtatgtgagtacactgtcactgtctttagacacacctgcagagggcatcgaatcttatttcatatggttgtgagtcatcatgtggtttctgggaattgaactcagacctcctgaagaacagtcagtgttcttagccgctcagccatctctccagccctgttcatggcacttttgtgtggggatggaaagtagaacagaataatcatactac

SEQ ID NO: 1478 - DNA, 1370 bp, Mus musculus
ccggccgggtcttgagctccactcgccgctgcagcccctgtcgtgcgtgcgctctcatccagccctcttggacgctctttgccatcaccacagctgctcagaatggccaacaggggaccttcctacggcctgagccgagaggtgcagcagaagattgagaagcagtacgacgcggatctggagcagatcctcatccagtggatcaccactcagtgccgcgaggacgtgggccagccccagcctggccgtgagaacttccagaagtggctcaaggacggcacggttctgtgcaagcttattaattcactgtatcctgaggggcaggccccagtaaagaagatccaggcctcttcgatggccttcaagcagatggagcagatctcccagttcctgcaggcagccgagcgctatggcattaacaccacggacatcttccagactgtggatctctgggaaggaaagaacatggcttgtgtgcagcggacactaatgaacctgggtgggctggcagtagccagggacgatgggctcttctctggggatcccaactggtttcctaagaaatccaaggagaaccctcggaacttctcggacaaccagttgcaagagggcaagaacgtgattgggttgcagatgggcaccaaccgtggagcatctcaggccggcatgaccggctatgggatgccacggcagatcctctgatcatactctctctccttcccctgccctccatgaatggttaatatatatgtatatatatgttttagcagacattccctgagagcccctggattgctgaactcccctctgccagggtccaggccagcctatcttgtcaccactggcagggcctgataattgcctctctctctctctctctctctctctctctctctctctctctctctctctctctctctgggcttactaatgcattccttcccccacaaccatcaaaactggaccaacaaaaaccctgggaccaaagttgcctccccacagcatctttcctgctttcctgatctcttcttttagtccatcccttggctaggagtcagagattctgccccatggcctgatgctgcaccgacccttccttctacaaggaggcctctcctacagctgtggctgcagggacttaatttatagggaggggcctgtggctgtcactccagccacagctgggctgtacttaccacacgtctgggcagctttccctagcagaggctctttggcttctttctttccattcctctctcactgtggctaaggggtggagcagaggtaggacggctgcccaccatgctctggggcttgacgaacacgagtttgctgattttaaataaaaagatctcattttgttttgcatg

SEQ ID NO: 1479 - protein, 228 aa, Mus musculus
APLAAAAPVVRALSSSPLGRSLPSPQLLRMANRGPSYGLSREVQQKIEKQYDADLEQILIQWITTQCREDVGQPQPGRENFQKWLKDGTVLCKLINSLYPEGQAPVKKIQASSMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 1480 - DNA, 27566 bp, Homo sapiens
  misc_feature (1)...(27566): n = A,T,C or G
cggccaggcccttgggaggggcattccagaccgggggtgcggggagcaaaggcatggagatgggggacagccagctgcccatactgacctgaaagagttcatgagggctgacatatggaaagatggctggccacgtagggagggtttggatcgcaggggtccacagggctgggtttgagcttagtgtagtaggagccaggtgctgttgcaggttcctgagcagaagtgttctgtggctcaaggggctgtttctgtatgaatggccattagagtggcagctgcaggggagcctggagtcaggggctgctgcagcatcttgaggtgaggtattgggcacctgggttagggccagagacagagaagtaattcaagaggtgacaagcagggatacaaatggtaaatgagcagagttaaactgacgcccccaaacacacacaccattcctaggcagtggaactgcatgaatggagttgctcttgatggaacagagagaatttggaaagaagaatgggtctcagggagaggatgaattcttgttacatacagggggaagcttctgcttccactccccaaagccctgtaacaacgagccctaagattccagagagcagagctgggaagagttgtagaggtgacctcagggttctgggaagactgtgggctgaggccaccttcctccccttgtgcatcccacaggacccccagtcatcgtggtgccccccaagaacagcacagtcaatgcctcccaggatgtttcattggcctgccatgctgaggcataccctgctaacctcacctacagctggttccaggacaacatcaatgtcttccacattaggtggggtcaccctcattaggaaggtggaggtggggaattcacaaacagtctctgaagagccgcttggctgggcaaggcctggacccctcctcacacatgccacattgcagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctgtaagcctgaccccagcttctccctcagcctgctcccttcccctgggccaggccaagcccctctcccccaacttgccactactttcccccagacccagcccaggtgacagctatgcctcctgagacacccctgcccataggcatgccgggggtgatccgctgcccggttcgtgccaaccccccactgctctttgtcagctggaccaaggatggaaaggccctgcagctggacaaggtacaggcttggggcaggggaaggagggtcttagcttggcgttattctgctcaggacagcagggtggagttagctcggtttaattcagttcagtgactggggacacacatcttttgtgaatttaatttgtgttataagacatgttgcataggaaactacttaaaacccctgaggaaaaatttccatggtttaaagtggtggttttgtgtcttctttggggaaagaagagagatgatctctggggaaaatgatggcaaagagtcaagaaggagaactgaagtttctttcgtgtgatgactgggaaattgtgtgtcccgggggaacacacacttcttaccaggtgctgtgtggggtagtgggttgagggcaggggcaaggaggcatccatccttaaagtgggcaccatctgggcagaggacagcaacactgtctggaaggccagggatggagctcgtgccttcctcttagggtggttgaggatagaccagcaacagattctgggactttggtgatgggcctcaaagaggacacagtcattcccttgcagaaaccagggtcaagaggcaggaagtagtatagtacgtttatggaatcatggatcgtccaattgggtgggagccggagtgcctgcagggacatgaatggtgcagagaaagctggaaagacaggttagcatcaaaaggaagaactggatgccaagttactattgcctcattccaaggcaattgggatcttttgtctgcagagactataaatttttgaggcctagtattgcatcttttcatcatagtgtacctggggcttctacaacaatagtactcagtatatctttgttgaatatttaagaaaaaagtctacaggcagttggagccactggaatttgttgagcattggtgtgataggatcagagctgtgatcaggggttgagcttgcccagtggaatgtagcgggagatactggacataggaagaggggttctgaagctgctgaaatggcccaggtgagagttatggagtctgatttacagaggacatgaagatgaatgggctcatgctctgacaaaagggacttcccaggatgactggcttagtgagtatttcaccagggggagtgagggaacgtgaggaggcagacttcagcaagaaggatggcgggccctttaatagagaaataggagctggttttgggtggaagactctgaacttagttgtggagtgctgggaagagagccaggtgaagtcccagcaggcaggaagccccacgcggcccaactacaggggtggccattcacagtgtattttctgtgagtggcaccccctggagttgtgcagtcacagcctcacactattgggaggggtccctctgcaggaaggaaaggaagcactggaaatcagagaggggtcaggcctagacatggagctgctggagtcttctgcacagctgtgggtttctcgtcctgccccctctcttgtactgccatcccgggcttgtctctgctgagctcctctctctagctgtcatcttctcttccttccagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggttaggccgggggtgggcgggggcctgtggtgacagtgggtcagatggctggagatggtgctaaggccaggctgatgggggtggggtggggcagacacatggggaggggtttccaagtttgtttcccatggtggccacggcagcagctgcctgatgccatcccagaggtttctgcagaggtggtgctcgggaggtgggacatcagtcacacacatccagaagtaagatatcctgtttgccccaactctcactaaccttgaccgtgctgcctccctctctggggctctgggaggaagaatgttctgcagaggtttgtacatctctgagagtcctgcctaagcctgccagcccttactacaccaccattttcctccagcccctacccactggggaacagaaacagagccagagaggaattgagagatggagagagaatgaggtagagacaggcttggtgagtgtttagctagggggagtgagggagagtgaggtgagacatggcatgacagggagcacagagagagggagtagccagccttagatgtaagagagggcccctcccaatgccagatctggcttgcaggctcccccagcttttatagagcggcccaaggaagaatatttccaagaagtagggcgggagctgctcatcccctgctccgcccaaggggaccctcctcctgttgtctcttggaccaaggtaaggctcctgagcccgctctgcctgtacccacgcccactacacccctgcctctcgtgccccagccattttgtgggagggagggtgtgggaaggagaaggctgtcagaggcagggtggggaggaactggagctgcctggagagatgaggggcgcctttggtgaggggtggctgcgtgtgtcctcagggctcaccagtggttctgtaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggttagtggctggagagagggccaggggctgggagaaactacttgggaatcgtttttggaggcccagaaagaggatcatgggtgtgggacccctgggatgatgatgggtgaaggtcagtggccctggggcccctgctactctgtacactccctcaggccctgaccaccatccctccattcccccctgcctaggcactagccctcatgttgtcaccaatgtgtccgtggtggctttgcccaagggtgccaatgtctcctgggagcctggctttgatggtggttatctgcagagattcagtgtctggtacaccccactgtgagtgacctgctcctgccatttctctgtgccaatcttgcctcctttcctctcctccttgaacctatctggccttctgccctttcttctgtccctctatccctcaccagtcctggctctgcttccctgtttccagattctgaggcattcagggccaaggtcctgagaccttggatggttgagcagaggggaggtggttagatctctggaccccagatcttctggtcttcctagctcacgaggtgccccccatgtcctcatgtctcccagggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaaggtgagaagcttctcgtcccagaacagcagagacaaggatggggaagggctgctgggagagctgggatatgggaggccctgggtgggaaggggcagaggtgctggccagcttggggtccagaggggtgtgtggaagatgatttgagcttgtcttcaggggttctgggagaagagttgggcactgggagttgtggaaggccaggggaggggcgctgggaatccttgctctgacctgcctttctgtcccacgcagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggtatgtgcgaaaggcgatacagagagaggcctcctaggggctctcctgcgtccttctccattccccaaactctatcttctcatcttgatttgagctcttcacctctgcgtcctacctcacccttccgtcccacgtgcacggtctttccgcgccccgctgggttgggcggtgctgggccctgacctccctcctggtaccccatccccatcgcaggatgttctctacgagttccgcctcgtggccttcgcgggcagcttcgtcagcgaccccagcaacacggccaacgtctccacttccggtgagcacctggcgtgagggaggagccccagggctgctccgagtccactgaccctccctcgtggacccctgcctaggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaaggtaagtccctccaccctcagccctgctactgcgcacttgggcctagcctccttaagcccctcctacctgggggaaaagccctcgctcctgtgtgatccaggtgcattctcttagtcctgcatctggtcctgcctacgcttttcccagccggatggggttgggcgcctggtgttgggtgagagagtctccgcctagagggccttgatttttgcctgtgtcacctactattctcatgcccttccagatccacctcttatcttctctccgaccgggaagtcagctgcaccgtaagtgcctccacctccttggctttcttctgcctttccattgtacgtgccagtatcttctgcttccttttttgcatctttaccagggggatgttgggtgttggggaggaacaaaagtgggagagggtaagaaggggtgtgcagtggccccagcctgaggccgttccagtatggcctgtgccttccctccaccctccaccatgttggtcctttcctcgcttgttcttcctagctctgctctgttgttcaccaaacctctcaaggcctgacgctggctcctgggagggggacctgcccctaccacagaccctgatctcctgtccttccccagctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagcgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggtgagagcagtccctgcccatccctgcctccgcctcagtcccaccccagacctctcacccctctcccaataccctgcaccttctctgctccactcccaccctgggaacgggaaaacttgtcccttttagaagcttttgctgaggtccagggatttttcaggggaaacccatgacctaacgtgagtttgcggtcgctgaattcagacttttctgaacagcctctattcctccacccacaccatatgtttgtctttttttttttttacaggaggaacacatctgtggacgagaactatgagtgggactcagaattccctggggacatggaattgctggagactttgcacctgggcttggccagctcccggctcagacctgaagctgagccagagctaggtgtgtgagccccccggaaaggcaggcatctcggccatactgtcccacatccccccgccaccttaggacccatctattcccagtcaggccctgcctcccaggctcctctgctctagactgtgccttgcccccttgggccatctgtactggaagggcctagcgagcttcacatctgagctcttcactcagtgaacctcagggcttcttctcattgtcctgcccgcctcttgcaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctaatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcactatgtgccaggcactgctctaagccctataggtggactgtttagttctctacaattctatgaattaggtagtactattagctctgttctatagaccagggaactcaagcacagaatgcacaacagtcacacagcaggtaaagggtagagcaggtggggagccagtcaaggaagggaaactgtcctaggcagaggaatagcctttgtaaaggcacagaagagtgagaatgcttgacaatcagtgggactggaatatagggctgtgtaggactcggggagggaacagagaataatagaaaggttggacaggactggatattgacatcctggaatctcaggttcaagggaggactctatcatgtgtgcagaactccaccccgggggactctattcaactgaagcctgaaaggatggggggctctttcttcacccctgaactgtgctgtcctccaccctcagagacaaaagaaccccagccagcctcctcgcgctgaggtctccccctctgatccctccaggatttaggaagagataccaggtcatagaaaaggagatgaaaggcagggagaagacaggtctgagccctgggtcccaacaccgaaaacacccctagggccctgggcagagtgacctcactgttagtccctgcccaggcttgaagtaagaggtgagcaagatcacgtgggggtgctgtcccggcctgcaagtcccagtcctgtcacacactagtcagttggggtcgggggaaggccttcctgtgcctccttttaccttgccagcctctaaactaggaggcttcttcctacataaacacgcccacagtgtttagctaactttctaggcagaaagtttcctactggggcacaagtctacgggctctcggtggaggctgaggtactcacgggtggagaccactgcagccgcctttgtagattcagactccccgaacctttaacccttgctctggtctactgtccctctgtctcaagcagtcctccctccttctgcgctgcggcgcctttaaaccttcttggcccttgccccgccccgggtccgccccgtctgaggcgggaccctcctgaaaatccccggctgggcagggcgcaccacttgcagctgcagcccttgccttgagtcagtgcgccgctctccagcccgcttgaacggtgagcaggtcgggggtacgggggtcggggacatgtgcgtgctgtgtagaaagcaagaagccagcgctttgaacttgctccagcgagctcggggatcaagggctggtaccaggcaagggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaagggcgtcggactttagctggctggccccgagtgaccccgggtcgtggcgccggccctgggccagctcgtgctcctgggctttcccgcgcgacccttcactttcctggttccaggagcacgtgtgagcactgcgtgccctctgagtccccgaggccgcccttttcatttcctgttcctgctagcttgctattctggggactttgaggtcacgggctggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagacctcagcgcgaggaggctggctggggttcttttgtctctgagggtggaggacagcacagttcaggggtgaagaaagagccccccatcctttcaggcttcagttgaatagagtcccccggggtggagttctgcacacatgatagagtcctcccttgaacctgagattccaggatgtcaatatccagtcctgtccaacctttctattattctctgttccctccccgagtcctacacagccctatattccagtcccactgattgtcaagcattctcactcttatgtgcctttacaaaggctattcctctgcgtaggacagtttcccttccttgactggctccccacctgctgcctccccccgcgccctgtgcctcctggggctacctgaagccggtgtcctgggagatctgtgagcagttggtatctgtggggcagagagaaacggggtgagagtggggatggagtgtgggattcgatgtagaagacctgcggctgggacggggctcccccagtgttctcattgacttcaaagcaccagacagcaatagctctctatctctagccccctcccagtttctcctccccactacaaggggcagacctacaactgcagaggaggccaaggcagggcgggcccagtagggccctaccattccagaaccaacaaataggttttgtccaaccgcaactccctccctcaccccaaggcctctgcccctgtcccccaccccgggattggcccctaatcctttcttcattccatcccttctccctccagaattttcagctgtgggttctctagctcagaacactttcccttcccaggggatttcttctcctgaacaactacttcctgagtcctcttcttcaccccaacacgggtcatttcctatcttcccccacacgctgtccatccccactatagctgtctcctggaataatctcttgcacctggctacacccgagcactgctgagacgatcccacttctgctcccgtgctcacagcctgctcaccacaacgtctgtgttgacagggtgtttctgcccggagcccccacccagcctccaacactgtttggtacacagaagccatggcaacggcccccacctcatcccctcctcccacgcaagctttggagcttcctgtttgtgtagcctcagctttctcttctgctcctgactctcggtggtgaggggctgccctacggtggttcccttaattgtgggccgccccccatccttgctgctggctgtggcacctcgctctgtgggctggtgccctcactgtgctgctctttgagaacactccctgtcccaaatctgagttgggaagttctcctgtgttccatctgcacggtggatggagagtccctttgtcttcccaattaaacaccctagccaagaaccctgaagtcctccctgcccccacccatgtccgccttttctttggctttggctttggtgaggtaagcttccagcccagggtctgggtggggccgagtgccttgcgtggcccctccccgtttcccgcctattgtaactccagggtgagggtgagggttgttctcacagctgcagtagcgctagggtttaggttgctccctgccagtccatcccccaggttgttcagctgtcaccttcctttggggtccccagctctgggggtcccccacacctgtcttccagctgggcatatctcttctcaccctggtaggcaacttgcttactgttttctttatgtttgagggaaggcaggggcaggtcccctgggtgtccctagggtgggccttcccagctccagcagccgcagcccatcagcttctgcctgcccgtgggggtggggaagagaaacagctgctgaccaggcctggcctggttggaactgccccttctcaggaccccgccctatggctctggcacctcagagcttgagggcaatggccccagagtggagcagatacactgcagctggaggccgtgaccctgccagctgtgtccaggccccagcgttgggcggtggagggggttcctcagcatccactttccacccagtggtgggtctgggaggccaagtttgtcctgccttggggggttggggggcactggaagtgtctggcttcaggcctttctctctgctcttaaccccagtgtctaggttaatcattctcctgccctttctttacctgtgccatggtgatccccgagcctcaggccacttggtccctggaaacagccctgagcacagccactcccaggagagaggtctggaactgggctgcggaaagggggcttactggtggtagtagctcttagccccttcctcttcctacctgtcttccagccattcccctgtgcatcagaggttagaggtttctatggtggagtggcctctgggaagggcagggatgcttctcttggtttctcctcagaactcagccaccccaccccgcctgccttccccaagctgatggtgtgtgtgcctggcgctgtgggtcggggcccagactgacatttatctggcccagctttcgggctgggggaagtggagggggcgggttgctcttaatgaggtttaaaaataactgatttaggggaggatctgccggaaatgtgcagcttgataagctggggtaaaaaggagcagccatgttggagtcgggacgggagggactggcccaagacacagcctctgcggccgagaggtgttgagggtttgaggcaggctggtccccttgtatttcgcagagccccaaggtccattgagagggggtgacgggattgtttaacctgggtgtgtgggagagggggagctggagtgacttcatccctgaaggccaacctggcctggagccagatgtggttagaaggggtggctctctttcttccccttgaacgcagatgcctgtcctgggggtcccctttcgtgagcagcctgacagctagctctgttttggagaagagagaaaagccaaaccagggtggggatgggacagaaaatggggactgtggcccattcttggttcttggctccccttggcatccataccatgcccgggtcttgctcagcccctgagtgtcagacccaggtggtgagtgtggtgggaacacactgccacagtgaggtccgccaactcaggccattggtcgggaaaccacccagttcttgctaatcaagctcctccaacgaagttaaagaaaccctcctgtgtatttccccgtcttgccttctcttctccaggtttccccaaaaatatcacccagggctcctgtattagtttcctatttctgctgtaacaaattgctacaagcttagtgatttaaagcaacacaaatacagcatcttacagttctacagactcaacaggggtctcactggctaaaatacaggtgttggcagagctgtgttccttctgggggtttttgggtgaatctatttccttcccttttctggcttctggaggccacctgcattgcttggttcatggccctgtgtgactctgacttctacttccattttgttgttgttgttgttacttctcccactctgactcacctatctcccactttcagttagtaaggcccttgtgattacactgggctcatttagatgatgcaggataatctccccatttcgagatcttaatcacatctacgaagtccctttttgtcatataagataacaatatccacaggttctgggaattaggacatggacaccttttgcgggggcatgattctgcctgtcatagctcctagaggggaaagtagaatttgtttttattgcctggtttttcataggaaattcgatttgtttgctgaaatccctcaaggacctattcaagcctacctcttccagaaagccttcccaggctgcttctgcccgtctgcttcttttaactcctacaacatgtgatctgaactgtgcactttagtattctttgtgtgcaatccttacctgttcatatgtactcactttgtctccctgatggcactgtgggcacttgaggaccaaggacttctactatctctttcacaatccctagcacagatagtaggtgctcaattaaaatccagtggtttgcaccaacctagatggttaaaaaaaaagcaaagaaaacccagaggttgagggagggtagatccaaccagtttcctaagctgttccacattcctcctcctctccccaaatcattctctttcccagggctataaagagcagggttgcatttggtagcagttctggtcctcatccttggggctcaccgtgggggaaatggtgtatatccctgcaggcagaattcctgaattccccactccccaggctgcaaggtgttgaccaaaagcccgggtgtgtcctctccctagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgagagccgggccccactggcttggaagtgcagggagagcaggactgggtccagtggactggggattgtttaacctgaagaggagaagactgaaggcacacatgtcccagcctcttcctcagcttgaaggcctttgtcaaggatgtgagagggcccatgctttcctcccttcccgtggagtggagggtaagggtgaatgtgcctcccaggcagtggaagactgaggtgacactgaggaagaatgtctctaaggaaagaactgtgggagggtatattagcaaggaaagactaaacactggcttttcactctgggctcggaggaaggaggctggcaagaaggactgtgaggcttactctagtgaaagagtccaagctgtcttcaggcaagacaggagcctctctggttcattgtctctggttctgagggtggtgtacgctgagctgcgataggtaggcatattctcacctttccacccctgctgtcctcatccaggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggtgggacagggcgaggggctgggtcctgtcatccaggaggccagagattgggctgggccctcttgaccaggcagaaggggctgttttctggctccctgcagagaaagaggggtgtgtttgtgttccatggagcacttggtcatattggaggctggaatggagaagggtatggaaatgaacagtagaaataattaggaagccaggcctgctgacttagcgatagaggcggaaccctggtatctaggacactgcggaggctgacacattcccattctccttcccaggaaagaacatggcctgtgtgcagcggacgctgatgaatctgggtgggctggcagtagcccgagatgatgggctcttctctggggatcccaactggttccctaagtaagtattgctgggacagccgcagggtccagcaggtgcattgtttctgcccaatcctgtccctaggaaataacttatctcagtagcagctggccctttacaaagcactttcagaaaattcctcatctcacttaatcctcacaacaccctctgggatggcaaatgactgtccctttggacagatgaggaggtggcttcagagagcttatggctctcgagggcagagctggcaccagcccttgagccaacagcaaagcctgtgctctgtccaaggaagggatttactagggcagcctgtgatctcctctaaccaccactcccttgtcacccaggaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatggactctggctgtgtctggggccactgtgccactgtggggaagggaggaatactgggcaaagtgcagtgagtgatacaggaaggagggcagagatgagaggttgcagtgctaacccctgtcttgagtttcctccccatcctcattctcacttgctttggggggtggtgtaggttggaattgagaggggacaggacctcacagctgaatgcagactatgtaggcagtgtccacagggaagtaaggccctttctagtcaatggaattggctaatcctgcctgctgcctttggctgggtctgcctctacagttggaacagcttctcagtcactgagagggtggggctggctgctggcacagccatcagtcctggcaagtgaagctgtctccaggtgagaggtccctcaggcgggcttggggtgaggtggtctgtgttggagtggtgagggtgggggttgcagtggtgaggaaacgtggagagctggggaatgagcaggagtgagttggtggtggtcgctggagggaagaagccgtgttgattgatcctaagcacctgtgaactaagtgcctgggagagactaaaacttcctttctagggtgtggccttgggccatgatcatcaattttgggtcaggttgtctctagcacctatccttgaccgaggcatgagtgttccacccacagtttctttttttttcttttcttttttttttgagacagagtcttgctttgtcacccaggctgtagtgcagtagcatgatcgctcttgttctccaggctggagtgcagtggcatgatctcggctcactgcgacctccgcctcccaggttcaagcgattctcctgcctcagcctcctgagtagctgggattacaggcatgtgccaccacgcctggctaatttttttgtatttttagtagagacggggtttttccacgttggtcaggctggtcttgaactcccgacctcaggtgatctgccagcctcggcctcccaaagtgctgggattacagatgtgagccaccgtgcctggctattttttgtattttttatagagatggggtttcaccatgttggccagcctggtctcgaacccctgagctcaagcgatctgcctgacctcatggctctgccttttcttgccatctcccaactccccagcctcagcctcccaaagtgctgggagccccacccatagtttctaaccactaggtgttacctttaccccaaggcttcccagtcagactctgtgtctccccagggggaatttgagggacgctgggccagtctgacattaagttccagccccatcagcctcacccagaggcctggccttccttgcccctttccccttttctacctgagggtatctctgtctcctaggaggagaaagccacaacactgtgcctgagggaaacaggtttgtatccagagcttttgttctctccccttttgttcccctgcttctctgaggctccctcttccaaaaagcacccactaggggcgaggcccaatgccaattcttcatagccatggctgtcagcctcatccccacaccacgcttagccttgccacaccacacctcgggagagactgtatttgcttgcttgctgcactcccacaggctgtggcacagataagataggctgcagcctatgggcaaattcccaggggattagatcctttatctctcattcaggaaggctttgtggaatgctagtcagggagagtgatgtcattgcagagaaaacattgaattcgctatgtatactaaaacaacaagccgtttgccaccttccctggtttaactatttatagctataaattattggccacacgcctcacaactctgagaaatgccatttgttacagtgccagcgctgagaaccactgccttctcccagaagattctcacaaacgcccaggaggtggatattactgtaatgtgttccccattttgtctttagatgaggatactggtctcagaagggccaaggaatgtgcccagggccacaaagcaattaagggagaagcagggatttgcatccaatcaagctggctctgaacctggctgagcctgtgcagctctaggctcagcaagaagtgaagctgtcaagggactaggggacagaggtggtggtgggtggcagggcaatgctcctcatctgtaagctgaagatgataattccttcctcgtgaagttgccgtgaggattagatgaaccctggaaagcactttgcatggggaatgctagcacatagtgctcaggaaatggaagtgtggggaataaaaggtggaacatttgtgtatggaccctgggctgagagggagctgatgcccagcagtttcatgcccttcaccactgtcctgttgaacacgggccaagatgctttcagtggccttatcccctttacctggaacagcttattttcaagggagacaccagctgtatttgagaggggctcagccattgggctcaccttcttctggctgcacccaccaccacccaagccttgtgaggaatctcaatgttcccttaattcatctaactgcagactcagctgcttccttctggagccggcctccagtggcatctcaacattttccagctttctgtttgtctgctttctagcattttgtctcacctgaggttacaatttcatccttaacttggcttctctcatctctgaccccacttcaggccctggggcccagactaggcaccagcctgtgtatggttctgccttttcttgccatctcccaacaccttattctgtgtggctgtctacagtggtgtctctctctctttttttcttacatttttctttattattattattattaattattatactttaagttctagggtacatgtgcataacgtgcaggtttgttacataggtatacatgggccatgttagtttgctgcacctatcagctcgtcatttacattaggcatttctcctaacgctatctctcccccagcctcccacctccacaacaggccccggtatgtgatgtttccctccctgtgtccatgtgttctcattgttcaactctttctttctttctttctttttttttttttttaactttaagctctgggatacaggtgctggacatgcaggtttgttgcataggtatacgtgtgccctggtggtttgctccacctatcaacccatcacctaggttttaagccccgcatacattaactgtttgtcctgatgctcaccctcccctcgccacaccccttccccgaccacagaccctggtatgtcttgttcccctctctgtctacgtgttctcattgttcaacgcgctacagaggtgtctcctaacactctgcacttgcagggcttctcctgccgcctggaacaatctccttccaggtgctgccctcacttgctcctttatctccttcaggtttttgtttagacgtcatcttccctgatcacctcatttaaaactgcacacttcaccctcagcctggaccccgtgctccattcctgctttcttttatcaccacctgacacccaatatattttacttatttattttctgtccccacccatagaatgtaaactacacaaaggcaggcttttgttggttttgctcatgtagagtagtggttggcatgttgtaggtgctggataaatatttgttgaatgaatgagtgagcatgacaccaccctcatgctcctcagccccctggcttggcaacacagtgcccagccagcccaagggcctagcaacccagcctttcatcatatctgagatacagcccagctcatgtctctgcttccaatgcttccagattattcatttccaaaaaataaaaacccaagaagctgcatttcctacagatagaggagaggaggttggagggtggattgcatgctctggacacatggaaggtgatttgaggatttgggggaaaaaaatgggaggagggcaggaggaagaggtaggagccagcttgggttcatttgctccttgccttcagcctggaagtggaaaatcactgtggaggtggagggaaagtaggcttggcccatgatggccaatggaaaggagagttggggaagggaggcagagaggaggaggaagagggggagaaggaagaaggtttcagatgctccacccagtttggctcacctgtgggtaacaagcgtagctctctgcagcctattcatatgcgtgtgagtgtgcatccaggtgtgtgagaattctcagggctagggctgggggccagggggtggggtgcggtgcaggtgggaggagataatctgtgactgtgtgtggaggctgcctatgagtatgtgtttaccaaggattggggataatgggtgcagagaggtgtttgtcctgcgtgtgtaggcatctgtgtgtttgtacatggttccgtggagaataatatgtcccattcctgcctccacagctgaaggaggcctttgagagcttggcagaaggcccaaggagcagtggaatggggaaagtgctggatgataggaccccagggagggaacaataaagggcctgggattaaatttgttgaagaaaaggctaaaagggtgaattaataactgtcttcttgcaaagaaatggattttagtccctgtggccagggaggtagattagaagaaaatgcaccaaagttgcatctagagaaatttagattagacaaggaaaaatgatcctcttgactctgaaggttattagcctttggaatctcttaagggtcaggaggaatgtcttcaataataggacaaaatgcatcttcttgcagaggaaaatgggcagttctgcctgggaatcgtcatatacacactcatttttttcattcatatattcattcatttaacaattattgagatcctactttatgtcagggtttatggaggatgtggattattaatacatgatctctttgctcaaagagtgcatagttctgtaggggagatacaacacagatagaagccatactatttatttattttttgagacagagtctctctctgttggccaggctggagtacagtggtgcgatctcggctcactgcaacctttgtctcccgggctctagcaattcttctgcttcagcctccccagtggctgggattacaggcgtgtgccaccacgcccggctaatttttgtatttttagtagagacgggatttcactgtgttggccaggctggtctcaaactcctgacctcaggtgatccacccaactcggcctctcaaagtgctgggattacaggtgtgagccaccacgcaggccagaagccacaagaatttaggaaacctgtgacatttgcctttggagaaatgcaaatagggctttttgggaagactactgcctccctctcaatgctctggatgaattcctggatggtgactggtggtgatgtcatggggagctgaggccgcgtacctcagggatcatctcccctgatcagcccaggggagtaggagagccagctggggggactgctctggaaaaaggagcagtccctggctttgtggtcagaagtcaagtttcagtgtggagcgaggggctatttctttcctgcctggggtggggaagggcaaaaaggcctgagtcagggtgagaaccagggatcaggtaaggacagatcaacatcaatggagctgggggtaggtctgaaggggttatataaacacttcctcagacactgggactgtcagctgtttcacatcattgctggcaggacctgaatttttttttttctttttcttgagatggagtcttgctctgttgcccaggctggagttcagtggtatgatctcggctcactgcaacctctgcctcccaggttcaagcaattctccctgcctcagcctcttgagtagctgggagtacagatgcctgccaccacacctggctaatttttgtatttttagcagagatggggtttcaccatgttggccaggctggtctcgaactcctgacctcaggtgatccacccacctcagcctcccaaagtgctgggattacaggcatgagccaccgcccatggcctctctcccattttatagatgaggaaactgaagctaagagaataaaagtaacttgctgaacccagctagtggaaaaacagatttaaacttcttaccactgaagcccaagctattgctcaccctgtcatggggctcccctgtgaggtggctgaccctggggaagggttcagcctgcaacggacttgagctacggtttctctgtgagtggaggcccagggccacagtggaggaaggaagaggtcaggtttgggaagaggtgcaggaagttcagttctgcaggtgccactcctctgaggcaagcgaggatctggcagctttagatgggaactaatggagagtacctgagatccagcccctggatcctacaacttgaggtttccatccccaagtctccctgatctctctggaccctcctcagacagccaacatttatctccagcaataaaagctatcacaactctcaggacgatacccgagagttgcattttcaaggcattagcatatctgttaattccagagaggcttgtcgccttcttggtagggcttttagtagttttataccctttagagagaagagaagagctaagcctagagactgtaagtgatttgcccagggtcccagtgttcttgggagtagaaagcatgccttatgtatctttgtgtggctcacaagtctcagaacagacagtgtcaggcccagaaggagctcagtccaagttcattgtattgaattggttctgtatgcactagattctgggtctctggactcctggtcactcacttgatgttgaaaatacccaaagtcaagtgtacccctagagatgagtttggctgtagactacagtggacacagggtggtgggataccccagctcctatcgtatgttttctcctaaccctgctacaaggaatctcaacttcttaaaacttgttctgttctctgagtgacgtcctcagactgacagcattggactctcctggcttgctggttagaaatgcagattccatgatgtggtcttgtcatagagacacaaggcccagtggtcactgagggatgtgctctctgcatgggcaagactgtgactatcttaataccctgctgggcctccccatgctgcctggtagagtaggctttccacaaataaatgtgttaaatgaatggaaaaagaaaaaaaaaaaaagaaatgcagattccagttagacctgtgagacctatggactgagaatctgtggcagaggtagtggaggtggtatcttgaatttgcatttaaacagacttcccccataatccttaggcagcagtgacctaggatattcgggggagaagtctctccagccagcaagaaaattgaggtctgagaggccctggccttgaggccttgaacaagagttggccctaccccctaccctgcactgtttggtgactgtggctaggttgccaggggaaccaggctgtgtaacttcctggctttggtggtttccccctccttggccttatctcagcatccgccacccagtccagggcctgtgctggtcacgtaggaggggaagctggtgccaggcgtgcagaggcgtgtctaggataccagggcaaggctggcccaaggacctggggcgggcaagatggtggagatgtggttttcaagaaggcagggaggctgcagatttgttaatgtctttctctttggtctaggagatatcgcactatgggaatgtggggaagggggttggtcagagcctggggctctgtctgtcattactctggcatttcaactcctcattcatggcctaattccccctccctgggagtaggggcaccaataatactgtggcctggcctgtgtccccttttctcctccttcctccctctgctctctagacttagggcctctagccgcaagcacccctcagtactcctcactaccaccctcaccctaacatctctgccccagctttattcacccctactcattctccttggttccaaattttttcctgttcttcagactctctcccctctctgtgccgcatgcacgggtctctcagaaggtagcaggaagccctgacagtcttcaagaatggaaaacagaaaaagttttgaagaaagagggaaggcaggaaatagttgaataaaataattaatgcatttaagtatttgtttatgttctaagccatactttgaagcagttttgagaattcaagtgttccaggaagaaggagaataatgaaaatagtgaaatagcctctcaggcctctatgcaacttggaggatttatgttctgattcctgatggtgtttatattacattaagaacaaataccccccaccccccctgccccaccatattcccatgctctgggggaaagaagtgcaaagaaaatagccagacactgtgcaaattgatttttccagcctggtcttatcttcatggtatctctctttggggctattaccctatctcacagattaagaaacaaggcccaggtggttcagcaagttacccaaggcctctcagctctaagtggctgagccagggttcaaaacctgctaatctgtctccacaattagtcaccacttctcttcttcactttgctcccccagggaacacaaatcagggagacttcttctaggatatcctagatggaattattgactaggaaccaggcctagaagaaatgatgctgtactgaggactgaatgggcattgcagaattcctttattgggggggtgggcacccctaatatgggagcagaggctatatagggcaatgcggacagttccaaaggaaggggggacccctatcctggagaattcccagtagttagcaaaggagttcagaggaaacatgagagaaatagaccaacattaacacaagttatatgcacttgcaaagactcttccacaggaatgtggaaaccccatatctcattccaactctatggtcctgctatccccatcccagtttctttgccttcttctttcacatccagcctcagcatctctgatccctgcactgggaggtgcagtttcctaaatgcggttcagagaaaggggacagggaagagaggaggggaaggcaggggacgggagggagggaaggggacgggaaggacagagcaagaatcagggaaccagtctcctttctcgttgttcttagacaggagacatgctcaagtaacaggctagacttttcattgtaaccatacggctgtgctggaccttgtctcccagactcctctcatttaaatatgcttattcatcagagggtcaaaattcctatccctcccacctccgccgtgcagggagaacctgggggccagcggggtgaccagcacccaggtccagtggctgtgaggtagaggtgccaggaccaagtccagcccaagattgctgggctctgctcctgcctcctccgcacccagctactgtcttggatctgagctcctggcccctggctgacaatcaggctttattctgagacttctctgggagtaggaagggtcagggagcccgaggtggggttagggttgggcagagaatctggacctactctctttctcaggcatctttagtctctaaacttttccccttgttctcagtccttggcttgctgggcagtgagaatgggttgaaaatgggatcaagaactaggaggagagtgaaatgagagcttgggggaaggaaagggactctaaagatgcacaaatagaaaagggggaaagaaaagctggaaaacaacagggaggagaagagtgagtggagcttggcctaggttgggaggtgagagtgaggacacccccgctcctcacccccagcagcaccagatatggctgcagttttgagccaagttttgctgagaaggggaaggttgcctccctacttatcagggtggaccttggttttgtgaggtatgaagcttatacaatttcgaaagctccatttgtgaaaaacaacaaaaaa

SEQ ID NO: 1481 - DNA, 1383 bp, Homo sapiens
gggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttga

SEQ ID NO: 1482 - protein, 219 aa, Homo sapiens
VSAPLSSPLERSPQPPPPIGMANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 1483 - DNA, 33805 bp, Mus musculus
  misc_feature (1)...(33805): n = A,T,C or G
tttctctccctcttctttgatgttccctggaccttgggtggtaagaagctgatataaattacccactgtatccagagttatttaaagccagtactttggccagttatgagtctctacattaactagctgctgcaaaaggaccaaagctgagagcagtacaagtctctaaacacaaatgtttagaacacagtttgacggcatgagcatttagcaaaacatcaatggtaggttccctcttcctagcccagaacctatgatttaaaccaccaaaggcttctgaacaggtttacagtacaaaaatccttcctgtggagaaggccctccatctcattaaagaagttggttacccccataaccttcatgccactattgaaccagaaggtgtatcttaccaaaatatcagtgttttagcatctaggggccagcactgggagggaccatggatatattttctccttgcatagcaccttctggcaccatgtaagttagctagcaggaagagagtgtcctggtgagttagaggtcggtttctctatgcccgatatccaaactgagtggtaccttcagcaatagggtctaatcatgttgttatgatgggttaccaagagcaattgtaatagcctgtgtgtttgaggttccaagagggcctccctaaccaaaaactcatatggggtatccatgtctggcactgagctgtttttgtggggtgatggtgtttctgtaatccagctgcctgctggaatgttgatggattttgttggcttagccttctctaagtgtccatagcttgcttctgcaagtatccgtagcttctgcaagtgtccgtagctgtggtgagcacatgagtgaagctgtgatgtcatctgtaaaaaaacagcttttcatagagcccctccccattctctatctcttacatcccttccacatcagcttccctgatgtttcctgagcctgtggagctgaaatagatgtcatatttagggataggcactcgagcatcattcattctcaccctttgactatgagtcattgcatcaactcctgcccacaactgaagaagcttctctgactaatgttggtgctatctgtgtacctctaggtatgttattctttgggatattatgtaagtggaatttgtttccttcctttctcttctagattgttcttcaatttttagtgtagacaaacacaagttagtttttgttggggttggttttttgtttgcttgctgtcttagttagggttttactgctgtgaacagacaccatgaccaaggtaagtcttataaaaaacaacatttaattggggctggcttacaggttcagaggttcagtccattatcatcaaagtaggtgcatggcagtatccaggcaggcatggcgcaggtagagctgagagttctatgtcttcatccaaaggctgctagtggaagactgacttccaggcaactagggtgaggatcttatgcacacacccacagtgacacacccattccaaccaggtcacatctattccaacaaggccacacctccagatggtgccactccctggtccaaggatatacaaaccatcacattccactccctggtccccatagacttgttcaaaaacatgagtctatgggggccatacttaaacatagcataatgcaaaatgcattttaggccaactttcaaagtcctcatagtctatagcagtctcaacaatgttaaaagtccaaagttcaaggtctcttctgagattcattcaacttaattaactgtaatccccaaagcaaggcaggaaaccagctgggcagactccaaactctgcatctccatggctgatgtcaaagcggtcttcagatctccactcctttttcatttttgttgactgcatcaaactgctttctcctgggctggttccactccctgttagcagctttcctcagcatgtatcccatggcgctggcatctttaacatctttgagtctccaaggcaatttcaatgctacagcttcttgtttcagtgtctgggattccacttgatcttttggaatcctcctaagggctggcatcacttttccagctctgccctctgtagcactctaagctcaggttgatccactccactacggctgctgttcttggtgatcatcccatggtactgacatctccaatacactggggtgttccactccaactaggcttcaccaatagcctctcataggctctcttcagggtgccaagcctcaaatcctttgcatgaccccttcagtcctgggccatcaactacagctgaggcttcatcttctccaatggccttccctggcctctcacagtgctaagcctcagcttctctccatgatcccttcatttcttcacaagcaataccacctgagtgactcttacacattaccaagtccagccacagcatgaggtacaaccttgggtatctctggaacacagcttctttgtgctcccagaaaacaatttccagaagatttcacctcagtgatgctggtcttttcttaatcactgctaattccttagctccagctaaccagcatcaatttttccagtagttccttccattcttaactctagagccagagccacatggctgaagctgctgagttctgctgcttacaggaactagaacatgatccccttgttctattacattatcactagctttatgttttctaaatccttcactgcctaagcttggctatcctggttcttgctctgtagattgaccttgaattcagagatcagcatgactgtctcatgggattaaaggtgtgtaccaccatgcctggatataattttaactgggtaggatcttgccccaaagtcccactcccttaatctgttatctcctagaacacaggattttgcttcatttcacttcctggtatgcctttaatacttgaaccatatattttatattttgcctttctaagcttgctatgcttgttcaaacttctctttgtgagacttaaccagagaacagagtctctgctgggcttttttgaaacttcctttgtcaatgcagttaattcaattaatccaagtctcttcaccttagcctcaggcagacttttcagacaagggcaaaaagtaaccacattcttcaccaaaataccacaaaaacagtctttatgctacatactgaaattcttctcttttgaaatatacttgggccaggtcaacacagttcaaattactcccagcaacaaagtcttccatatacctactaggatgaccaattaagccccatttaaagcattccactgagttccaaatccaaagtcccaaaagccacattctttcaaataaaagcatggtcaggtctaacacagcaataccccactcctggtaccaacttctgtcttagttagggttttactgctgtgaacagacaccatgaccaaggtaagtcttataaaaaacaacatttaattggggctggcttacaggttcagaggttcagtccattatcatcaaggtaggtgcatggcagtatccaggcaggcatggcgcaggtagagctgagagttctatgtcttcatccaaaggctgctagtggaagactgacttccaggcaactagggtgaggatcttatgcacacacccacagtgacacacccattccaaccaggtcacatctattccaacaaggtcacacctccagatggtgccactccctggtccaaggatatacaaacaatcacacttggtgagacagagtttctctacataaccctggctctcctggaactatgtagaccaggctagccttgaactcacagagatgcacttgcctttgcctcccaagtgctggggttgaaggcatgagccaccacacccagccaaactagttttttttgttttggtttgggtttttttttttttcgtatgtgtgtaactgggtgacctgcaactttgttgaattcacttattaattctgtcggctttggtggattctttaggaagttctgttaatatgaccatagcatctatgagaaggaactgctttatttatttgtttattacaattgatatggctttcatttctttttcttacctagttgctctggctgaaacttccagaataacactgagtagatgcggtgggcatgggtatcatcttctcccaactttaactgaaagctgtcagtcttgcatattgtcttagttagggtttctgttgctgtgaggaaacaccatgactaaaaaacaggccagggaggaaagtttattgggcttacacttccatatcactgttaatcatcaaaggaagtcaggacaggagctcaaacacaactggaacctagaggcaggagctgatacagaggccatggaggtgtgctgcctactggcttgctcagtttgcttttttatagaacccaggaccaccagcccagtaatggcacaaccaacaataggctagcccttccctcatcaatcactaattaagaaaatgccctacaagtctgcctatacccctctcttatagaggcgttttctcaattgaggcttttttttttctcagatgacttcagcttatgttaagttgacataaaattatccaccacacatattaagtagaatgttagctgcaagttttcataaatgccttctgtcaggctaaagatgttaccttccattgttagagtctcaaagagtgttgggttttctcaaatgccttttctatatcaaatgagataatgtgtcttttttcttcatttagttaatatccatgtattatcatgttaatatcaattgtttttcatgtttaactactctgacatttctgagataagttttacttaatcatgatgtataacctcatagtatgcagtttggttctgtttgttggcgctttgttaagacttttcccacaaacactcagtttagcagaagttctgaacctatgggtcatgactattgaaaactacatatttctgatgctcttaagaacctgagaccataaatctatgttcattgctatttcctaactctaattttgctactgagaagtgtctcagttcctaaggccttcagatatacgtgtttttcaatagttgtgagaagagccaagaatatcttccttccggacctgtcagaccaattcatcttgtaactttgagatcaagccatatgaggtgtctagatctctcccttcacctataactctctagcagaaaagacccacctccactcaaaactgacctcacttgtgctcctgaaccctactctggcttcctcctcagaaacagctctatgtttttaacattcctttcccaccatacctttaaagcccttctccgtgcactgctccccctttctgtaaatttactaagatcccttgccatcctaatgacctcctctcctccatcccacctccccctaaaagatcttctctgggtttctcttcctttctctgtcaaatcgcttgataaatcagcccccactttctttctgaactaattgtctgggaagttaaacagtccactgtgtcccctttggctatgaacatacacaagccagccatctaagttagaaacatcccggttttggtttcttctgacttgtcattcttttttagagccaacctatgcctacctatgccttatccttcctagaacactgtttccatatacttctctacttttccacagtactgtacatttgccatttatatcttacaaagtcaatccacactgctcaagtgaccctttaagattttctacattctgatctcagtctgcatagctttcattattagtgtgtgtatggttgtggttttgagacaaggtcttatatgtagcccaggctagcctcacattggcaatcttctgcattagactctttatgtattactaggcttggattattggtttattcaaaaagtttaactttatcctataatttacttagttctgtgctaattgaatgggtaaaaacctagaaaacatagctctcatgccatattctcggtccaccttcatatgcctgcttctggtgtggatctggggaacacatgcgttgtatgtataaacaggatagttctgatttgctgattctctatctgatggagaagcctgaagcagcttctacagaaataaaaagctaaaccagaactcatgttttcagagacatgtcgtccattgagtggaaaataaaaagtataagtacaatattccctgatttgatatcaccagagaatatcagcaccttctccatagtccaagtggtccatagagtcccaaatgggacataccccttcccaacaccaagtaccctgccacagccagagccaccataaagcatctttccaactcctactcttctatgctggctctactcttccacatttactgccagcagagcaatttgatgtcccagaacatcggtatccaagccaaaggtgttggcccagtgtgattaaaagcatcagtacccaaaccaggaaaaaatttccgtgtttcctctgggccaagccatatatcacctggtggtttcctgagcatgcgcagtaacttctgatattcatgcaccatcagcatgttggttcaaatctggttttgtcattactttgttttatacctgcagagaattgctactcccttatgttctttatgtccatgtacctctctgtcctaacacaggctcccttctccttcccctgcaccagtgaaaatttccacaaatacaagcaaaggcaaatcagtatttcaatggtccttcaaagataagtaacagcttaccatgtgaaaatgaaggggaggagcttttcagacagaagtgacagcaatgcaaaggaagcaggatcatctaggaaatttaccaatcactgagcaatgggaaagtccctgttgctatgcagactcttcctataacattgcatcttgcggcttgctcatggataactgtccctggcccatcattcactatagatgcctccatagaacacatacatccctccatccactcattatctattgacttgaaactgtgctgagccataatagtacatgggaaaagcatcctgcctgctctcgtttagcaagaaaaggaggagatgctgtcagaatgatagtcaaggagaagagcacaaaacataggcagtacaatagtggtcctaggaaaatgcagaggcagacctaatcccaagccagtgccccacccaccacaccatagctactcattcacctgtcaggcttctccatcagatagggaaccagcaagtcagaactatcctgttcatacatacaacgtatgtgttccccagagccacaccagaagcaggttttcacccattcaattagcacagagctaagtaaataataagatacatttaaactttttgaataagctaataatttaagcctagtaatacataaagagtctaatgcagaagattgccaatgtgaggctagcctgggctacatataagaccttgtctcaagaccacaaccatacacacaataataattttgatctataaaattaagagaattggaaggaatatgctagccggtgttgcaagcattcctggtgagtcctgtgaccactgagaaaatacgcccagtgtctttattcagagaaggtgaactttaacatcctggatagagactttctgagagggggactagggatgtgcctaatcactcaccatgaaataatctgaggctcatcttgtgccaggcacttctcaaagatgttccaggatgtcccttccctatgtgatgcttacacttctagtaaagaggacaaaacaaaaagcaaaagcagaacaaaacaacaacaagccctcacacattcttaaagtatagtgattgacatagaggaaaataaatccaactgagagtgggtcacaagaatgggtaggagggttggtagtgaggaaagcgtggtctcagaagacatcgttgaaagaaacatttgcattgaagacattatggaggcaaaggtgttggtcacatgattgcctggaagaagtacatgccagggatgtattaatgcagagacagctcaagaaacccctgagttggagcaaactgaataggaagtcagtcacaggagttgtgctggaagagggagctggccaaatcatctttgtccattataggtcaatataatgattttttaggtttgattttgctgttatttttattaaatgcaaagagaagccataaattctgagttattagctcaatgaattctgtgtattcacacagaaagatgaaagcaaagaacactcttctcagcaccttaaattccccttagagcgtctcttactcactgccccttcttccttcccaaaggtaaccttcctcctgatttctgacagtacagatttgtcttgcttgattttaattttaagtaaatggaaaactacttggggcaccttttggactcaagattttgctagttatattttactcacatgactttgagaggaaagagggggcaaaatggcaaatagccacgtgtcaaaaggctgatgggaaaaggggatgtttgacggcaacactgacgtgcctggtagccatatggcaattcaggaaagagagcagaagtgcaggctcatgaaagagctgagtgagtgtcaggaggcctgagacaccagctctgggccaccccataactacacacacagctgcaactcttccttggaaaacaagagactccaagaaagctgaagtcacaatcatggctcactgatagtcaaacatctccacagatcataacatgtgtgaaacactgcagagtactaagtggtaagtgctgggtatacaagaatgaccacagggtggtcagttaaacaagcaaacagagccctagatagcagagtaatgtgtgctaagagcttagcgttgacgttaaaggagcgtcctctttaagagttgtaacaatgatggtacccccagtaaacttcctaatgaattcttatgattgttatcaggctttactgggattaggctaaagttgttagtacacttataaaaggctgctataaaaataaataaataaataaataaatcaaaggctgctatggtaacactaaacctaagcggtctcttttccaaaataaaaaataaaaaataaaaataaataaaaaaagagttgtaacaatggggctggagagattcctcaacagctaagagcctgggttgctctctcacaggacttaggtttgattccagcaccaacacagcaactcacatctgtcttactctaactccagttccagggaatccagctcccttttctggcctatggaggtaccaagcaagcatgtcgtacaatgacatccatgcaagcaaaacacctatacacacttctttttaaagcctgagtttgaatcctggctctgctagttttaaaatgtacaaccaaggaaagttggttaatctctctgtatctcagtctcttcatccataaactgatattgttttgatctgtctcacagactgttatccccatcaaatgaaataacgcatgcgaagaactgcatatgcagtaaacccctgttactggctctctgtgctgcataatcatggtgcatggcacatagacagacattaagttcattgtaaatgactagctgtgacagtactaccatcagcaaagccttgcaattgttggagtttgtgccaaaggggtcaatatagttcattatccctcacagattgttgccaaaagatttcaaaggctgaggtcacaaaagtatgaccagccagggaagaaggagaccataagttaggatcatctaactagatcaactgcccattagccaagtctgccagatactttgcttgaggtagagccactaggagtgtaattgtctactgcaacatttccgaacactcctccccacttcttccttcatcacatctctggccttcttccaaagagcttaaacagactggcagaattaagagaaaggaactaggaacagaagggggttatcagaaacagctctttagccctctccttctgtgtttacagggagtgaagtttcacagagcagctcagacccccagctaatgaatggcgttctaggagagtctgcagttcttcctctaaagcttcctgcagggaagatagccaatatcatcatctggaattatgaatgggaagcgtcacaagtcactgccctcgttatcaacctaagtaatcctgaaagtccacaaatcatgaacactgatgtaaagaagagactgaacatcacccagtcctactccctgcaaatcagcaaccttaccatggcagacacaggatcatacactgcgcagataaccacaaaggactctgaagtgatcaccttcaaatatattctgagggtctttggtgagtccaaatacgtcatttaatcatgtacaaactttaaaaaaaaaaaactgtgtgtgcctacgagagtgcacagtagcctagtgctaaagatgatagcatttggcatcattaatgaagtccagaagtaaagcattttcataacattgcacagctaaatagcaacagagctgagttaaaaactaaatcttgtggctctctctacaccaatcacctcactttccctttcaacaagaaatgtacagttagtgcaagcaaaatgcttaatataacaccattaacatgcacaattaggtatctgtcacacactctgctcttgcgaggtgggtatgcagaatccgatgctcagagaatatccttagtcatggtctcagagatggtaaatggtagcacctcccatgtaactgacctatctcactttacacagacatccagctgacttatcagaggtgttgccttagaaagtactctgcacaggtgagccaattaacagaaaaaaactaatagaaaacttaatataaaaccttttctatcaaggttacttaatttctaatggtattttctccagatgttttatgttgagccttaatcaaaaaaactgtctttctaactggagggatggtacacatctataataagcctaatatttgggaagttgaggcaggaggatcaagagtgtgaggccagctttggctacattgacagactgtctcaaatacattggtctacctccctaatattaaagaatgaaagtgttttcaacttaaaagtatagaaacaataatgagatactgtcttaatctaaaccatgaaaaatgtagctaccagagatgctcagcaatgccatggactattttacagtagacccaagcattagattggctacctaagggcagtgagatggcccagtaggtaaaggtgcgtggtaccatgcctgatgagctgaatttgatttccagggcccaggtggaaggagagaactgacttccacaagttgtcctctgcttccatacgcataccatggcacttatgcacacgtgcacgtgcgcgtgcaggcacacacacacacacacacacacacattataccataccagagagagagagagagagagaggtaaatggttaaattaactatatgttagctggtcatgaaggttcacagctttaatctcagcactttgaaaacagaggcaggtggatttctgtaagttcaagaccagatataatctacatagtgagtcctgggagagctggggttttgcatagagacactgtctcaaataaataaataaataaataaataaataaataaataaacttacaatatgccgtgagtgctaaggaagaggcatggagcaacagggtgacaagggacagggcaggaaacttggtgctacagaacaaaactaggccctgagcaagctgcacaagtgctctatcactgaatgtacaccaagcccaaggaattgttttatagagaaagcgatcagcacaggcctctattgaaaacataacatgtgaggtaagctctgttggtgttaagagaataaaccatgcagatatctgggagaagagccactcagaacaggtagcaaagtctgcattcaaagagcatcctgcaagaaggctgaacatcaattctccagattcatgtaaaaatctgcgaatggtgacaagcatctgtgatcctagctgtggggaagaagagacagaaaccccctctggagcttgttgaccaatgggtaagttcagtgagagaccctgtcccaaagaataaggtaaggagtaatagaggaagacaccctgcaccaacctctgacctcacatgcatgtgagcgtgtgcctataccctcatgcacacatactaccatatacacacataaacccatcaaacggaaagacggcatggtgagggatgttttttcacaggttgatcggcaaagccatgtgtccttaactgaggtcttttctctttatgtagaacgattgggtaacttagaaactaccaactatactctcctgctagagaatgggacctgccagatacacctggcctgtgttttgaagaatcaaagtcaaactgtctcagttgagtggcaagccacaggaaacatctctttaggaggaccaaatgtcactatcttttgggacccgaggaattctggtgaccagacttacgtctgcagagccaagaatgctgtcagcaatttgtcagtctctgtttcgacccagagtctctgcaaaggtaatgtgggaactaaaaacggggggccctgggcaagagagggaggaaagaaccacatcctgccagagttccacctatgctctggacaggcagatgtgggagggctgccagatgctttccactcagccccaggtgggcatccaagcctctgacccactcgacagggggtgaacaaggggcagcccaacctgggagccctggggctactccctaaagccctggggttatgggagagagggatgagggaagagaggttcccacaccggtgagagtgagcggatcttgatgagaagagactctctatggttttagagctttattttagaaaggcagggagaaagagagaagggagagagagagagagagagagagagaaagagagagagagagcaaaatctagagagaaagagagtaagagtaagagggagagaagaaaggagagaagagaggacaaagaggagagaggagtgagagaagtgagaggtaagagaacaaaggaataagagaggaatgagagaggtgacaaagagaagacaaagagaggagtgagagggtgagagtgaggagtaagagatctaggtggggccaagcagcctctcttatggtctttactgttgctaggtaactggggaggagtttagcctgaaggtcagaagcttgggacattgccaacgtgacttctagccatgcttctcttgtgggggctgtggggggggtggtaactttggcaggagccagagttccaggagcatgagggaacgcctaccgtgtcatgtaggtgaattatcacccttccggggttcagacctcagctcgactggagaccagcctgcctgtgcatagcccaatgccccacaaggtaacatctgccttgggtcttcctgggaccctcaagcagctgggtagtattatagtgtggattcacaagactgcctgaacagtggcagttggagcagccagactgctgctgagaggaacgaacagggaggctctagaactctctgcctctattaatcttctttccctccccaagtcctcgtgcaagagcaagacctcaggagtcaaaatggctctctcctacctcagccaggccatacctctcctgcatctcagaaagcctgacagatccccagactgcgagtagaaatggccatactcagcctctatagacagcccagaaggactgaagaaatccttctgagacaaactcaaaggatccctcattttatgtatcctaggaagttccacttcctttttatttaattcttcttttcaggggttctaactaatccaccctggaatgcagtatggtttatgactacaatttcaataatcagtgcagtcatactcatctttgtgtgctggagcatacatgtttggaagagaagaggtaagttccccttctgctttcttctatctgctgtaagattgcagctgtttagagtctggggcctctggttgccaggggtcaagggaggatggacacaacttctggctgaattagtccactgggatgatgcccagcatgtgaccaggtttctgttaatacataagggaggtgtcctactgagaagagcagtacccggcctcgggatccacttgctcacttgcccttcatttgggttccgttgcctgcatcctttggaaagatgcctggtggagaaggatggaggaaatattctctcaccgaactcatgtgttccaccttcctgctttcatttcccaggttctcttcctttgactagccaacatccaggtgagcatgcagcctctaactacaaagcgtaaagcagacaggaagaggtaaataaaagagaagaggggctggccagagggataaagagtgagcattactattcatctggaccctgtggtgtcagaaagactagctggtaaccacgagacctacagcattcctcccaagtatgtgaggggcatcacactcttctagagcaaggtcaagatcactaacttcctttctgatggagaacacaagtcccggtgaaaagggtccatgaaccacacatgcactgtcacttggagcataaaacactcaaaactaggctctgtgactccgccactgagactcaaccaaagttgagacattggatagatgtgtgagaaagagatgtagatgcaggttcgttttctgagtctcgtcccatgggtgatagtttcaagataccattgttgaagagagggcatgaggtcagggatcagaagacctgcattctcactcctgtcccctcttcctaagcgactctgtacaagtccactaagcacccttgagcccgaaattcctcatctctaaaattgtcaaatctgtcagacggggctgtgaaaactgtctccagagatctcgcagactgtggtatttagtccttcaagtgtgttgacatgagggaatcactgagactctgaatcataagaataccacccacaccctcacccaagaagtgaggttagaaatagaccatacgatagttcttgttcagcactgaactcaaaagattgggaggtggagagagagtccttaaaggggggtcagtcttgaaacaactgctttgcagggggtgttctagaggccagcaagacacaagatcctgtgcatattcaccccagagtcctaccactgacagctgtaccttttgtgtgtgtgtgttaaccatacagagtcctcccagagcacagatggcccaggctctccagggaacactgtgtatgcacaagtcactcgtccaatgcaggtaagtcctctcagctctgttctccactgttgctgttgttaccgtgacccccccccccacaagcacatcaccataatcgtcagccttctttattggagaaggcaaccacagagttgacacccagtgtctgccctgatggcctctaagataatgcttcccctcgctcgcttcccagtgttctctgtctgcttaacccatcaggcagtctttgtgcttcagggttactataacctgcttgaaaaatacaagttagagactctccttttcccttgctacatttgactagatcaaaggagatcataagctgggagggggtgtcatccaggaagtagagttcatgagaacttagagtagtgtctcaagagagaagggggccaagtatcacaagccttaaacaataaagggaacgagctacagctatggaagagaactctcacatagtaggatggccttggtcacgtgccagggtccccaatgagaccattgtgggggcacttttctaaaataagtagatagactggggagccaattctcaagtcttctaaaagaaaaaaaaaaaaaagcctaaagaacttggcattcttttttttttttcttattggatattttctttatttacatttcaagggttattccctttcctggtttcccctcagaaaaaacaccctcccaccttccccctgctcaccaactcacccactcccacttcctggccctggcattcccccacactgggacatagagccttcacaggacaaagggtctctcctggcagtcttgaaataatggaagtgaagcaacggcccagctaaaaggcttggattcctcaagcaaacacctttctccccagctgacgcaggctttgtggggcaaactcctaaaggagaagactgtgaggggcagtcacgctttttgcccatttactgttcccaactcctggtgggagcatgctcaccaacaacccaaagcagggatcatcagcccatatggcagctaagtagctaaatgtatgtagagatccacctaggacctgggggtttctgttgttactactgctttgtgcatcagagaaccattcactttgggttttctttccttttgttcattaatttacttatttgcattcatttcatttcttttacatcccaatcacagcttccccttcctcctctccccctagccccaccccctcacgcccccgattctcctccccttctgtcagaaaagggggtcctcccatggatatcgacccaccttggcatatcaggttgcagtaggactaggcacatcttttcctgttgtggccagacaaggcagcccagttaggggaaagggatccaaaggcaggcaacagagccagccaatgctcctgctgttcggggtcctatacatctgttacatatgtgtttggggcccaggtcctaaacgcatgctctctggttggtggttcttaaaaccggtagttcctatacttctggttccccactacaccatggtgactagaccattagaataacagggataaatgggagcaggcaaagtaggtggctccagttataactagtaaagactaagacaaaagatctgatgcaataaccatctagcatgtaagcttttatgtatgcttaaaggagcaagcatggaatcagatgcaagacaagaatgcttttatccctccacactactctgcccttcggttgttctctggctgggcctttacattgctgggacattgatattctatttaggttgtttttctgtttcttggagaatgttgctaaaacatcacaggtttgaactggtagagcttggtcctaggctcctcttggcatgacgcttcttccttccttgcttcttcctgtctttctctctttcttcctttctttctctctttcttcctttctttctttctttcttgctttcttcctgtctttctttctctcttcttgtttttttttcttgtcatactacctttccccaaaatacttgcatgcacagacctctttgtttctgtgtgagccaaatgagtattattcttttgtttgtttgtttgtttacaggaaatgaaaatcccaaaacctatcaaaaatgactccatgacaatttactccatagttaatcattccagagaggtaaatccatgactgctttgttttcttgtattgtgtatgcctgcatatatgtgtgtaatgtatgtgtgtggtttgtgctcatgtgtgtgtgaataggaataataccatccagtgccctgttccaccattccgtctgactcccacaaaacagtgcctctcactgaacccaaagctaaccctgtgtccagaaagctaaaaagtcctccttctttgggcccctggagtgttggcattacagagctaggaaagctttttacatggggactggggatttgaactcgaatcctcatgctttctcagtaggcactcttatctactgaaccatcttgccagccactatcttcttgtatttttgttcctctcccaaacttattatcttgcaaataaaataaaaggtccattttacagatatctaaataccactagaaaaaagaaagtcttagaacattaccaaaatataaaaagatatcttgaggctggtgagatgactcagtgggtaaacggcagctttcaacaagcctgataacctgagttcaatccccaggacccgcagtgtaggagaaaacaagctcccacaagttgttccctgggcagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggctgtagagagagcacggtgttttggttaaatgtgtagtatctggcattggatggaccacactcatgccctgacaaatcatttacttagacaggccccctgggatatttcctatgttcttggacctttaatctcacagccaataagaggaggatagcgatgcattgcttccattgctcacaccaggaatctaagccatccatgactacagtttatccccaaacacttcagactctacctccaatatatattaaacagatctctctcttttcaacttgtagaccatcatcctatctccatttctcccatctggaacctgaggtactccaattatctctaaacatctcttctaattttgctcttgtctctgcattacccatggtctaaaagacaaccagcacaatgtccttagtatagtcccactcttcctattgactgcctgtacccttgcaaactcctcatcacagccagtgtgaaagccagagttcctggctcaggatggtctgccacatccccagactctgctagtttcactctccccattctctgtttgatctctgtgaccttttagctcctctatcagagaagaaatttctccatagtatagtcacttacatctgccccaaagctcttcttctgcctgttgggttcctcctgtactttagacctcaacttaaatacatcatcttctataaaagaccttcccagtgcagtctacctaaagagggattccttattagtctctttaacttccatgttgtttatcacatgatattgaatatttatttttaatatctgtttcccttattagaggataaatctgtgggatcagagacaataactattttattgctgtaatcattaatatgtagaacattgtaagtgttcaaacaatacctttagtaaataaatgtatacatgatggattggtgtgggaattaaatgaaacaatatgattggctctgcaactgtaggtctacttctgtgtattctataactgcaaactgaaatatttgacaaagaattgtatctatactaagtatatacatacttttttcttattattcccctgagatagacataggttctatagtacccacctccattttatatgaggaattggcatctagggatagcctagaaccatcttccaggaacaccaagggatgactataaacctgaaccctttagcctagtgcctaacacattaagagagccaaagacatgcatgcacaactactagttttgcctggtgctttgtgtcaaggcactcttagaatcctaacgcttgggagatagagtcaggaagagtcaatgttgtcctcagttatacagaaagttcaaggccaacctaggttgcataaaaccttgtctcaaaaaaaaatcttattgccaacgttgttattatcattattaaaatttattctcctgaatcacagaatcttcataaattcctttaacagctaagagtcctaagttcaaggctagcctgggttacataggaagttctgtgatagtcttagctacacaagaagactgtcacaaaaagtaagataaaaggctggagagatggcttagtggttaaaagcactgactgctcttccagaggtcctgagttcaattcccaacaatcacatggtggcttacaaccatctgcaatggaatctgatggcctcttctggtctctgaagagagcaacagtgtgctcacatacataaaataaataatttttttaagtaagataaaataaatgagaagagagaacgtccactacttgaccacattcatgccatttcttgccttgtctcaagtttcaaatccgattagtttaccccatgtgaaatgcatgctcccctgtcctaaggaacatttttggagggagaagaaggattgctgctatttcttttagtatgttttattcttctcaaaaaatagcacatgtgcttatttagaataattcacacactccaaaacaaaacacctctacaatagccaagataactaccattaataatcctatatgaaaatagcactggtttttaccaatataaaatcttttcataactttttcttggctttaatttgtttttgtttttattttcatttgttttaacttgttttgtttttgcttaacaatatcccttaaataactttctgaagtttggatgtataatcctactgatcatctttgctccttttgggtttcaattttatctatacgaatagttgaaaatcaagcaacactttgaaatgtgtgtatatcagaggcagcccatatcaaaaaacagaacccaagatgccaagaagcaaggatagtggcatcgcaatagaaaagatctaaagcaatggctgtgaacaacagaaggagaaaacaaaattcaccaaagttagttaggtcttttttattttggttgttagatcattggagaccgaatcttctgaggcccggaaaagccttaagctcactgtatatggactcctgatcctcctgcctccacctgcccagtgctaacattataaattcatgttgaatcctggctactaatgacattgtcagctaacaaactaggataaatagagaaaagttcatcaggaagaaaggggggcttaagaaatagtcgtggagtcttcaaagaagggaaaaggaagaattcctataaggccttacaaggtgccctaaagcttagaggaagactcattggacagataggaaggtaccctcctttatttttgacatttatgtgtgtgcatgtgtacttatgggacacgtggagtcagaggatctcttagagtttctatttctgtgacaaaacaacatgaccaaaaagcaagttggggagaaaagggtttatttggcttacactttcatatcattgttcatgactgaagggagtcaggacaggaactcaaaggggcaggaaccttgaagcaggagctgttgtagaggtcgggccatggaggggtgctgcttactggcttgttctttatggcctgctcagcctgctttctaatagaacccaggaccaccagcccagggatgcacaacccacaatagtcctaccctgttgtggatttggtttattgcttatattatgttaattgggtccccaaattatacggaaatttgccatctgcatgtaagacacccagggtccctgcccccagttggttctaatagttaaataaagttgccagtggtcaatggttgggcagggagacagaggcgggactttacatttcctgggcaagggaacccagggaagaaaaaggatttagaatcgccatgctgatcaagcttgagagctgcgggagaggaagcatacagccatggaagagtgagagctgtgggacaggaagcatacagccatggaagagttggggaagagcagccccagcggtgcctcccccactgggtctggggtaacaaagatggagtatagattttagtaagtaatcattcatgagtatcagagggtaggagttagtaacatgaaaattagggagtggcccaaccactgatttacgtagagcatattaaaaataaggctgtgtgtgtttgtctttcattaaaaaatccagagcatcttgtcaggtggcaagcattgagcaccaatttgagtagtgttcacaattaatacagcagatggtgtccaacctgtaggctcgcactcactaaaaaactaattggaaatgctcaaagggagaacacacaccatggcatgagattaggaggtggaagaattggcttcttagcacagctgctggttcttccccaagcccaaaattgggtttggaactagaacaaagggaatgctaattggagcgcataattttgggttttgtagtttaaggatgagacacacccaggctgacccagacaaagctgggtggcagggatttaccagattaacacaatacgcccccatcaatctctggtgagaaaacgccttacaggctggcctaaaaccctatttttttttaactgaggttcctttctctcagatgacttcagcttgtgtcaggtcaacatacaaatgtccagaacaaaggacagctctaggagttgcttctctcttccttctgccatgtggatcctagggattgaactcacgttgccaggattggctgcaagtgctttaacctgctagccttcccacccagcccctgaactggcttcatttatcaagattattaataataataacaataataataataataataataataataaaaaagacatcccagatagaaaaaaatctataaagtcagggaagatagagaaatattttccactgtttgaatgttcaagtcagcaatagacatagccctgtgtcttggaaaggacattctatccatttagaacaggaaattaaccaaacgctaccccaagcctaaactgcaccgatgtctagactgtactctggcaaggatcacacctgaaacaaaaattagttccaaaaaaaaaaaaaaaaaaaaaaaaaaaaaaaaaaaacctgtgagaaaaaccaagttttatgttttccagtggaccacgtaataaaacgagacttcctgattccagcatttcctcccttcttacaagcctctgcccacttatcgatgccacagtctagactccacaatgctgcacttccccggcgttcctccttcctttccagctctttctcagcctcctcactgagatgcctcttctgcctcttcagttgcaggactcacaaagacaatttggactgggtctcagactcagaggttcccttcatctccatcttcctgtccttttctaatgtgacctttcccaacatcttagcaccaccttatatgctaatgggtcacaaactcatgtcttcgtccctggcctcccagcttagatcaactgtcttcttgacatctccacttacagatctagtaataggcatcaaagtatttcttaatcaaaactcttgatttttgtgtctccaactcttttcttctgttcatcttcagatcagtcaatgatacctgattaggtctcctttctaggcctgaagatcacacagaacttggaatataagtcatcattttcttttcttgtaggaaacagtggctttaaccggctataaccaacccattaccctgaaggttaacactttaatcaactataactcctgaaggtaaatgttttaagacccaggtgccctactctcaaaacacaaagcatgcatattgcaaacagcaaagaaaatctcgttggtcacaaagagcctatgaaaaataatatttttagcccttcttgaacagctattggcagttaaggtcacatggggggaagggaagtcctactccttagaaattctcaacctctgctcatgcggataaccttaattaaatatagtgaattgcacacgaatacacacataggcatgtgcacacacacacacacacacacacacacacacacacactggctatgcccccagtatacaggacgtgccagctcctgtccccacaatactcacatcccgcaccctctcctttcctccttattcctcattgctttctcttccctccttgttccctggctcctagagaagtaggcagatgctatgcaattgttagtgagcaaaaggatgactgtgcacactgtacttcgggttcccaaacccacaaatacaccatccatcttcttttaaggcagtgaaggacaaacgccacctcagtgagaagattaatttactcttaaattaccctcgtctactcggtatgcaaaagtgaatgctctttttcttttccccctaggaagagcactgcagtgacttgaggaaattaaacaatgctgtcaccacagctctggcttagattaatgaagtcagcatctctggagattgagcgctgccatttgcattgttcaaacgctttctaggtggtatggtgagatgccagagggctaagggccattatagcagggtagtttgactaggaatacataagatagaaagcctagaatcgtatcattgaaagggacaatggacctaagagaagtggaataaaattgtgtcacgctgtgtggttctgtgatttctttagattgagggttgaaggggcctccaagttggcacggacacacccagacaccaaattctcagcacaaaagagatatattacccttaaggaacaagcagattggctgggggttggggaaaatgcctctgaacgggacaaagacagcagcaggtgtttttgcagaagtggtgggttttttttttttttttggtttggttttggttttttggtttgtttttaggagaaagggtgtagggaattctatgctagagtaagttgctaagtccttacagatgaatgcaggacagagcacaggaagccccaccccagggtcacaggataggcctttcatcttgggtttcaaggtaaaaagtggaatgggctgaaaggagctttctctaatatgaataaagtaaatgtgacctctgcccttcctcttccctgaggctagctgaagatgctctctctggaaagggaggagagcgcgccattgtcatgttctaactaacacgccattgacatgttctaactaacagatcactggaatgagtgacaacggccaatgctttcttgtcccttactcctagcctgcagacccctctgaagttgaactcttcagatatctctgcagctcttaaatgacaaaaccccacagtattagctttttctcctaggtttcatttaatcacatctatttttttatggccttctgccttctccttacctttccccagctagtcttcctttacaattccagacttgtttccctaggttcagctgacaagctccttcctgcttagttcattatcaccctaaattctgtttttctctctcctctgttcatttctatgtacaaatatgaaggactctctcttggtttttgagacggggtctcactacgtagctctggatttttagaactcacaatgtgaccaggttagtctcaaactcacagagtatgcctgtctctgcctcctgtgtgctgagactaaaggcatgagctgccacacctggccaatgattaagagtcttgataaaatagtcaaagacaaatgcctgtgtcaaaacccattccgggatcctacaacaatccaaaccacaaggtgaattcaaagaaaataattggaacacgtgatttcttgaggtagagattttcaggaaagaaaggatacaaaaaagaattctgcctatattataaagcaaaatgtgcaatttgataggacatagacaaaaggatttgtgcatatcagtggatttcactgtgacagttccatgaatgtgttagcgatcaggcatttccaccagcctgcccttgggaacatcgtagcgcagcgtacatcattacccacagccaagtttgacaagtgcaacagatatggtgtgtgaaagcaccctcccctccagatctctctctgggtccttatctgtatttttctcttcctcccattccctcattgtctcattcattctatctaattccctgtcttgttctttctctctctctgcccgtttgtctccataaacctcttacactacatatgttgcatggcatactttcttagcagctcaccttgacatggccatcaaaggtaccctcacactcaccatactatcctaacagtataaatatatcaggttttggtcatattcaagtattccctttccctggtcttttccttaccctccctaaattgtccctctactactacgtttaagagtattatctttttatctttttcttatctttataaaacataaatgacctaggtataataatatatacctgtaatctcaacacttgggaaacaaagtcaagaagatcagaaactcaaggccaaccttggttatgtaataagtccaaaccttgcctagattacaggactggtgatgtgtaagactcacccaggtggtactggctttgaaggcatgaaggggtcatgaagagtagctgaagcttggcactgtgagaggccaggaaaggccattgatgaaagtatagcctcagttgcagttgatggcccagtactgaaggggtaatgcaaagaagctgagccttggcaccataaagagaacctatgagaaactatttgtgaaacctagttgcagtagaagactccagagaattggagatgccagaaccgtggaatgatcagcagcagtggagtggagtcaaccagaacctagagtgctacagagggcagagctggagaagtggcacacgtcctttggaggagcccagaaaatcatgtgtagatctcagacactggaacaagaagctgtaacacagaagatgccttggataccacaatgttagagatatcagagccatgggatatctgccaaggaaagttgctaacagggagtggaaccagctcaagagaatgaagtttgttactgctgaatgccagatctgccaacaacaatcaacaaggatgaaaggagctagagttctgaagaccaccttggcattaaacatggaaacatagagtttggagtttgaccagctggtttttggtctggctttggtccagtaattcctctctgagatgttttggaattgggaatgtatatcctgtgccatgatgtgttggaagtgtgggatctgcttttttattttgattttataagggattacagttaagagattgcatgaattccaagagagactttgaacttcggcttttaaacattgatgagactattattatagactatggactaagtgaagttggactaaatgtattatacattgtgctatggctaggtatgactcccttagactcgtgtgtttaaacaagcctatggggaccagggaatagaatgtggtggtttgaatatgcttggcccatagggagtgagactattaggtgtggattttttgtaggaaatgcgtcactgtgtgactcctatgctcaggctctaccccttgtggaaaagagcttcctcctagatgcctgagaacaccagcctcttctggctggttgcctttgaatcaagatgtagaactctcagctccttctctagcaccatgtctgcctgcatgctgctatgcttcccgctatgataataatggacgaaacctctgaaaattgtaagccagccccaattaaatgtttgtctttgtaagagttgccttagtcatagtgtctcttcatagcaatagaaacactaagacaactagtacacaatacctctaaataggtaaacaaaaataaacagataatcgcccctatgataagtcctttgaatacttcagtgatgctaataacatctttgtaggttatattacttcaaggcattcatgcttgctgctcttgttttatggctagctttctttcactgttttcacaatgaaaaaaattcatcctcataaaaaggccatggtatatcaacttaaaagattccttacctcccccacctcattcattcatggggttctttcacagcactgacttgtactggaaaagacattttgtttcttttcccctcttaggatgtgagttgtatttatgcagttgacacagtttagaggatgcagatcagacttctgtcttgctgggcaagtgtcctaccactgagccacagccccagttgcactgttcattctacacagtgtcttacctgtttctcccactgagatggttaatcttgattgtcaacttaatgaaatctaaaatcaccatggaaacaagtctctgggcatgactgtgagttcatctagatgggggtcattgaagtgtggagacaacctcaaaatttgtgtggtattactccaaggactgcggttcctgactgatgaagaggagaaggcaaaccaagcacaagcatttgtggcccgtttcctgactgcagtgagaagcaagcctcctattcctgctatcacgccctcccaccaggatggaaggacctccctcaaattgtaaactaggataaactgttctttctttaaatcccttcttatcaaattttgtttcagtaataagataagcaactgacgcacccattttcctctaagttcaaggaaaacatgcctttgtcactgctgcagtctgagaacatagaccatatgatttaacacagatatctcaatatctataaactaataaaggcatgattaacactatggaggtggctatggggatggagttactcttctgaggtggtgacttcttgtttccattcttttttttttttttttttttttttatatttatttattcattatatgtaagtacactgtagctgtctttagacaccccagaagagggcatcagatctcattacggatggttgtgagccatcatgtggttgctgggatttgaactcacgaccttcagaagagcagtcagcgctcttaaccgctgagccatctctccagcccccgtttccattctttatttacaatgataaactataagtaaaaccttttatctcatttggattcatagagtgatttttaaactgtaacatgcccttttttagggagccacatatctgaatcataaattatagtgggttgatgttcaaggtctatttaatattctatgtacctatctttatcttttcttacatcttaagagacagggtcatattagaaagttcaagctagtctcaactcagcatcttcctgtctcagcctcccaagtgtgccacgatgtccaatttcattgtgctgctggattaaggtaggataaactatatctcctagctttcagtgaagctagataaagacctccctgccttttttgacttaacaggggaaagggttagatttgatgagtgttggcatttcagaaatagacttcatatttctcaagtggaatccaccaggctagggaaattgtttaattggtaaagcatttactgcataagcataaagacctgactttaaatccccagaactctaggcaaagccaggatcaggaattcacatctgccaccccctgaatcctccaggaatgagagggaaaggcagaaaaagtaagagaagtttgtgggccagctagcctgatgaatgaaacagcttgcaagaccctatctagattgtgtgtgtgtgtgtgtgtgtgtgtgtgtgtgtgtgtacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccaggaaggtaagaggagggtctccaagcccacccccacttcctccaacaaggccacacctactaatagtgcagttccctaggccaaatatattcaaaccaccacagtggttgtgagttgcctgatgtaggaaccttggatcttctagaagagcaacaaacactcttaatcagggagccatctctgcactctgtctaaaacaaggtaggagacaagaaccaaccccttacattgtcttataagccacacacacacaacatggcaagcacatacccaaactcatatatataaacacattcacacacaaaggggaaaaaatagaattcatgtaaatcaccggctacgtatacatgggagatgaggaagaggaatagactatggtaaatcaaaacatctttgtggttgactggaattttaaaatgaaaagaaagaaagtggagaccataactcagacccagtcactcagatgccaggtggacatcctatggctaatccttgaacactcagaaatacaatactggaacaatggagctcagttgatgcttgagataaagatttgggggtcatatgaatttggacagcaactgaagtcatgagatgggtaaaaaaaaaatcacctaggaagtgcacacagtgagaagagagaacatggagggaatactgggtaaccctactgagtaaagaagttcccaagatggaaaaaaaaaaaaaaaaaacaaggaattgacccacaaggtaggaaaatgaacagatcccaggattgtaacatttcaagaaaatataaataactcaaggtgaaggtgctatccaggattagtcatactcctatacaacctacaatcccagcacttactgaggtagacctctaagttcgaggccagcctggaatacaaagcaagcaagatcttatttttacagttttttatttttcaataagaaattaacaaggaggaagggtgaaagcaaagaataaaagaaggaatgaaaaactaaagagtgagagaaaagaggaagtagtgatgaattctgaagaagacgtcagataaaattttagtcagaaggaaatcatgcatggctgtaaggtgaatggttttagactgccccaccctattcttcctgccgtagtcaggactcctcttccggggggaagtgtttatcccctagccgaccctcagtattctttaccacacctttctcattggttgttggcctcccctccaatcaccctgtcctccaatctgtaaaagtaatcttttggggggcggggttcttctcccattctgcttcctggtaacaacgtgtttctatgcttgctctagcctattttagctcctgaataaagacatagaaacctggtatttttattttcaaactgggcaggttctgaactattctaaccctgctaggctgttaatatccagcagaatggcttgtgtttgccatctgagtcttgccttggctctctctcccatcacatcctcatggtgaatcctcctgttctccctacagtggtttttctccgggttctgaagccctgcattattcccttctgcccacctaattggctgatgagctcttcactaatcagagatgatggaaatcaatttttacataactttgagaccagagatgcttgacccatgtcatcctctactgtaacagcgtccaaaaccagccccccaacacagtcctttagcctttcacacattcactcttctgtcatcttcatttccagcattccactgtctctaatcaataccttctcaatcatttttatgatatcatacaccccaactcatcagtcctttaacctccttaagaatctacaattccttttttttaaaaaatccaatcactttctattctccttatgcccctcatgttatcatttttttcttacactcttctttatccaactgcctcaagacccttagacttaaatctctttaatatattgacaaatttaatcagaccctcctaatcttcccataatttgcttttgccacagtgtcccccccagctcagtaaactgtgtttggttttatacccccggtcaagggactgaggtgcatattttacaaaccaacgcagacctggcctccaggttctccaagcatccttcagtccctacctggcacaccctgcccccagacttgaattttccaccccaggggctgaactgcccttccccagaggctcctccccatatattccaggcactttgctcttcctgctcaaactcaagctctctctctcttctcccttccaatctcccctcctcttcctccctcccctcccccacctctccatttgctgtctctgtctctccttcacttctttgtgtgtgtgtgtgtgtgtgtgtgtgtgtgtgtgtgtgtgtgtgtaccctttctctctttctcctctccccagcctctccccaacctcttcccatgacgacttccctagtctcagtccttggtgctactgaactggcccacgagaagcttcccaataaacctgcctttaatataatctaacctgaattgaattggctcatttcactggcagcgaaataacccatcaaattgcaacctgtctttccagctgcttcgacaaaaacactggaatcctcctttacctcttgctcttcccacccaatctgtgctcacacactattgcttctccctttaaagtagacctgcaatcagctgctcccctgcctctcccctgctggttccctggtccagaacccaacaccagaaccaacatcaacagactgtgctagtgtcctgctgggtcactctggttcttgtgttattcttcacaagttcccctcaatagaacctaactctctactccatccctcctggtgcttcttatctcaataaaagctagagtctttaaaacggtccctaagcctaacacttcatggtctgtaatggtccgtaagcctaagacttgacccctcctgattgcttgtctgtcctcacctgctactttcctcctagacttcagcttcatcctcaccgactcccttgtcattcttcatatacgataagtacactcttatctctgaagtctccagttcccctccctagatggtcttccagatatacacatcatctgcttttcccctcacctcttttagagatgaacaaaatcatatggttggagacttacacatttgggaagcattttcatttgagtggaagctggagccagggtactgctgagactgtgcaaataccgtgtggtgtggggaaagctgatcacataacaagagccctaggtaagagcattagtggcagggaacccaacaggaagagaaacaggaattgatagaagttaggagaactggaagaacctagcctcacagaattcaaggaaggggagagttgcaagaaataaaagatgtgtcagcaaattctccagaaaagtaatatatgagtctggagagaaaggaggaagtcggcagggagcatctactctcactgtagctggaaagcaaggacttgagaaatgacaggaagaggtggaagtgaagtggaaactgaaactggagaccattttctcagaagctgagctcagcagagaacacacacctgtctttctctaggagagagcacatgttagcaatgaggggctgcaaacacacgtgaagaagggggttgttgggggattgctatcttttgtgatatcagactcaaaatacaaatttgagggtcttgataaacagtttggtggacccaagtacgattctagcacgttgggcagttcaaatccacctgcaacttcagatccaggggaatccaacaccatcttctggattctgcaggtaccgcacacatagcattctctctctctctctctctctctctctctctctctctctctctctctnnnnnnnnnnn

SEQ ID NO: 1484 - DNA, 828 bp, Mus musculus
gggagtgaagtttcacagagcagctcagacccccagctaatgaatggcgttctaggagagtctgcagttcttcctctaaagcttcctgcagggaagatagccaatatcatcatctggaattatgaatgggaagcgtcacaagtcactgccctcgttatcaacctaagtaatcctgaaagtccacaaatcatgaacactgatgtaaagaagagactgaacatcacccagtcctactccctgcaaatcagcaaccttaccatggcagacacaggatcatacactgcgcagataaccacaaaggactctgaagtgatcaccttcaaatatattctgagggtctttgaacgattgggtaacttagaaactaccaactatactctcctgctagagaatgggacctgccagatacacctggcctgtgttttgaagaatcaaagtcaaactgtctcagttgagtggcaagccacaggaaacatctctttaggaggaccaaatgtcactatcttttgggacccgaggaattctggtgaccagacttacgtctgcagagccaagaatgctgtcagcaatttgtcagtctctgtttcgacccagagtctctgcaaagagtcctcccagagcacagatggcccaggctctccagggaacactgtgtatgcacaagtcactcgtccaatgcaggaaatgaaaatcccaaaacctatcaaaaatgactccatgacaatttactccatagttaatcattccagagaggaaacagtggctttaaccggctataaccaacccattaccctgaaggttaacactttaatcaactataactcctga

SEQ ID NO: 1485 - protein, 275 aa, Mus musculus
GSEVSQSSSDPQLMNGVLGESAVLPLKLPAGKIANIIIWNYEWEASQVTALVINLSNPESPQIMNTDVKKRLNITQSYSLQISNLTMADTGSYTAQITTKDSEVITFKYILRVFERLGNLETTNYTLLLENGTCQIHLACVLKNQSQTVSVEWQATGNISLGGPNVTIFWDPRNSGDQTYVCRAKNAVSNLSVSVSTQSLCKESSQSTDGPGSPGNTVYAQVTRPMQEMKIPKPIKNDSMTIYSIVNHSREETVALTGYNQPITLKVNTLINYNS

SEQ ID NO: 1486 - DNA, 54169 bp, Homo sapiens
  misc_feature (1)...(54169): n = A,T,C or G
cagggtcatagcataatagtggagagaaggtcagcagataaacacgtgaacaaaggtctctggttttcctaggcagaggtccctgcagccttccacagtgtttgtgtccctgggtacctgagattagggagtggtgatgactcttaacgagcatgctgccttcaagcatctgtttaacaaagcacatcttgcaccgcccttaatccatttaaccctgagttgacacagcacatgtttcagagagcacggggttgtgggtaaggttatagattaacagcatcccaaggcagacgaatttttcttagtacagaacaaaatggagtctcctatgtctacttctttctacacagacacagtaacaacctgatctctctttcttttacccacatttcccccttttcttttcgacaaaaccgccattgtcatcatggcccgatctcaatggttgctgtctcttcagagctgttgggtacacctgcagaaaggctgtcacttcacacttggaagattgcacagcggccaggcagaggtgctcctcacttcccagacggggtggcggccgggcagaggcactcctcatatcccagatggggcggccgggcagaggtgctcctcacatcccagacggggtggccaggcagaggtgctcctcacttcccagacaataggcagctgggcagaggttctcctcacttcccagacaggtcggccgggcagagacactcctcacctcccagaaggggtggctgggcagagacgctcctcacctcgcagacggggtggctgggcagaggcgctcacttcctaggtggggcggctgggcagaggcgcacctcacctcccagatgaagggcggccgggcagaggaactcctcacctcccagatgatgggtggccaggcagaggggctcctcacttcccagacagggcagccgggcagaggtgctcctcacctcccagacagggtggctggacagaggcactcctcccctccccgatggggtggctgggcagaggcgctcctcacctcccagacagggcggccgggcagaagcgctcctcacttcccagatggggtggcagccgggcagaggcgcccctcacatcccagatggggtggtggctgggcagaggcactcctcacttcccagacggggtggcagctgggcagagatgctcctcacctcccagatggggtggcggctgggcagaggcactcctcacttcccagacggggcggccgggcataggtgctcctcacatcccagatgatgggcggccaggcagagacgctcatcacttcctagacggggtggtggctgggcagaggcgatcctcacttcccagatggggtggccaggcagagggtctcctgacatcccagacaatgggcggccaggcagagacgctcctcacttcctagacggggtggcggctaggcagaggctgtgatcttagcactttgggaggccaaggcaggcagctgggaggtggaggttgtagcgagctgagatcatgccactgcactccagcctgggcaacattgagcattgaatgagcgcgactccgtctgcaatcccagcacctcgggaggccgaggcgggcagatcactcgaggtcaggagctggagaccagcccagtcaacacggcaaaaccccgtctccaccaaaaatacaaaaaccagtcaggtgtggcagcacatgcctggaatcccaggcattcggcaggctgaggccggagaatcaagggagcccgaggtagggaggttgcagtgaggtgagatcacggcagtacagtccagcctcggtaaggtggggggtggggcagagagagagagaaagagagagagagagagagagagagagagagaatcaaatatctgatgaggaattaatatctagaatacataaagaactctacaaccccccccccaaaaaaaaatccaagttaaatttgggcaaaggacttaaatagatattattccaaagaagatatacaaattgccaataaggccaataagcacatgaaaagatactcaacattattagtaattaaggaaatataagtcaaaaccataatgagataccacttcacattcattaggataatcattatcaaaaaatgaaaaataaaaaatattggcaaagatatggaaaaattagaaccctttttccaattgcaggtgagaatgtaaaatgatgaagccatcatgaaaaacagtttggcagttcctcaacaggtaaacatagaattaccatatgatccaacaatttcactcctaggtgaatccaaagaaatggagagcaggaattcaaacagatacctgtacaccaatgttcatagcagcattattcacaatagagaaaagatagaaacaacccaagtatccaccaatagatgaatagataagcaaatgtggtacatacatataatggaatattatttagttgtaaaaaaggatacaattctgatacatgctacaacatggataaaccttgaatacattatgctaagtgaaataagccagacacaaaaagacaaatgttgtatgattccacttatataaggtacctgcaaattaatagaaacaataagtagattataggttactagggactgaaggaaaagggaacggggagccattgcttaatggtcactgtttccgtttggggtaatgaaaaggctttggaaatagtgttgatgactgcacaacattgtgcattaatgccactaaattgtacacttaaaatggttaaaatgataaattttagattacatagccacgatatataatttaggttattttaccacaataaaataatcacctccaaatggaaaaagtatatagatggaaagtgaaatttccaattcacattgcacaattaagatttgtgcacttgactactgggcaagatgacaagataggaacagctacagtctgcagcaaccagtgagatcaactcagaagtggggtgatttctgcatttccagttgaggtacccagctcaccttggaagcgcaaggggttgaggatctctcccctagccaagggaagctgggagggactgtcccatgaagaatattgcacttcagcccagatactacgcttttcccatggtcttcacaatctgcagaccaggagattccctcaggtgcctacaccaccagggccctgggttccaagcacaaaactgggtggccatttgggtagacaccaagctagctgcaggaggttttgttttgttttgtttcccataccccagtggcacctggaacaccagtgagacagaaccatttattcccctgaaaaggggggctgaagccagaaagccaaatggtgtagctcagcggatcttacccccatggagcccagcaagctaagatccactgccttgaaattcttgctgccagcacagcagtctgaagccgacctggaaagctcgagcttggtggggacaggggcatccaccactactgaggtttgagtaggcggttttcccctcacagtgtaaacaaagctgccaggaagtttgaactgggcagaccccagggcagttcagcaaagctgctgtagccagactgcctctctagattcctcctctttgggcagggcatctctaaaggaaaggcagcaacctcagtcagaggtttagagatcaaactcccatctctctgggacagagcacctgggggaaggggcggatgtgggcttagcttcatcagacttaagcattcctgcctgctggctctgaagggagcagcggttctcccagcacagcgctctagcactgctaagggacagactgcctcctcaagtgggttcctgacccccatgcctcctgactgggagacacctcccagcaggggtcgacagacaccttatacaggagagctcgagctggcatttggcaggtgcccttctgggatgaagcttccagaggaaggaacaggtagcaatctttgctgttctgcagcctccgtaatgatacaggcaaacagggtctggaatggacctccagcaaactccagcaggcctgcagcagaggggcctgactgttcgaaggaaaactaacaaacagaaaggaatagcatcaacattaaccaaaaggatgtcaacacagaaactccatctgaagctcaccaacatcaaagaccaagggagataaatccatgaaggtggggaaaaaacagtgcaaaaaggctaaaaattccaaaaaccagaatgcctcttcacctccaaaggaacacagctcctcatcagcaagggcacaaaactggaaggagaatgagtgtgatgaattgacagaaataggcttcagcaggtgggtaataacaaactcctccaagctaaaggagtatattctaacccaatgcaaggaagctaagaagcttgaaaaaagattaaaggaattgctaactagaataaccagtttagagaagagcaaaaatgacctaatggagctgaaaaacacagcacaagaacttcgtgaagcatacacaagtatcaatagctgaatccatcaagcagaagaaaggatatcagtgactgaagatcagcttaatgaaataaagcatgaagacaagattagagaagaaagaatgaaaagaaatgaacagagcctccaagaaatatgggactatctgaaaagaccaaaccttcatttattggtgtacctgaaagtgatggggagaatgaaaccaagctggaaaacacactttaggatattatccaagagaacttccccaacctagcaatataggccaacattcacattcaggaaatacagagaactccacaaagatattcttcgagaagagcaaccccaagatacataatcttcagattcaccatggttgaaatgaaggaaaaaatgttaagagtagccagagaaaaaggtcgggttacccacaaagggaagcccatcagactaacagcagatctcttggcagaaaccctacaaggcagaagagagtggaggacaatattcaacattcttaaagaaaagaatttacaacccagaatttcatatccagccaaactaagcttcataagtgaagaagaaataaaattctttacagataagcaaatgctgagagattttgtcaccaccaggcctgtcttacaagagttcctgtaggaaccactaaacatggaaaagaacaaccggtaccacccactgcaaaaacataccaaattgtaaagaccatcgacactatgaagaaactgcatcaactaacgggcaaaataaccagctagcatcataatgacaggatcaaattcacacataacaatattaaccttaaatgtaaatgagctaaatgccccaatcagaagacacaggctagcaaattggataaagagtcaagacccatcagtgtgctgtatccaggagacccatctcatgggcaaagacacacataggctcagaataaagggctggagcaatatttaccaagcaaatgaaaagaaaaaaaaagcagggattgcaatcctagtctctgataaaacagactttaaaacaacaaagataaaaaaggacaaagaaaagcatcacataatggtaaagggatcaatgcaacaaaaagagctaactatcctaaatagatatgtgcccaatacaaaggacccagatttataaagcaagttcttagagacctacaaagagacttagactcccacacaataataatgggagactttaacaccccactgtcaatattagacagatcaatgagacagaaaattaacaaggatatccaggacttgaactcagctctggaacaagaggacctaatagacatctacagaactctccaccccaaattgacagaagacacattcttctcagcaccacatcacatttattctaaaactgaccacataattagaagtaaaacactcctcagcaaatgcaaaagaatggaaatcataacaaactgtctctcagaccgcagtacaatcaaattagaactcaggattaagaaactcactcaaaaccacacaactacatggaaactgaacaatctgccctgaatgactactgggtaaataaaaaaattaaggcagatataaataagttctttaaggccaatgagaacaaagacacaatgtaccagaatctctgggacacagccaaagcagtatgtagtgggaaacatagcactaaatgctcacaagggaaagcaagagaaatctaaaattcacatctgacatcacacttaaaagaactagagaagcaagagcaaacaaattcaaaagctaacagaagacaagaaataattaaaatcagagcagaactgaaggagatagagacactaaatacccttcaaaaatcaatgaatccaagagctgttttttgcaaagatcaacaaaatagatagctagtcagactaatgaagaaaagagaagaatcaaatagacacaataaaaaatgataaaggggacattgccactgatcccacagaaatacaatctaccgtcagagaatactacaaacacctctacacaaatactagaaaatctagaagaaatggataaattcctggacacatacaccctcccaagattaaaccagaaggaaatcaaatccctaaatagaccaataaaaagttctgaatttgaggcagtaattaataacctaccaaccaaaaaaagcccaggactagatggattcacagccgaattctaccagagatacaaagaggagctggtgccattccttctgaaactattccaaacaataaaaaaagagggactcctccctaactcattttatgaggccagcatcatcctgataccaaaacctggcagagacacaacaaaaaaagaaaattttaggccaatatccctgatgaacattgatgtaaaaatcctcaataaaatacaggcaaactgaatccagcagcatatcaaaaagcttatccaccagccgggcatggtggctcgtgcctgtaatcccagcactttgggaggctgaggtgggtggatcatgaggtcaggagatcgagaccatcctggctaacacagtgaaactctgtctgtactaaaaatacagaaaaattagctgggcgtggtagtgggcacctgcagtcccagctactcaggaggctgaggcaggagaatggcatgaacccaggaggcggaacttgcagtgagccaagattgttccactgcactctggcctgggcgacagagcaagactccacctcaaaaaaaaaaaaaaaaaaagcttatccaccacaatcaagttggcttcatccctggtatgcaaggttggttcaacatatgcaaatcaataaatgtaattcatcacataaacagaaccaatgacaaaaaccacatgattatctcaatagatgtagaaaaggcctttgataaaattcaacatcccttcatgttaaaaactcttaataaactaggtactgatggaacgtatctcaaaataatgagagctatttatgacaaacccacagccattatcatactgaatgggcaaaatctggaagcattccctttgaaaactagcacaaggatgccctctctcaccactcctattcaacataatattgaaagttctgaccagggcaatcaggcaagagaaagaagtaaagggtattcagataagaagagaggaaatcaaatagtctctgtttgcagatgacatgattgtatatttagaaaactccattgtcttagcccaaaatctccttaagctgataagcagcttcagcagtctcaggatacaaaatcaatgtgcaaaaatcacaagcattcctatacaccaaaaatagacaaacagagagccaagtcgtgagtgaactgccattcacaattgctacaaagagaatataatacctaggaatacaacttacaagggatgtgaaggacctcttcaaggagaactacaaaccactgctcaaggaaataagaaagtacacaaacaaatggaaaaccattccatgctcatagataggaagaatcaatatcatgaaaatggccatattgcccaaagtaatttataggttcaatgctatttccatcaaactactattgactttcttcacagaattagaaaaaactactttaaatttcatacagaaccaaaaacgagcccatatagccaagacaattgtaagccaaaagaacaaagctggagtcagcacgctaactgacttcaaactatactacaaaggtgcagtaaccaaaacagcatggtactggtaccaaaacagatatatagaccaatggagcagaacagaggcctcagaaataacatcacacatctacaaccatctgatctttgacaaacctaacaaaaacaagcaatggggaaaggattccctatttaataaatggtgttgggaaaactggctagcaattatgcagaaaactgaaactggttcccttccttataccttacacaaaaattaactcaagatggattaaagacttaaatgttagacctaaaaccacaaaaaccccagaagaaaacctaggcaataccattcaggacaaaggcatgggcaaagacttcaatactaaaacatcaaaatcaatggcaacaaaagccaaaattgacaaatgggacctaattaaactaaagagcttctgcacagcaaaagaaactatcatcagagtgaacagggaacctacagaatgggagaaaatttttgcagtctatccatttgacaaaaggctaatatccagaatctacaaagaactcaaacaaatttacaagaaaaaaaaaaaaaaccccaacaaaaagtgggcaaaggatatgaagacacttctcaaaagaagacatttatgcggccaagaaacatatgaaaaaagctcatcatcactggtcattagagaaatgcaaatcaaaactacaatgagataccatctcatgccagttagaatggcaatcattaaaaaatcaggaaacaacagatgctggagaggatgtagagaaatgggaatgttttcacactgttggtgggagtgtaaactagttcaaccattgtggaatacagtgtggcgattcctcaaggatctagaactagaaataccatttgacccagcaatcccattactggttatatacccaaaggattataaatcatgctgctataaagacacatgcacacttatgtttattgcagcactgttcacaatagcaaagacttggaaccaacccaaatgcccatcaatgatacactggataaagaaaatgtggcatatatataccatggaataccatgcagccataaaaaaggatgagttcatgtcctttgcagggacatggatgaagctggaaaccatcattctcagcaaactaacacaagaacagaaagccaaacaacgcatgttctcactcataggtgggaactgaacaatgagaacacatggacacaggtaggggaacatcatacactggggtatgtcacggggtggggggcaaggggagggatagcattaggagaaatatctaatgtagatgacaagttaataggtgcagcacaccaacatggcatatgtatacatatgtaacaaacctgcacattgtgcacatgtaccctagaacttaaagtataattttaaaaaatcagttttcttttggctttttcttagctttatacttaaatatttttttctaatgtaattagagtggaattgttttttgaattttatttttggattactcatagctagtatatacaattgcaattgaattttatattttgattttgtatcttttcaccttgctgaactcatttatttgttctagtagattttaggaaattccttacagacttttacatataagtttatgaaagatgcaataaaggactttatcttcttttccaaaaaaaaaaaaaatttgtgcacttagctcagaaaaaagtaaacaaaaaattaacacagttacaaattaggatttttagtgcaggggaagaagttgtcaccacgcctctaagaggaaggggaagtctcagaagtattttcagtttatgacagaagggcaaaaacattgactgcctcaaggtctcaagcaccagtcttcaccgcggaaagcatgttgtggctgttccaatcgctcctgtttgtcttctgctttggcccaggtaaatgtcaatccagatcggtgtagtcactgagtgactccctggttttgtgcagcttgctcaacctaaatcgtctgtatacagttgtctggctctctgccaagggattggggcgggaaaggggacgctggcagtgttacctgatatactactacctcctctcaactttggatgcgataagcctgagatggttgtcggtgaacaatttcaattgtgtctgcatgtaagaaagttatttgctggggcagaggaaataagcttttgaagacaagactgtttgtggtttatgaccagcatcttgtgttataaagagtaccaagaccaagaaaatgggccctcataccaatgtatctactatcgtactgtgaacctcagggaggttacttatccttcctgaacctcactatcctcatctaaaatattaaaaacctattattcagttgagccaaattttctgggcccaaccaaacacaccaaaaataaccctctcaccttttgctcattgcaaaaaaaaaaggtttccatctctcccctcctttagtgcaaattagggctagctagtccagcaatgcattatatatggcagtgagaaaagaatgaactgatccagctggcttcttgtttcctgctgtccattatatggagaagatgaagattcatatcacatttggggaactacaagtggtccacgggagacaaagtgtagcattcaggcagagatagtccaggagaccaatggaaatctagtccagagctagcccagggtagcagataaaagtaggaagcattcactgagcacttattgtatttcaagtattgtgccaggtgctgtacacacgttatgagtctcatgagaattctatgaatttatactattaatatctccattttaaaatgaagaactgaggtgaacttaatttaaataatttgcccaaatttcattagccagcatgcgacaagctcttgtaatagttatgagaaaaaataacagttcaacaagtgtggcagcagcataagagaaagaagagactgaagcaagagatcccatcaatatggagttaagtagagtaattggtaattggaatgagaaaggaataaatattcattgagcacctactgaatgcttggcactcttctagtttgcatgaatacatcatgaacaaagcaagcaaaaattcctgccctcatggagttaacattttagcaggagacaaactgtaaaaaaagataaacaagtaaaatagtgtattgggtaggaagaaataaatcaagaaggaaagggagagatgaaatatggtaaagacggcagtgaaatttcagacaggatagccaaagaaagtgacaaaattggaaggtggagagcagccacaggaggaaggtgagttcaattttggacctactgattttaggatgtcagtgtgctatacatgaggaagttacgtggaggatcctgggaacttaggactaggggtagagctgaggctagagacttaaaaatcaatggcatagagatatgttaagctgaggagaaaactggaatgagaacagaactttgggaaatatatataaaatgcagaaagagagagaattctttccttcattcaagagccacttcctgatctaggagcagaatcttgagtttttgcttcatttttaccaccctgcaaaattatttccacctctagaataaaatattctgaatgtccttgtgttaaaactcctcttcttctccctatttccatgaatacttcttataatgaccctatgaaatatacagtgctccaatctccacttcacagatggggaaagaaggcacagaacactaaagtaacttgctcactgccccacatttatgggggaaatgggtatagaaagagaaacacatttgaatgagtttacaggaggcagatgcaggtgttctgagacccaggaggagagaagtggctgctagaattggaaatcaggaagcttggctccggagtctgtgctcatagccacttcactatgctacttagcttacacacagtcatacattcacacaaatgtgtacataattagaaaatgtgaggccagcaaaaaaaataagcagggcaccttcatagagaaaaacacggggacctgctttggacggagtgatgaagaaaggacttcctggaaaagtaacatctcatctgatatttaaagggtgtgaaaagttaaacaggaaaagtcaaatgaagaagattttagggcagagggaatcatgtgtgaaaagccgtgatgcaggaaagagcctggagtgatttaggaagggaaagaagaccactgttgcaaaaatgtggggcaaatgaaattaatctttgaaacaaccatgaaaaacaatgactcatgccagcctacattctttgaagtgggttgggcactatcctgactccttttagaaaatttagtggaaaagacaaaccatattgaaaaataatcccatttcctttaactcaagccctgggtggcaaaactaacagaacaaaacaataattgtaaataaaatcaagcatcatgacttcctagagaaaataaatctcgtttgtttcttcattttgatttttatagatggaaagttggaaatttgtcaaacttaaatgtgcatataaattacttgggggaatcttattaaaatgctgattggggaatagggactgagattctgcatttctaagaggctcccaggtgacaccaatgctgcctgtccatggaccacactaagcagcaaggttctaaattccaatggacttcagtcatactgggattgtagggaggaagaaatagaaactaactttgagtgtgtttgcaggaagcagatataggtattctgaggtccaggagagagcagtggttggaaatgtaagtaaagcaaacacatgagggctgattctgaggttgagtcaaaatgtgcaatgctcttctgtgaagagattgtgacccgatggcccccgagcagtgttatctactttttaccaaccgtccacatctttcaaatgtttattgtgctcaacaggcagagagctgttttatattttttcattatcctcagacacgtgtttttccacctctcagaatctgcaatctccaatgtgacctccaggtgttcatgcctctgtttttggtcccttaacccagattcagctttgattgtttctctgttcacactcagacattttttattaaggtgaaattcttgtaacaggatgtaataattttaaagtgacattttgtacattttgtgaaaccaccacttctattattctaaaacattttcatcaccccaaaaggaaaccctgtacccactaagcagtcatttcccattctcccctcccccccagcccctggcaaataccgatctgctttctgtctctgtgggtttacctattctggataatttcatataaatgaaatcacacaatatatgacctttcgtgtctgacttctttcacttagcatcatgttttccaggttcacctatgctgaaccatgtatcagtacttcattcctttttggctgaatagtattttgtattctgtatatactacattttatttatccatttatctatcagtggacacctgggttgtttttgccttttggctcttgcgaatagtgctgctatgtgtacaagtatttgactacctgtttttatctgggtatatacctaggaatggatttgtcagatcatataattctatgcttaactttttgggaaattgccaaactgttttccacaatggctgtaccattttacatttccactagctgtgtacaagagttataatttctccacatcctcatcaacacttgtttttttcctttttaaaaagattattatcaccatcctaataggtgtgaagtggtatattattgtggttttgatttacattttcccaatgacaaatgattttgagtatctttttaagtgtttattggccatttgtatatcctctttggagaaatgtctattcaagtcctttgcccattttagttgaattatttgtctttttgctattgagttataagagttgtttatacattcttggaaccagacctttaatacatgacctgaaaatattttctcccattctgtaggttgtcttttcactttcttaataatgttctttgatgcacaaaagtctttaattttgatgaagcacaatttacctatttttatcttttttcttttttatcattttattttaagttccaggatacacgtgcaggatatgcaagtttgttacataggtaaacatgtgccctggtggtttgctgcacctatcaacctcacctaagtattaagccctgcatacattagctatttttcctgatgctctctctcccccctgccccacccccgacaggccccagtgtgtgtcattccccttcttgtgtccatgtgttctcattgttcagctcccacttaaagaacatgcggtgtttggctttctgttcctgcattagtttgctgagaataatggcttctggcttcatccatgtccctgcaaaggacatgatttcattcctttttatggctgcatagtattccgtggtgtatacgtaccacattttctttatccggtctatcattgatgggcatttgggttgatttcatgtctttgctattatgaatagtgctgcaatgaagatacacgtgcaatgaacatgcacatacacatatctttataacaatgatttatattcttttgggtatatacccagtaatgggattgctgggtcaaattgtctttctgcctctaggtctttgaggagtccccgcattgtcttccagaatagttgaactaatttacattcccaccaacagtgtaaaagagtttctatttctccacagccttgccagcatctgttttttcttgacttctaaataattgccattctgacctgtgtgagatggtatcccattgtggttttgatgtgcatttctctaatgaccagtgatgttgagcttttttccatgtttcttggccacataaatgtcttctttttttttttaacacctgaagagtaagtttaatggaattcatagttacagatattcagaaaatatttgttgggggaactaattaatacatttctttcttttaatttttatttttagttctgggtacatgtgcagtatgtgcaggtttgttacataggtaaacctgtgccctggtggtttgctgcacctaccaacgcatcacctaggtattaagcccagcatgcattatctatttttcttaatgctctccctcccccaaccccactccccaagaggccccagtgcatgttgtttccctccctgtgtccatgtgttctcactgttcagctcccacttacaagtgagaacatgcagtgtttggttttctgttcttgtatgagtttgctgaggataatggcttccagcttcatccacattcctgcaaaggacatgatctcattccttttgatggctgcatagtattccatggtgtatatgttccacattttctttatctcgtctgtcattgatgggcattttggttgattccaggcctttgctattgtgaatagtgctgcaatgaacatatgcatgcatatatctttgtaacagagcgatttatattcctttgggtatatacccagaaatgggattgctgggtcaaatggtatttctggttctagatctttgaggatttgccacactgtcttccacaatggttgaactaatttacattcccaacagtgtaaaagtgttcctatttctccagaacctcacaagcatctgttgtttcttgactttttcataatcactattctgtcatgagatggtaatttattgtggttttcaattgtatttttctaatgatcagtgatgttgagctttttttcatgtttgttggctgcatgaatgtcttcttttgagaagtgtctgttaatgtcctttgctcgccttttaatggggttgtttgatttttttcttgtaaatttgtttgagttccttgtagaatctggatattagacctttaacagatgaatagattgcaaaaattttctcccactctgtaggttgcctcttggctctgataatagtttcttctgctatgcagaagctcttcagtttaactagatcccatttgtcaatttttgcttttgttgcaattgctttcagtgatttcataatgaaatctttgcccatgcctatgtcctgaatggcattgcctagattgtattctagggttttcatagttttgagttttacatttaagtctttaatctatcttgagttaatttttgtataaggtgtgagggaggggtccagtttcaattttctgcatatggatagccagttctcccagcaccagttattaaatagtgaatcctttccccattgcttgtttttgtcacgttttttgaagatcagatagtggtagatgtgcagtcttatttatgggttctctattctgttccattggtctatgtgtctgttttgtaccagtaccatgtaccgtgctgttttggttattgctgccttatagtattgtttgaagtccagtagcatgatgcctccagctttgttccttttgcttaggattgtcttggctatatgagcccttttttggttccatataaattttaaaatagttttttctaattttgtgaaaaatgtcaatgatagtttaatgggaatagtagtgaatctattaattacttcgggcagtatggtcattttcatgatgttgattcttcctatccatgagcacagaatatttttccatttgtttgtgtcctctctggtttccttgagcagtggtttgtagttctttttgaagaggttccttcacttcctttgttagctgtattcctaagtattttattctctttgtaacaattgtgaatgggagttcattcatgatttggttctctgcttgcctgtgtgtgttgtataagaatgcttgtaacttctgcattgattttgtttcctgagatcttgctgaagttgcatgtgagcttaagaagcttttgggctgagatgatggggttttctagatataggatcgtgtcatctgcaaacaaagataaatttgacttcctctcttcctgtgtgaatatgctttatttctttctcttgcctgattgccctggtcagaacttttaatactatgctgaataggagtggtgagagagggcaatccctgtcttatgctgtttttcacaagaaatgcttccagttttgcccattcagtataatattggttgttggtttgtcataaatgtctcttattgttttaagatatgttccatcaatacctggtttattgagagtgtttaacatgaagggatgttgaattttatagaaggccttttctgtgtctattaagataatctgtggtttttgtctttagatctgtttatgagatgaattacatttattgatttgcatatgttgaaccagccttgcatcccaggaataaagccaactcgatcagggtggataagctttttgatgtgccgctatatttggtttgccagtattttattgagaatttttgcatcagtgttcatcaggatattggcctgaagctttcttttttgttgtatctctgccaggttttggtatcaggatgatactggcctcataaaatgaattagggaagggtccctccttttcaattgtttggaatagtttcagaagaaatggtgccaggtcctctttgtacctctagtagaattcagctgtaaatccttctggtcctgggctttttcttttagactatttattactgtctcaatttcagaatttgttattggtctattcagggattcagcttcctcctggttcagtcttgggagggtgtatgtgtccaggaatttatccatttcttctagattttctaggttatgtgcatagaggtgtttatagtattctctgatgattgtttttatttctgtggggtcagtagtgatatcctcttttaacattttttattgtgtccatttgattcttctctcttttcttctttgttagtctagctaactagcagtctatctatattattagtttttcaaaaaaccagattctggactccttgatttttttgaagcattcttcttttatctatctccttcagttctgctttgatcttggttatttcttgtcttctgccagctttggagtttgtttgctcttggttctccagttcttttagttttaatgttagcatttcaatttgagatctttctaggtttttgatgtgggcatttagtgctctaaatttccctcttaacagctgctttagctgcatccagagattctgatacattgtctctttgttctcattggtttcaaagaacttcttgctttctgccttaatttcattatttaaccaggagtcatgcaggagcaggttgttcaatttctatgtagctatgtgattttgagtgagtttctttgtcttgagttctaatttgattatgctgtggtctgagagactgtttgttgtgatttcagttcttttgtatttgatgaggagtgttttacttccaattatgtgatcaattttagagtaagttccatgtggcaatgcatagaatgaatattctgttgttgtaggatggagagttttgtagaggtctatcaggtccacttgatctagagctgagttcaagtcctgaatatctttgttaattttctgtctgaatgatctgcctaatattgacagtggatgttaaagtctcccgctattattgtgtgggagtctacatctccttgtacgtctctaagagcttattttaggaatctgcttttgtattgggtgcatacatatttaggatagttagttcttcttgttgaattgaaccctttaccatgcctttctttgtcttttttggtctttattgctttaaagtctattttgtcagaaactaggattgcaatccctgcttttttctggtttccatttgcctggtagattttcctctatccctttattttgaacctatgtgtgtgtttgcatgtgagatgagtctcttgaatacagcacaccaatgggtcttcacaatttacccagcttgccattctgtgtcttttaaatggggcacttagcacatttatatttaaagttagtattgttatgtgtgaatttgatcctgtcatcatgatactagctagttattttgcagacttattgatgtagttgcttcacagtttcattggtcttcattgtgtacttcagtatgttttgtagtggctgataatggcttttcctttccatatttagtgcttccttcaggagctcttgcaagtcaagcctggtggtggatgaattccctcagcatttgattgtctgaaaaatattttatttctcctttgcttatgaagcttcatttggccagatatgagattctgggttgaaaattcttttctttaagaatgttgaatattgacccccaatctcttctggcttgtaaagtttctgctgagaggcctgatgttattctgatgggcttccctttgtaggtgacttggcctttctctctggctgcccttaacattttttccttcattttgaccttgaagaatctaataattatgtgtcttgtggttgatcctctcatggagtatcttactgggttctttgtatttcttgagtttgaatgttggcctgtcttgctaggttggggaagtctcctggatgatatcgtgaagtatgttttccaactttgtttcattcacctgtctctttcaggtaccataatcagttgtaggttcggtctctttacataatcccataattctcagagattttgtttgttccttttcattcctttttctctaatcttgtctgcctattttatttcagcaagatagtcttcaatctcttaaattctttcctccacttggtctattcggctattgatacttatgattgcattgtgatgttttcatgttgtgtttttcagttccatcaagtcatttatgttcctctctaagctggttattctgatgaatagctcctgtaatgttttatcctgattcttaggttctttgcattgagttagaacatactcctttagctcggcaaagttcattattacccaccttctgaagcctacttctgtcagttcatccttctcagcctgagcccagttgtgtgccctgctggagaggtgttacaatcatttggaggagaagagacactctggctttttgagttttcagcattttttattgattctttctcatcttcctgagtttatctagctttgatctttgagtctgctgacctttggatgggctttttgtggggacttttttgttgatgctgttgttgttgctttctgtttgtttttcttttagcagacaggaccctcttttgcaagactgctgcagtttgctgggggcccactccagaccctattcacctgggtccctccccaccctggtggtgtcaccagtggaggctgcagaaccgcaaagatggctgcctgcttcttcctctgggagctccgtccaagaggggcaccaaactgatgacagtgggagtgctcctgtataaagtgtctggtaacccctgctggggagtctcacccagtcaggagtcacaagataagggacccacttaatgaagcattctgtctgtcccttggcagaaaggatgtgctgtggtgggggggatcctacttatccagactgcccagattcctcagagccagcaggggaaaagactaagtctgatgatccacagagtccgcagccccagtacccacagggactcaatcccagggagatcagggttctgtccataaacccttggctggagttgctgaaattcccacagggaggtcccattcagtgaggagggatgagtctgggtccagcctaaagatgcagtctggccacagtctgccacagctgctgtgctgcaccatggggaattcctcctggttccaaaccaccagtccctctggcactggcaggggaaagcagcagacagaagctgcagtgatggctgctgccccttcccccaagaactcagtagtcttagacggtctccagccaagtggcagctgagaatctgcacagctctgtgcttgggatccaaggcccttgtggtgttggctcacgaggggatctcctggtccatgggttgcacagatccatggaaaaagcatggtttcctgggtggggtagcacaatcactcaccacttcccttggctgggggtgggagcaccccttgccccatcagcttccaggtgggctgttgttccaccctgttttcctcactccctgtgggtcatgccaaccacctagtcagtcccaatgagtgagcctggataccttagttgctggtgcaggattcactcactgttttcgttcttctcagtgggatcctccaaccacagctgtttctagttagtcatcttggcccctccccacattttatcttttcttacttatgcttttggtgtcatatatcagaatccattcccaaatcaaaaatcatgaatatttatcattatgttttcttctaagagttttagctcttatatttaggtgatcgatacattttgagataatttttgcatataatgagaggaaggggcccaacttcattctgttgaatgtggatatccagttgtcccagcaccatttgttaaagagagcattctctccctattgaatgatcttagcactcttgtcaaaaatcacctggccataaatgtttgggtttatttatggactctcaatttaatttcatatagacatctataagtttatctttatgccagtaccacactgttttgattaccatatctgtatcagttttgaaattggaaagtgtgagtccaccaattttgcttttcttttacaatattgttttggctacttggggcatcttgaaatcacatataaatttgagaattagcttttccatttatgaaaaaaaatcaacattttgataaggattgcattgactctataaattgctttgggtggtatcggcatattaatattatcttccaattaatgaacataggatgtatttccatttatttagattttctttctttcagaaatgttatttagttttcagtgtattatcttgaacttctctggttaaattattgccaggtattttgttcttttgaatgctactgtacatggaactgcttttcttaacttctttttcagattgttcattgctagtgtgtaggaacagaactgatttttatacattgattttgtatcttgcaactttgctgaatttatttattagctctgatcatttttgtggattctttaggattttctattttcaacatcatgttatctgtgaataggaatagttttacacattctttttcaattgagatgcattttatttatttttcttgcctaattgctctggctagaacttccagttcaatattaaatagaagtggtgagactgggcactgttgccttttcatgctgttatttgaaaggcttttagtcttttatccttgagtaaaatgttagctgtgggttttcataaatgccttttatcagactgaggaagttcccttctatttctagattctaaagtgtttttatttaaaaggtgctggtttttttcaaatgttttttctgcatcaactaagatggccattagtctatttttcttcattctgttaatatcatatactgcattgattggttttcatgtattgaaccacttttgcattgctgagataaattctacttggtcatggtgtataatccctttaatatgagctggattcagtttgttagtattctgttgaaagtttttgcatcaatattcataagggatatcagtctgtagttttcttttttctgatatttttggctttggtatcagggtaatgctgacctagtaaaatgacttaggaagtgtttttctcctcttctatttttgggaagagcttgagaataattgaaactaattattctttgaataattagtagaatttaccagtgaagccatctggattttctttgtcaggaggtttttgagtactgattcaatctcttttcttgttataggtcctctttaattttttatttcttcttaagtcagtcttggtattttatgtgtttccagaaatctatttcatctaggttattcaatttgttggcatatagttatttatagtgttctcttaatccttttagttgttatttctataagatctgtagtaatgtctccacttctatgtctacttttagtaatttgaatcttttctattttattctttgtcaatctagctaaaggtttgtcaattttgtttatcttttcaaagaaccaacttttggtttcattgattatttctcttgtttttctattctctatgttatttatctctgctctaatttttatgatttgcttcattctaatagctttgggtttagtttgctcttctttgtctagttttttaaagtgtaaatttcctccttctttatttttttaatatactttaagttctagggtacatgtgcacatcgtgcaagtttgttacataggtatatatgtgccatgttggtttgctgcacccatcaactcgtcatttacattaggtatttctcttaatgctatccctcccccagctccccaccccctgacaggccccagtgtgtgatgttccccaccctgtgtccaagtgttctcattgttcaattcccacctatgaatgagaacatgtggtgtttggttttctgtccttgtgacagtttgctgagaatgatggtttccagcttcatccatgtccctacaaaggacaagagctcttccttttttatggctgcatagtattctatggtatatatgtgccacattttcttaatccagtctatcattgttggacatttgggttggttccaaatctttgctattgtgaatagtgccacaacaaacatacgtgtgcatgtgtctttacagtagcatgatttataatcctttgggtttatacccagtaatgggatggctgggtcaaatggtatttctagctctagatcctttaggaattgccacactgtcttccacaatggttgaactaatttacactcccaccaacattgtaaaagtgttcctgtttctccatatcctctccagcatctgttgtttcctgactttttaatgatagccattctaactggtgtgagatggtatctcattgtgattttggtttgcatttctctgatgaccagtgatgatgagcattttttcatatgtctgttggctgcataaatgtcttcttttgagaagtgtcttcatatcctttgcccactttttgatgggatttttttttcttgtaaatttgtttaaattctttgtagattctagatattagcgcttggtcagatgggtagattgcaaaaattttctcccattatgtaggttgtctgttcactctgatggtagtttcttttgctgtgcagaagctctttagtttaattagatcccatttgtctattttggcttttgttgccattgcttttggtgttttagtattgaagtcgttgcccatacctatatcctgaatggtattgcctaggttttcttctacagtttttatggttttaggtctaacatttaagtctttaatccatcttgaattaaattctgtataaggtgtaaggaagggatccagtttcagctttctacatatggctagccagttttcccagcaccatttattaaatagggagtcctttctccatttcttgtttttatcaggtttgtcaaagatcagatggttgtagatgtgtggtgctatttctgaggcctctgttctgtaccactgatctatatatatgttttggtaccagtaccatgctgttttggttactgtagccttgtagtatattttgaagtcaggtagtgagatgcctctagctttgttctttttgcttaggattgtcttggcaatgtgggctcttttttggttccatatgaactttaaagtagatttttccaattctatgaagaaagtcattggtagcttgatggggatggcattgaatctacaaattaccttgggcagtatggccattttcatgatattgattcttcctacccatgagcatggaatattcttccatttgtttgtgtcctattttattttgttgagcagtggtttgtagtcctccttgaagaggtccttcacatcccttttaagttggattcctagtcttccttctttctttcagagggataaaaatatccctctgagcactacttttgctccatcccatgttttggtaagctttgtttttgttttcacttggtgtcaagatatatcctaattcatcttgttatttcttctttgatccattgattattttacactatgttaattatgacatatttgtgaattttccaattctccttctgttcttgatttccagttttattccatttatggtcatagaagacatcatatatttaagtcttttataatttattgagacttgtttttgtggcctaatatatggtctgtcctatgagaacgacttatgtgcatttgaggaaaatgtatattttgttgtgtttggatgtagtgtttttcatatatatgttaggtattgttggtttataatgttttccaagtcctctatttccttattgatcttctctctagttgttttgaccattattgcaagtgaggtattgatgtctccaactattactgtagaactgtctatttctcccttgaattttgttactgtttgctttatatattttggggctgttgtttggtgcatatgtgtttataattgttataactttttgcagggttgacccttttattaatgtataatgtccttttttgcctctactaataatttttgacttaaagtctatttgccaatattagtatagctactgtaactctcttttggttactacttgcatggaatatcattttccatcttcttcttctaaaagtatttgtgcctttgaatctaaagtgaatctctgtatgtagaaaatagttgaatcctgttttttcaattcattctgcctatctctgcattttaattgaagagttcaattcatttacatttaaagtaatgactgatatgtaaggacctacttcttgcattttgccatttcttttctgtatgtcttaaaccttttcccctcagtccctccactattctattctttcatgtatagtttatatttttaagtttagattcctttctcatttcctttcctgtatttttagttattgtattgttatcctcagtgttacatttaacctcttcaacttataacaagctattttgaattcacactaccttagcttcaataatatacaaacactgtgctccaatgttgtttcattctgctgcctttacgttgttgtaacaaactacatctttgtgcatgtgtgctcattaacagatttataattattgttttactcatttgtcttttaaatcatgtgggaaaaaggagaagttgcaaagcaaaaatgcaagaatactggcttttgtattaatctatgcagtcagatttaccttcattctttgtttcttggtagggatttgagttactttctagtgtgattttatttcagcctgaaagattccctttagtatttcttacagtacaagtctactagcaataaactctatctgcttttgtttatctgcaaatgtcttaacttctccttcatttttgaaggataattttttcagatgtagaattcttggttgatgggtgtttttttttctttcagcaccttaaatatgtcatcccactgcctcctggcaatcatggattcttctgagaaattggctgttgattttattgagcatgacttgtacatgactagttgctttctcttgttgcatttgagactctctccttgttttcatttttctggtttgattataatatgtcttgttatggatctctttgtgatcattcttcttggagttcattgactttcttggatgtataaattcatgtcttctataaagtttgggaagtttggggccattattttttcaaatattatttatgcccttttctctctctctgctcctccttggactcctattatgcttattttttggtatttttgatggtgtcccacaaatctcttaagcactgtacatttttcttcactcttttcttttctgatcctcaaactggataatttcaattgacctagctttgaattagctatttcttacttctgcctacacagagcttctgttgaaagcctctagtgaattttttatttcaattattgtattttttcagctccagaatctctacttggctccttgttattatttctatcttttaaaaatattctcttttctttatatatccttttcttgatttcctttagttctttgtccattgtttcctttagctttttgagcatatttaagatagttgaggccaggcagggtggctcatgcctgtaatctcagcactttgtgggggccgaggcaggtaaatcatttgagcccaggagttcaaaccagcctgggcaacatagtgaaactgcatctctacaaaatattttaaaaattagccagggatggtggcatgtgcctgtagaaccagctactcaggaggctgaggtgggaggatgacttcagcccaggaggcagaggttgcagtgagctgagatcacaccactgcactccaatctgggcaacagagtgagaccctgtctcaaaaaaagacagttgacttaaagactttgtctagcaaatccagtatctgtccttccttagggacaatttctgtttatttcacctgtgaatgggtcacactttcttgttcttcacatgctttataattttttgttgaaactagatatttttaatactataatatgataactctggaaatcagactcttccccttcctcagtattttgttttgttccttgctctgggttgtaattcttgtttttttagtgactattctaaactatttttgtaaacatattatttgtcacatgtagtctctaaaatgtctttttctttagcttatggtcaactagtgttttgacagatatttctttgaacaccagaaggaataaacaaacaaataaataaataaattctgtgcttgtctttgcagattggctctgttttggggcactcctttaatgcctagacaggctaccactctgcgttagccttgactttcttcttgtacccagcataattatcagccatagataaaatcttagagtcttctcagaacttttctaagtatgcaccctgccctaggcatgtatgtggctttccaaattccctggtataagcagacattttcttaatgcctgaattcttctaagaatctttctccccagcttttcttcccaggcattcgacatatctattttttgcctccactataatgttttgccccaggtattgatgggttattcattgcctttcagtgtttatgagaaatgtcctctgcatggctaatttctacctgaaagagaggtagttgagacaaagacaagtgcttttcctcagttttttagggagcatccagtatagttgaaaacagacaaatacaattctttcagaaccagttctgctctatgcctgctggaaccagtgaccatggtctcctactgaaaatgtagacggctgtcttcaagactgctatcaagttggagaaaaaagatcggggaaagggcaatcaaacattctgcaaagctccccaatgatttttttttaattgtgtatatctaagctgtacaacatgacattttgatatatgcagtgaaatggttaccctagtcatgcaaattaacatattcattatcttgcactgttaccctttttgtgcaagtatggtaagagtatctaaaatctactctgagcaaatgttcggtatacaatacaatcatataagtatagccttcatgttgtatattagattcctagacttatttaccctacatatctgcaactttgtaccctgtgacctacatctccccatttcctctctgttccctctctccacctctgataaccactgctttatactttgtttctatgtatttggctttttttaactccttttttttcttttgctttttttttttttttttgagatagagtctcactctgtcacccaggctggagtgcaatggcatgatctcagctcactgcaacctctgcctcccaggtttaaacaatcctccccagctgggactacaggcatgttccactctgcctggctgatatttttgtattttcagtagagacagggtttcaccatgttggccagactagaactcctagcatttttaagttgcctctttttttgacccatcatttgtttggttgctataatcctttgactagtttctacagttctgacaaagttgattctgacaatgtttgctcactctgtgtgtgttcgcatgagtgtgcatgttttttgtggagggatggacccttgcagttatttattgtgccattttgactaatgtcactgaccctcagactttaggccagcaatttcaacaaagtagtcaccattcccctgaaatccctctcccctttgatgccacacctacctatactatgcctattgctaatattaggtgatccccagcaccttctttccctgttcctgggctacaagtgctataatcattggagaaagttattagtgtggtgcaaaagtgattgcggattttcccattgaaggtaatggcaaaatccgcaatcactttcgcaccagccaatgcaaaactggatggactccatgaatggtgcgtgtcaaccaagcttggccaattcctcctcactgcttccacactcatttattgatgacttgtcagtttcctaacaaattcctcatagcagcttttacatgtctcatccgtcttcctctagattctatgagatctacttctcttagaacaactttgagaaaaacataagcgaaatattccaacttcttcccctttaccctctaaatcttttgagatctttaaccttattcttttcagtctcaaaagaaaaggagaaccacgtctacccaagactaacctcttcacttatgctcctaagcccaccctggcttcctcctcagaaatgacaccgttttgaatactccctttcaccatatcttaagttttttctttttctcccagctgcttccctttgctccaaatttgctcaggactctgttacctaaagagtaacttccatttgtcctaccttctcaatatcctgactatgtttctcctcccttctctttaaattctcttgagaaatcagcccctactctctttcatactgcatttgcctcctgtggagctaacacagcttgctatattcctgttagctatagatgggcctaagctagtccctcaggttagaaacccaaagttccttgacttttctctctttttcagaatctgcttagttctacctctctcctctctttcctaagacactgctctctttatactttgccaattttcaaaaatacttcatgttttttaataccttccaaactaaccctccactaatcaggtaacccttaaaaacttctctattctaattccaatctacttaacattcactgagttccctggaccaggttatggggaaatacaatgctgactaagatattatttgagttccccaaaacacatcatacagtagatgaaacttgtaaacaaatgtaccccaaatgtctgctgtcttgacatcctcaccagtggatgggcaagacctcagcatcaccttcatgttgcaaggagttccccagtgacttatgagagtctcaaaggaaagcttcccatgagtccccaaagcagcctacgagttgtagccaacatgaggcatctttcccattcttaatctccttttctggttctagtcccccacacaggatgccagcagagccatttagatgccctgcttattccaagaacatcaatgtccatgccaagggtgctggtcccggatgctcccaaagcatcagtgttgattcctggcagagcagagaaaaggacctccatgtgccctctgggccacaccacaacaccttggccctgaagcagctctgctcctgtccaaagtctcatgcagggtcttttaaacattttcagtagcatctgaccttcactgtccctaagcatattgtctcaaatctagttttgctttggtttggttttgggtctgtggggaactattcctaccatctcatccatcctgtgctccttctccctttgcttcaccacaaactcctttctccccttccccatgtaccaatgcaaaacccccataaatataagaggcaaacagatattttagctcatccttgaaggataaataggagcttaccatgtaggaaagatgaagaaaggcattttaagcagagggaaaagcagtgcaaaaaaaaaaaaaaagcaaggcattattggaagaattacaaataattaagtaatggagaactcatagcttttattcaagactttgctacagtgtcatctcctgtgaactgttccctgacaactcccaactcttcccagttcatgattctctaaatttttgctcccatggagcacatatctctaacaattcaacatttattgagctagaaattgtgtgctaagttctaggaatatagaaataataatcagaatccctgacctcaagattatggaaaagaaaagaaaataatcttgtaattataacaaagagaaagaactgcttgcaattgcatgtataactgcaatagtgatacgagggcaatgcagaggcaagccttacactagctcaatgcccaacccaccacatcagaactaactactcatttacctgtcaggctcctctatcagatgatggacccagaggactgacagtatcttatattcccagtttccagtctagaaactggtacataaaacagacctaataaatatgccatggttcctaaggttttactaattgaattagcatggaagttagcaaatattagaatatttgaacaccagaatgaataaacaaacaaacaaataaataaatttctgtgcttgtctttgcagattggctctgttttggggcactcctttaatgcctagacaggctaccactctgccttagccttgactttcttcttgtaagcaggataaatagccgtagataaaatcttgttacataaactaattatttcaatctataaaatcaatggaacttaaacaagcgttccaggcaagggaagaacagctcctggtgagtccttaggccactgagtaagcccagactccctaccaaaaggaactgagctttaacattctagacagaaaacctccaagagaagggatggagatatgtccattcactcagtaaatattcatgggatgcttactatgtgccaggtgctgttcaagaatgttcacaatagtagacaaaacagacaaaaatctttgtctccatggagattacattctagtggagaggtgagaaaataaacaaaaacaaatatttaaattataaagtatactagatggtaagtactagatggtaaatccaaaggcagctggatgtgcaagggtggatgggggctgatggtgcaaaaagagtggtcacacttctttaaattctctgagcaggaatgtttgcattaatgactttatggaggcaaaagagtgagctgcatggatacttggagaaagtacattccagacagaaaggattgcaaatgcaaaagccctggcctgctcaaggaatagccaagggggctggagcaaagtgaacaagggggagaatataggaattaggtcaaagaaagagaaatggccagatcattttggtccttatagaccatagacatgattttgttttgctctgcttttgttactgttttaactttttaaactgaaatacaaagagaaaaactatacgaatcttaaatgtcagctcaatgaattatcataaaatgaacaaatctgtgtagccaaatacagatctagagataggacattatcagtattccaggatccttcctttatactccctcctattcaccacctctccctcctcaaaggtaaccactctcttgacttctgacagcatagatttgtctgtttatcaactttaaataaatagaatcatatatttgtattctctggtatctggacattctgctcaaaatgttgcttgtggtattcacccatgtgattcagaggaaagaggaataaagatgacaaataacagtgtgttaaaatgctgatgggaaagatgttgatgacagcaatgttcatgtgcctggaacccatatgacaattcatgaaagagagaggaagtgcaagctcacccaggagctgagcactaggactccaagagacatttccttccctattcagctcctcctataagaaataagaaaccctcagaaatgacaactttccatgctcatggattggaagaatcaacatcgttaaaatggccataccacacaaagcaatttctagattcagtgctattcctatcaaactaccaatgtcattcttcacagaattagaaaaaccattctaaaattcatatggaaccaaaaaaagagcccaaatagtcaaagcaattctaagcaaaaacaaaaaatccagagacatcacactatctgactttgaaccataccataagactatagtaaccaaaacagcatggtaccgttacacaaacagacacatagacaactggaagagaacaaaaaactcagaaataaagccacacccttacaaccatctgatttttgacaaggccaacaaaagcgagcaatggggaaaggactccctgttcaataaatggtgctggataactggctagccatatgcagaagattgaaactggacccttacctttaaccatatacgaaaattaactcaagatggatcaaatatttaaatgtaaaacctcaagctataaaaatcctagaaaaaaataggaaatacccttcttgacactggccttggcaaagaatttttggctaggtccccaaaagcaattgcaacaaaaacgaaaattgacaagtggaacctaagtaaactatagagcttctgcacagcaaaagaaactatcattaccgtaaacagacatcttacagaatgagagaaaatatttgcaaactatgtacccaacaaaaggtctaatatccagaatctataaggagcttaaaccaataagcaaaaagacgaataaccccattaaaaaatgggcaaaggacatgaacaggcacttcttaaatgaagatatacaagcactcagcaaacatgaaaaaatgctcagcatcagtaatcatcagagaaatccaaatcaaaaccacaatgaaataccatctcacaccagtcagaatggctattattaaaaagtcaaaaaaaagaacacaatagatgctggtttggtttttgatatggtttgattgtgtccccacccaaatctcatcttgaactgtagagctcccattattcccacatgtcatgggagggacctggtaggaggtaattgaatctgggggtaggtctttcctgtgctattctcatgatagtgaataagtctcatgagttctgatggttttgtaaaggggagttcccctgcacatgttctctttgcctgccaccatgtaagacgtgactttgctcctccttcaccttccaccatgcttgtgagtgccatggcctccccagccatggggaactgtgagtcaattaaacatctttcctttataaattactagtcttgagtatgtctttatcagcagtgtgaaaatggacaaataacacttttttgactttttaataatagccattctgtcagaatgacagctggaagagaacagaaaattcagaatacactaatacacttttttgtatttttgtatagccatatgcagaagattgaaactggacccttcattctttcagaatgtctattattaaaagtcaaaaaataaaaaaaaaacaggtgctaggtcccacttggtgaggttgcagagaaaaggaaacagttatacactgttattgggaaatataaattttcactgtggaaagcagtttggagatttttcaaaaaacttaaaactgagctaccattcaacccagcaatcccattactgggtatatagccaaaggaaaatagatcattataccaaaaagacacatgcacttgtatgttcatactatgctattcataatagcaaagacacagaatcaacctaggttccaatcaatgatggattggataaagaaaatttggtatatatacaccatggaatactaaccagccataaaaaagaattaaatcatgtcttttgcagtaacacgggtggagctggaggccataatcctagcacaccaacacaggaacagaaaaccaaatactacatgctctcacttataagtgggagctaaacactgagcacacatggacataaatatgggattaatagacgctgtggactactagagggggaaggaagggaacaggtaatgggttgaataactgcctattagttattatgtccactatctgggtgtgatatacccatgtaacaaatctgcacatgtacccccatatctaaaataaaagttgaaatttttaagaaaaagaagcaagagatcctgagaaggttgaggtaattgttatagttattcattcattgacccactagaacatttccacagactctactatgtgtcagacatggtgctgagtactgacatgcaaggctaattaaggcgtggtcagttagacaaacaggtgaacaaaactacaaaatagtgtaataattgctaagaatttgggaaaggatgctaaggaagcatcttctttaagaatcattgtgaccatttcaccgtttttgcttaaacattgatagttctgaataagttcacaagaatgtggccatcatgtgttactttgaaattatatttattatttctatatgtatccattttgtctcctcaataactaaactataatctttctgagagaattaaaaaaaaatcttctggtatcatgaagacagcacaaagtcactggagtcagaagacctgggtttgaatcctgactctgctattctttagctgtgcaaccctgggaaaattagttaacttttctgtagctcagttcctttatctataaatggaagtaataatatccatcctgcctgcctcacagactgtagtcagcgtcaatgaaataatatataagaagaactgactatcctataaatccctgatattagtccctgttaccagccttctaagttgcacaagcctactatgttggacacacagtaagtaatcagtaaatatcaggctttaattatgctttattagcaaagacttgcagtttttggagtctatagtttcctgtccccctcaacctaatgtccaaggacttcagaggctaggatcacaaagtatagttatgacctaggagtgaccagccagtgtaggacccagcgtggactgggccggtttcatctagactagctgcctactaaccaagagtggctgacattttgctggaggtgaagctctgggactgtgattattcatttagaaacatctcctaccctttcctactctgtcatatctctgagttttggtatcagagagctctaacagactggcagcgttaggtgaaagggtgcaggacttggcagggagatggtcaggaacatttttaaaacctttccttctgtgtttacagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagtaagtcaaaatatggggtttaattccatatggactgaaaaatatacatgtattccaatcctatgtgacttcaaatgtgcactgtcgcctagtggtaaagaatatggcatttggagtcattgagtcagtgtcaacacaatgacactgcaaagccagttaatgacagagctgaagacagagcctaagtcttgtgtcccagcccagaattacttcactccgataaaatggtcttcttcaaccagaaatgtagcagaagtaatggaagtcaaatatttatgatagtgttgccttgtgcactacatgtatttgccatgtaattctcacaaagactccatgaggtaggtacagaccttatacccttgaggcacagcctcagtcacagtgatttgcctacaagtcacagagatagtaatggtagcacttcccacataactacctgccacgacacctcccttttcacaaaggctagtctgacccagtagagtggtcagtgtacagaacagtggtctacctagaaagttatctgcaaagataggctgataatgagaaacatcctttctgtcaaggttatttaatttttaacaatattttcccccgatggctcatattaatcaccagtcaacaatctgccttcccaagattaaaaagaatgaaaatgttatcaacataaaattatggaaactataatgagatttcttatgagtcaatatcagaaaaatacctctctagcaatcagtgatattcagagatgccattaatggctttagaataatcacttagcaggagattcaagcattaaattggcaatcagaccagaaaacattaaaggccacggaaattctgtaatttttatccacttgagggcctgtagtgtctaaaattcactcagagtcctttgggttaagacatggtactcaaaaaagcactgttaaaataaaatgtctccacagacagattacatgttaacttttagtatcccctgaatatctggtaggtttatcgtgttagattagtcaaaatcatgttcttgaagaatagaacaccaaacaggtaaatgtaatgggaaagaggtgatgtctggaaaacttctatacaagcgattctaactaaaaaggaaaaatcaccctggggcaatgtattactttcctgaggctgctgaaatagaaataccataaagtaggtggcgtaacagaaattcatattctctcacagttctggaggccagaagtccaaaatcacagtgtgggcagggctgtgctccctctggaggctgtagcgggcaatctgctctttgcctctcccggcttctggttgctgtcaacactccttggttttctttggcttgtggctgcatcacaccaatctctacctccatagtcaggttgcctccttcttttctgtctgtctcaaacatccttttgcttttctcttatgggaacatttgtcattgggtttggggactatccaggttatactggataatgtcatataacataattccatctgcaaagaccctttttttccaataaggtaatattcagattctgggaattagggcgcagacagatcttttctgaggtcattattcaacccactacaggcagaatcaccctgggtgaccagtaattatcaaggcagtgtaggacactggagagaagagagactcatccaatggaaagcctgaaatgggtaccaggcttcatcacatttgctgagataatgttcctctaacattgttgagaagaccaggtatgacttatcttgtgacagccaccctcttgaggctcaatgctgatctctttcagggctttttagagtgccatctccttcaaagtcacatacacagagaactgtgtaagctacaccaggtagttttacaatagtgcaaaggaatttcaaggtataagttatataggtttgatttttaacattgatcaatctcttggtatgtgccaggatatgaatggcaaagatttgattttatgggccaataccaattaattgggagtgactgctaacatggtttggctctgtgtccccacccaaatctcatctcgaattgtaatccctacatgtcaagggagggacctggtgggtggtgatttgatcatgtgggaggtttcccccatgctgttctcatgatagtgagctctcatgaaagctgatggtattaagcgtggcacttccttgccctttctctctctctcctgctgccatgcaagacgtgacttgcttccccttgcccttccgtcatgattgtaagtttcctgaggcctccccagccatgtagaactgtgagtcaattaaacctctttcatttataaagtacctagtcttgagtagtatctttatagtatcgtgaaaacaaactaatacaactgcctagagttcagtgttaagaaaatcttgaagccatgataggtttattaattgagtcaacaatatttgttagacatggataacgtccaaggcactgttataggcacctggaatacatcagtgagcaaaacagacaaagatcactgtcctcatggagcagacattctggaagggaagtagaggaaggtaacaagcaattcacataacatataaacaagtgatacagcatgtaagaaagccctgaatggtatgaacaaaggagagattagaacagcataagaagcatcaagagtgccagggagcaggggacaattttaaaagaagtgatcagaacaggcttcattgaaaagatgacatttgagccaagacctgttggaagtgaggaagtgtgccacgcagataactggaagacacgccatccgcatagatagcaagatcccctgtgcctagactactcaagaaacaccaaggaggccaaacgtccaggagcagagtaaggggaaggtaatagaaaatgaggccagaaaggaaacaggggccacatcgcaaaaggactgagagccatcacaaagactttggcatctactctcagtgacactgaaaaccatcagaaggttttgcaaacaagtaatatgatttgacttacttgtctaaaggattcctttggctgatctgttgagagtagagttcaaggggaagggtagaagccaatgggccaattaggagaccattgcaatagtccaaacaagagttgatgctagcttggatcagggtgatagcagtggagatggtgagaagtggttacattttggacatatgttgaaggtaaagccaccaggatttcctgatgtgggagtatgagatgaagatatgaatcagcgataactccagaggttttggcctcagtgataggaaggatgcagttgtcaacaagtcagatgggtaaaactgcaggttgagaaggtttgggagagaaaaacgggagtcctttagactataccaagtttgagatatacttacacacttatatacctgtggaaatgtccttacatattcattaagtggaaaaaggtaacaagatggatttttttttcagttcagccatcaacactggatgagggagatgtgattttcatgccaaatatttgccatccctgtactaggcactgtctcatttattcctcaaaattacctgagaagtgggtattattacctggtcttacagataaggaaactgaggcttggatatagcaataatttgtccgtggtcatgtagccagtaaattacaaaattcaggtcttgactccaaatccaacacttttcccatacatgaatactctgttctggcaatatttcagtacagatactccacaactcctactcaactaagctcaaagtactactcggtctcttctaatcagagaattggagtcattctcttcctggttgggtcatctttacttcaaacctcaggccaaggctaagtcagtggccttttctgtcttgctcccatgttcccattggttcacagttacatcttactaggcaatatttcctggtctttgctctcagaaatacctacatcacatgtcatctcacatgcctagatacgccgcacttctttgctccccagaattgcttgcttgctttctcaccttattcacttcttccttccccacttctttggttctcagcattttcctttctgtcttgctgaccttctacatctgagtctctttctcactattggagccagctttagatacaataggaaccaggatccccatagattcaaattccccaaggaagtgatgcttccatcttccaccccaattaggtaattctgatagcagaggaaacaggactcttccacctggtctcttggcttctcacatcactgagttgccctcagagttcttggcttggtctccaaattgtctttacacaggggcagagtgcaaggactagaaaggaacccagggataaactggagaccagaaatataaaataaccaccccaaaactacccagctagttgatggaaacctcagtctctcccttcccacttcttctgctgactatcctgccccatactgatgtcccgcatcatttggtcatcccagaccttgctaccatcaattaggcaatataagcagagtcatttacagagtctacagaccataacacacagcaaaggtgaaatacaaaacattgaggtgaaggatatttttcacagggggttgagccaagacatttgtccttaatctggatcttttttttttctgcaaacaggacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaaggtaacagcctgcctcaggtctgagagccttgagcagctatggggtttaacgcgtcctcacatcctacgtaatttccaatacagtggcccagtgggaggcagaaaatgctgctgggaggggacagatgccctctggagctctgcatctctcagtactcccagaggactctccttccttcctctccattccccaacccctcgtccaacctactcagaacccaaaatcaaaggcctgggaatgtaggattgctttctctccctaactccactgggccccaccctcccctgcctgccacataggactcccaccccagagcctccggctatagacaaacttacctagtccccaaagatggcctagaagaggctccacggaggctccaagaacagtgggcctcacttgatgtgtctcaaatgtcatttcttttttctcttttcagatgttaaaattcaatatacagataccaaaatgattctgtttatggtttctgggatatgcatagtcttcggtttcatcatactgctgttacttgttttgaggaaaagaagaggcaggtttcctttcttcctacttgtctcttctccaaggttccagtgattgagagtttggggcctctgattcccaaggatctcttgtggaagacaggaggagggagggaggctgcaaaccctggctcagctagtccactgagataatccctgggtgtgatcttgcacctgctaatatcctgagagaaatgtcctactgggaaaagtgggaccctgtctcagggctgcttgcccttccttttgggtcccctcccaccacatcccaacactcacggggttaggggtgaaatgcctctcccactgctgtcacacatttcaattttctggttttatttttcagattccctatctttgtctactcagcgaacacagggccccggtgagcattcagactcttaactctccatcataaagcagatgggaagagccaaatggaagagagagggggatggcagagggctggataatgacagaggaaggagtcagaatgtcattactcagaccacatgctgtgaggggagatgatctgtaatcatgggtcctacatggttcacaggcataggcatgtgaaccagtcactcacacagtttctcttggtgatatcaggttcattcaccaccctgctgatggagaaactaagtcccagtgaaagggatcatcccttgtcacccagcaagtccagggcacaggcaggattagagcatccaaggcacaaaaccaaactgtctgactgcatcattactgttcagccagggtctgggcaatggatagacacagtggaaagagaaaacatgatatagaaacacaaacacaggctctggactcagattggctttgggtctcatttcatgcatgagtgatgcatgacatcacttgcagaggaaaaggcataaggtttgaagtcagaagacgtgcatttgagttgctgtttcatcactgtctgtatggctttgcacaagtcagttaagttttctgagcctccagttcctcatctccaaaataatcaaatccgctgtagagacctctgaaaagcttaataatatcccaaatgtgaaataactggctccattatgtttgccaatgaggtgtctttagcccttccataggcagggctatttggtcccaggagcttcctgacccacatgtgaagcctgagggagactctgaagctttaggggacctcaacaccaccttctaccccaagagatgtggtcagaaatagaccacatgactgagaaggttcacccagagctccaaagactgtcaagaacgaatgatccctcaggaaaggagatgcttcaaacacctgcctatctggggacacagtgtgctctggggagggagaagtcctgggagagaagtcccagagtccttgtgccattgactgtgccttcctatgttaacagcagagtccgcaaggaacctagagtatgtttcagtgtctccaacgaacaacactgtgtatgcttcagtcactcattcaaacagggtgagtcttttcagctttatatgccattgttgtcagttttacagccattgttcacaaacttgtcaccataaccatctgactgaacaaatgaccaccgaggggaggagaagacagccacagcgacaggggctgcaaagttatgcgctagaccactctggtgtctgcctttctcacccttaagggaatgtttattcataccctgccttacacagttctccaaccgcttgatgcatcagtaagtcttgtcccttcagcttaattacaagccgactgaaagtacaaattatgtcttcctctctcttgccctatatcctagcataatgatcagtaaatacttgctgaatgggtcagagttccactaagtttgaaagtttcctatggacgtagttccatagcaggtggctgacttctcactctgcatgtaggggtcttaggggagttcagaagtagtctctcaagaggggaagggggcacagtagaggccactaaaccatgagcaatggttcacccctcccctctcatctagcagcataacaggatggctggtcaagcatcagcaactcatctgtcatgtatcagcaactccccaccacccctaaataaaggacctgcaggtggcacatctctaaataataccatacattttgagaggccagttttctgaaaaataagccaggaaagcttagcattttcaaaatgatgtaagcaatgatctagctagaaatcttggattcccttcacctatatttgcaaagtatgatccttgatgacaggaagcaagaaggggtactctcacttgctcagacatttcttttgcctttgcaaattcctcctgaaaacaagtcaactcacactctgacaaatcaaaaaactaatttcccacaaattggttagctttctctttagcaaaaagaaaaaaaaaatgtgctttggagagtttgaggtttttttgttttttgttggtttgttttttgttttttggtttttttttttttttgagacagagtgtcactctgtcaccaagggctgagtgcagtagcacaatcacagctcactgcagcctcaacctcctcatgctcaggtgatccttttaccttggcctcccaagtagctgcgactacaggcgagcaccatcacatcaggataatttttctactttttgtagagacggggtttcaccatgttgcccaggctggtctcaaacttctgcgctcaagtgatccgcctgcctcgtcctcccaaagtgttgggtttacaggcatgagccactgtgcccagtagagatcttgataattctctaaatacttcttcattaatttaaagtgtcaaaatctttgagtaggttctttgagggccgtagggacttctgctattatttctgtaatgtgcattccaggcagagccattcttaaggccaagtgttcctattctaccaattccccatgcttgagaagaccccaatgacatgatgacaaggcagttagaattatagcaaaagatggagcaggcaaaatgggtagtttcagtcatagctagtaaaaatttgagacaaaacatataataaactatctggtatataagttttttcttaaaaatggaggaaggaaagtagagctggacaaaggacaagaatacttccttcccttcatacagcaaggctgcctttctctggctcttgagcccattggtttgctgcagtgttgctgttctgtttggggctcaggaaatgccactaaatcctcacaagtttgatagctagtcgtgcttggtcttccactgaacattccccagccttcctctggaagaactttgacatattctcttttttgtcacacagtctttcctaagaatatatctatgcattaatctctttgtctctgtgtaagccaaattggtatgattctttttacaggaaacagaaatctggacacctagagaaaatgatactatcacaatttactccacaattaatcattccaaagaggtaagcccacgattgctccatgtttttatattcttacctctctccacagacctatgatttttcaaataaagtaaaaataaaagggtcattttacagatgcacaaacagcagcagcatgcggaaagtctcaggacatcaccaaaacataatcaagaagttattttgtattaggatcaccatgcataactgagttttcaattacatgtttttaaatttaatcctgccctatgctatcaatatctctattatctgcctctctgtagtctccagtcctctctctgtagttatgaggggtgggctgaggttccagttccaattaacctacctcatcttcctctttttcccacagagtaaacccactttttccagggcaactgcccttgacaatgtcgtgtaagttgctgaaaggcctcagaggaattcgggaatgacacgtcttctgatcccatgagacagaacaaagaacaggaagcttggttcctgttgttcctggcaacagaatttgaatatctaggataggatgatcacctccagtccttcggacttaaacctgcctacctgagtcaaacacctaaggataacatcatttccagcatgtggttcaaataatattttccaatccacttcaggccaaaacatgctaaagataacacaccagcacattgactctctctttgataactaagcaaatggaattatggttgacagagagtttatgatccagaagacaaccacttctctccttttagaaagcagcaggattgacttattgagaaataatgcagtgtgttggttacatgtgtagtctctggagttggatgggcccatcctgatacaagttgagcatcccttgtctgaaatgcttgggattagaaatgtttcagatttcaattttttttcagattttggaatatttgcattatatttagcggttgagtatccaaatccaaaaatccaaaattcaaaatgctccaataagcatttcccttgagtttcattgatgtcgatgcagtgctcaaaatctcagattttggagcattttggatattggatttttggatttgggatgctcaacttgtacaatgtttattagacacatctcctgggacatactgcctaaccttttggagccttagtctcccagactgaaaaaggaagaggatggtattacatcagctccattgtttgagccaagaatctaagtcatccctgactccagtgtctttgtcaccaggccctttggactctacctcagaaatatttcttggaccttccacttctcctccaactccttgaccaccatcctgtatccaaccatcaccacctctaacctgaatcctaccttaagatcagaacagttgtcctcacttttgttcttgtccctctccaacccactctccacaagatggccagagtaatgtttttaatataaattggatccttcagtttcctgcttaaaaccctgcaggtttcccaatgcactcagaaagaaatccagtttccatggccctggatggtctggcccacctccagcctcagctagcattacccttctgacactctctatgtagcctccctgatcttctttcagctcctctattaaaggaaaagttctttatgttaattatttacatcttcctgcaggcccttcctctgcctgctggggtcctcctattctttaggtttaattttaaatatgtcacctcctaagagaaaccttcccagaccactctttctaaaatgaatcttctaggctgggcatggtggctcacacctgtaatcccagtactttgggaggccaaggggggagatcacttgaggtcaggagttcaagaccagcctggccaacttggtgaaaccccgtctttactaaaaatacaaaaaaattagccaggcgtggtggtgcacccctaaaatcccagctacttgagagactgaggcaggagaatcgcttgaacccaggaggtggaggttccagtgagccaaaatcatgccaatgtattccagtctgggtgacagagtgagactctgtctcaaaaaataaataaataaaataaaatgaaatagatcttattattctgttacaccttctatgtcatttatcatatcattaaatatttatttttacttttttaacatctatttctcccactataccctaagctcttcagaaacagagacaataactgttttgtttatcaccgtaaccctagcacctaacacagtatctagcatatagcaagtgttcaaaaaaattttttaataaataaatgaatatgtaatggggttttgtgaaaatgaaataagacaatacacctggagtccttagcatagctctcagccacataaaggagctcaataaatgtcagtcagcattgttggtataattactgatacaattagtataaattaataatagtaaaaattaattattactgaattacacagaatcatctcacaaaccttcagcacaacaagacgtgacagagatcagctctcaagaccacaggattcaaagggaaggggttggagagttggaatggggaaaaactgaaataatggctgaaaagaatagaaaaaaacaaagctcatcaaagttaattaatctcaaataccagccatcaattacagtattagtcagtggagtaggacaagatagggaagcttaatcaagaagaaggaagagtttccaaggaataggttctgggttcatggagacttcaaagaaaagagtaaaaagagggttactgccatgttcgtgcaacatgacctgaagctcaggaaatctcactgggcaggtaagagagtgctttcctttcaaggggacccaaaaaaaaaaaaaaaaaaaaaaaaaaaaaaaaaaatatatatatatatatatatatatatatatatatatatataaagctttttttgtgtgtgtggaaactttgaagaattccaaggttcttcagagagggaaaaggaataatctgtaaagtcagtgcagatagaaaaatatttgcaacatctagggtgcccaaaaccagcaagaaaattaggggatatgtcatggaaggcacaactaatccatctagtcagaaatctaccagaatctaccctgaatctggactgcactggggaggatcacaaacaaaacaaaaactaagggcgtatctatagacatctaagaggtgagtaagaaaagaactcataagaaagctaagctcacttgtctttatagaccagctactaaaacatagaattcctgatgttatatttctttcaatctcttcaaccttctccctttttatcataaataccacactctcttctcttggcttctgtgacactacattccccgagttttactccttccttcctagctgcttctcaggctctttgcagatccactgcctcctccacaggaccagtaaagactgaagctaaggctcacatgtgggtcccattcacttctccatctaagtactcttcttatctgatgtcagccattcctattgccttaatagcctttataagctaatggttcccaaacacatctttagtcctgacctcctggcttacctcattaactgcctacttggcatcaccatttgcatatctggtagatatatcaaagttttttaaaaaataaaaactcttgggcagatgtggtggctcatgcctgtaatcccagcactttgggaggccgaggcaggtggctcacttgaagtcaggagttcgagaccagtctggccaacatggtgaaacccggtctctactaaaaatacaaaaattagccgggtgtgatgttgggtgcctgtaatcccaggtactcaggaggctgaggcaggagaatcacttgaaaccaggaggcggaggttgcagtgagccaagatcatgccactgcactccagcctgggcaacagagtgagacactgtcaaaaaaaaaaatcaaacctcttgatttctcttatcaagccttttcttctactatgctttttcatatcagtaaatggtatcattgttatgggacactcttgaacagatctcctttacaaaactgaaaactacccagtactcaccatataactaatcatttttgttttcttgtgggaaacaaatggatttaatcaacaaaaacctaatctattgttctaaagttaaatacattaagacccagatgccccattcctaaaagatgaatcatgcattttgcaagcagggaagaaaacatgcaatgcttataaaattcctaccaaaaaacaaactttctttgcccaggaggtaagcttgttctttaatatttttattgtagaattaaggaaatggtagccccattaaactactttgaataaggtaagatggctgtgattggctatcctggaaaggtaataaaagggaatagaaatactcttcccactctgccagcccccagtcattcccactaggaggtcacaaagtgttgacaaggcctacaagacccctactcacatctctactccttctttcacagcattccagccacactgttctttattcagctcctagaataatctagactctccttcctacttctgtgccttatggatactgggaccacatccctatgaggcaacaattagctggtgctgagtagcctctgttctattctaaatggggcttgcacttcacatttcactcctggcctgccctgcctgcttcactcacttaagatacctacctagtactgaaaatagttaagtttccaacctcttacctacaccatgaagctttgccccacatcatgttggtcaaaagagcacattaactagtcccaaaataacaatgtctgatctcacttgtccacaccccatcccaccctcaagccaacacctgaaccccgtgtagctttaggacacttacttgaagctttcatcatttagcctccctcagggttcagtgtatactttgatatgaggaagcagggccacagctagatgcagaacagagagaaggctaccctgtccaaggtcactggatagacatttcaccctgagtttcaagttgatgaaaagaatggactaagaagtgacttctcaaatggggagggagcaagtctgaccccctgaatttccccttcccagaggccatctaaaagcactctctgtgggaagaaaggaaggggacatcatcactgaccttttactaccagacgactagaatggccacatccaaagcttttgcttcctcacccctagcccactcttctgaagctgcattcttgaaggataccaacctctagaggcagggatcttttctctgcattctggtgctctctgcagcatttgacattacacaatccccccatcacccttgaggtttccctccttttaatgcccattaagtcacctcatcctacttttgtctttctgtctcctccttacctctccttagcttggtttctcttattatttatgtcccataattagatttgtttccctaggttctgctgactggatattttcctggatgtctcgtaatcaccttaaattctgtttttcattctccctttgacttctaatgacccaaggaaagtagaacatccctctcaggatccaacaacaatccaaaacacaaggtgaattcatggcaacttaaaacacaaggtgaattcatggcaatttaagacacaggaggaaatagaggggcagccaagatggccgaataggaacagctccagtctacagctcacagcgtgagcaatgcagaagacaggtgatttctgcatttccaactgaggtaccgggttcatctcactgggtagtgctggacagtgggtgcaggacagtgggtgcagcgcaccgtgcatgagccaaagcagggcgaggcatggcctcacccaggaagtacaaggggtcagggaattccctttcctagtcaaagaaaggggtgacagacggcacctggaaaatcgggtcactcccaccctaatactgcacttttccaacgggcttaacaaaccgcacaccaggagattatatcccacacatggtttggacggtcctacgcccacagagcctcactcattgctatcacagcagtctgagatcaaactgcaaggtggcagtaaggctgggggaggtgtgcccaccattgccgaggcttgagtaagtaaacaaagcagccaggaagctcgaactgggtggagcccaccacagctcaaaaaggcctgcctgcctctgtatgctccacctctgggggcatggcacagacaaacaaaaggcagcagtaacctctgcagacttaaatgtccctgtctgacagctttgaagagaatagtggttctcccagcatgcagcgtgtgatctgaaaacaggcagactgcctcctcaagtgggtccctgacccctgagtagcctaactgggaggcactcccccagtaggggcagactgacacctcacacggctgggtactcctctaacacaaaactttcagaggaacaatcaagcagcagcaattgcggttcaccaatatctgctgttctgcagccaccactgctgatacccaggaaaacagggtctggagcggacctccagcaaactccaacagacctgcagctgagggtcctgactgttagaaggaaaactaacaaacagaaaggacatccacaccaaaaacccatctgtacatcaccatcatcaaagaccaaaggtagataaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1487 - DNA, 527 bp, Homo sapiens
acagaagggcaaaaacattgactgcctcaaggtctcaagcaccagtcttcaccgcggaaagcatgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaacagagtccgcaaggaacctagagtatgtttcagtgtctccaacgaacaacactgtgtatgcttcagtcactcattcaaacagg

SEQ ID NO: 1488 - protein, 175 aa, Homo sapiens
RRAKTLTASRSQAPVFTAESMLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILTESARNLEYVSVSPTNNTVYASVTHSNR

SEQ ID NO: 1489 - DNA, 32237 bp, Mus musculus
  misc_feature (1)...(32237): n = A,T,C or G
gagagaaagagagagagagcaagagagcgaggagagagagaaacaaaaaaaacccaaacgaattgttaaaattctcctctcccaaagtcaagataagaattagggcaactgacgttggagcagaacaaaggattaaaaaagtacagtcacacttgcaggcgggactagcttccgtgttgtgcatacgtgggtgtttacttgagtctggtatacagacacattgcaacttacttattttgacctgttcccacggagtcagagcacctcacgcttacattacccaatggattttcccaacactctcattatgctgatattatgaaacttgcatggaaatcaactcaaaggttaagtgacttacccaaaggtacacaagaggagtggaggcgaggcgtgcatgccttccaactcactctctccacagattagaaggctgaaagcacttttgagtaagtttctaaaaccctggggaggacttcgaccctggagttattgcacactgtgctaaacactgtcttgaaaaggctgaattaattaaaatgaataaaataatgaaaaagaaaaaagcaattcgtacagagttgaggtgagttccaaacacattaactgccttagttctgctccagcatagacataagagaagatttggcattttgagaatgaccatggttagttttctctagaaactgaagatagttataaaatgccctcagtggtataaaagatgccctttatcctattggcacaggtgtacgttgtgcgttttgtgactctttgtttcttagacttgtgagtatatattggcttgtctctttttttccttttgaatgtgttcacatcgaaagcatcagacagtcagataagagaaaaagaatgctattctgtgctcccctcccactttgctgtgttttattaagctgcttatttatcatacggtgttcactgaaactttaaaagaagcctttttgttgtgatacttcagccactcagcataatggctcaggaaatagatcaaaatagccaaggaaaatattttaaatatggcagctgtagttgaagtttgggaaataaatctttgagaacaataatttattcacttgagctgttgtttcagcaaagtatttcatcttagtttcagaatagttgctattcattactaaatatgtttaaaaatcaaagcagagaaattgatttcattctttccagacatcctaaaaaatactcaggtgttaaagttgggtgctgtatcggtaaaagcaatcagatagggattgtggctatgtggttaattaaaggtagtaggcgccttcggggtaactttgcatcatggacttatggaggacttcacactgtagggacaataacgtggcgctccttccgaatgtgcacagtgctgtcctacaaagacatcaagatgtgtaggaagtcaaccctcctgcagtcctgccaagccagactgaccccggcaaatgaaaataatcaaaagtaattagaagcgtgctggatgactcctccgagagccgagcgggagagtaaacacgcccgaatcctcgagccactgcaaaggcccatgtctgagctgttaggtgccctgaccttgtccacataaagatgtgatttatgaagtgcagggcacagcagcagggcttctgtcttctcctggagaaccaaattactgaggcggagattaacatggcttcagtggagcctgtttccagaccaggggaaattttttatttacctttttttttttttaaacctttaatttcctttctgtctgtctgtcttttctttttttctctctccttttcttttctcttctttccctttcttttctttcttcctttctgcagcaccgtattggtcaacttaagaaaaggaaaaataaataaatacaaaggaagaaaggcagagagtccctcagaaatgacccaggatctctctggagagccatgctgacaggatgctctgggggtgcagtccctttgtgcctatagcttggtgtttggctgggcagactgcaagtctgcctaccagtatcccagaattcaagttcaagtttgtgacatacttccctgataaagcagcataaataattaaagtcaaatggaacattcgtcacatcggctcccttggctttctgatctagtttctgcacctgtgcattgaattttattcaaatttcatggaacaaaaagatttaaaagatctgataggtggtaagaatttggaggagtcggagggaaggaaaatggggtagcaattgtagaggaatcagcgacacatctcttgagtcccaaaataatactgaaattttcttacctgtgtctcacttaagcttaggtgaaagtctgaccacttcccacattgccactgtgccgtggagagaaagcattgattttctttttaaacacacatcaatatctatacacaaagctaatttaattagcaagcagttattgttcagccaaatgtcaatttctcaaattatttcatgcttcccaactgtatgaacggtatgaagcaggatttcacagatagtctgtgaaggagagactgcatatgagatgcccccccccaaaaaaaaaacaaaaaacaaaaaacaaacccatacatttgcttggtgttagaagaaaaaaaaaaagtcagacttggagttcaatggctgcttagccaccccaagaacccagagctgcagaattaaaaagactatacttaggctgaggttataaagggccttcctctataaactcaaaacataatgtcagggtgaatgggagcctactttattaactttatggtattgaaaactgccagcaagttgtcttgtttttaaataccgtcctctgcagagtgttacagggccgtttgtccacaggaagccattaaaagtggacagtgcagtcatttcatctggctttctgtggactgcttttctttcttttaatgatgtgctggcatgtaccatgcccatagggcctccattagctggactcttgcttctgggacaaccctgaagtttaaggcttaaaagaggcatcggtttacagtcctgtgggaatcacttggatactggggcgctgacttattaccgctttaactaatatattgacttattttaaataaacagttataccatgaaggcagaacccatggccttattggaaatctttgggccttttaaagattctgcagtccttgcagcctagggaggaagggaaaggattgcggagggtttatacccatttcaaacctggaagaaaatgcattaacccctcccaccccagcctggccatcaaccagtgtgtgactcctagaaaatctacccactctgctcaaactgagaatttcccaatgttgtcttcttggtaaacaacaattaagagcaataaagaaaagaagcgtgccatggctagtactgaaaagcggtttaaaagtatgattatttaagaaaaaaaaatctgatcgctactctgtaaaaatctgatcgctactctgttgcatgcattctcaaagccatacattgcttaaagccgcctcctgccttccactaccctggtagttagatcaactttcctgatccgggcttgcaaactaaagctggttcgagattaaggtaaaaccattatttgtaatagtctattgcaagggcggtgctaaactctgcagaacaggcgtattcctgatcactgtggagcagaaagcagctttgcagtggcttaatttgtagctggtaactactgtaaacagatttctctagaaatccaaggagtaaagggagttggtggatttggctccttgtatttatttattgttttagaaggctcctaactaacgggaagcaagcttacagggaagcaaagcacactccttgcaaaactctgccctctacccttgtttgagcctgtttttcttcggatggggtagatctcctaatgggttactattggagagaggcagggaggagcgctctatcacttattgtgagattgtgggactttttctctaaatttcaagttatgttaagacaaagcaggatggctgtcatcatgtgaagttcctgcctcatatgcaaaagaagacggtgttgggaggaggtgaggggagtggggaccaggaagctgctgttagactttcttcgcccagatagatgcttgtgataatgccgtgtaatctttcctgcagtttatctgttgtacaagagtgagaatcacagcaccaatattgatactatttaataagagacacatattaaacggatagcggtaatgttagaatggatcctcgctgtctttagacacatctctcaaggtctcagggaggaaattaaggaaattcagaggtaggagcatcctccactcaggcagtttcccagggtctgtgtctgtgagacctggaggctgcaaccaggctgtcagatcctggtgggttcacctaggtctttgaggctgcaggcactgtactttatttcgggatacatcgccacctaacggcctccagccgtacctgcaagaataccatctagacccgtcgccccgcctcccacaccagaagctaatgtaagtggggagaaaacaaaacaaaacaaacaaaaacaacaaaaacctcaaaggtttttttttttcccctgaaatgtgaatttagttaggacctgtcactgatttcccaggacctttgtgtcgccaccaacctttcctgcttttctgagaagctttgaaaaaggttaggcagtgggtgctgcaaggccagggtggggtggagtaggggcttggaatggtttggggcactgagcacccagatcccctgatcaagctgaagtgtctgaagcactcagttccccagattacttgtatttaatacacaatgcatcataaaacaaatctctcatcctgacaggaagaaaatagaacagctcatagctccagctattccaatttatggctaaattaaaaaaaaaaaaaaaagtaaaagaaaaagagcacttcaacaatgggcaagttgaggaagggcctaagatcaatgcagggaagcccagactcctcatgattctcaggcagggctctatgggaatatctcaatgcttaggttatttacaaaggatttttcccctgtcttacctaccactgctgtgagatctcccccccccaaacaatggccattatctgaaataacagttcagtgtcatagataacaggccaccaaaatgaattagtcaccacctctagtcatttactgtcacccgcttccttgtcttctgacactatttttgtttttcgatcagcattttggggaaaataaagatctactggattttcacattaacttgcccttggagagaaagaaatgtgggtggtactgtgagtcctgattcatagataaaagtttaatgtcagcacacattctaagcctgtgagctggctccacccctcccaagtacctgttcctagacctaggcattttactaaattttccattgttgagttgagaataaattggatctgagggctggcgatttagctcagaggcagttctcttgcctagtgggggttgggggtggttgtcctggaggtgtttctgtcttctcttggtgggtaggtgagctgtatctttctatttgcttttataaatggagttttctcatcaaaagcatttattctcaattaagcggtgggtttaacatttttttttccaaatttatctacaaataaacacatggattcttatattttgccatcctctatccaaattctttcacccaatgtcatctctgcattgtattgatagaaagtgcccaaacttattataaagttatctaatatataaaatatgaatcactaaaagcaaccacttgcataacttgactctggggaagtcatggccttttgaataacttagaaaatattctcaatctactacaatctatttgtgagagagatatgaaaataatgctttagattttaagatttgttcttgtgtgtgtgtgtgtgtgtgtgtgtgtgtgtgtgtgtgtgtaggggtatttttaaaatgtacacatttctggggacctaactataaaaaggaaaggaataaatttaagtagaaacttaaattatattttattttaaaatatgcttaactggaaactggaaatgtgtgttagttttcacttttgaagctgctgtcttgagacttttaatgcgagccagtatctctttatcctaagagttgccctggccctcttcagagcttccaaactaccagcctgcctggggaggcaccctcacacccctgaaagcaattctccaccctatctttcccatcccccacccaactctaacacagactctctctctctctctctctctctctctctctctctctctctcacacacacacacacacacacacacacacacacacacacacacacacacccttgtgctcaggacatcaaaaccaaagagatttccctggggaaacaaatcctgcctggagaaatttccccattggttgtttatcggcagaaatctacatgtttctggggatggtgcatctataatcagtctgtccctataggacttgggtcttggcgacctttttgtgacctctcccgccagaggaggctgctgtcactttaaaaatttactgaaagaggagcccgtcgtctggcttccgaccactctggagatagctccctttctccctcgccccggtttctttctggatggccgagcagatcccctttaaagagacagttcatgaaatagaaaccctgcggctgggcgcggagtggctaaaggggacgagccggtgagggtctggccccgagaaggctctgggaggacctggggggccgtcctggcctggcaggccccctaccttcgcacactttcctcctgcgggtcttgcccctggagctgcgacagaggagtgggagaagttttagtaggtttcagataactttcattacacatcgggctgataagagcaagagaaagtgaggaaagagggaggtagtgagaccagaaggaatagctgcgagctcatttaggaagaggggaaaaacccaaatacaccaaacccggctcaattctggtcttaaaacactgttggcggacaataaatccgaaacgcgtggtcctggcgatcagctcccaggggaacgacaaacttatcagacacccatttggaagtggagacacgaggcttttattttaaaacaatttttttttcttttaaaatatctcgaaatgttagcgggtgttctttgaaaagattttccaactcgagtacctggctgctgctgatcttatttttgtttaattctgctgtgattgcttttgattgctgagttgaggccgtagaaatcggaaggtaagcgaactcactttaaaaagtcttggctgtgggcagggtgtcgctggggacagcgtctgcgtcccgggtttgcgctgaggtccccgtgcccccggagcgtccctggtcgctgggactccgccgcctcgggtgggtcagcccggctggctgccgccttctcggctctcgcgtcctccttcccctccctcctacgttcagtcggtcaggttcggggacgcagaaggtggggttgccaaaagtcagaattcctggcaccagccaagcgactttggaagtggctttcggtggagtctcaccttgccaagtaacagcttcactggccaactgcgtgtgttgccttgagaaagtcacattcggacttttggcttacagtctgggattttccccccttttcgtttgggtatttattctatttttttttttttttgaaagggcctttttctcaagtccacctaaagaaattattattgttgttattttgaagcttaacagcttttgaaaaggcaggactgtgttagccggagaagggagaagatgcgctgtttatcttactcagatttgaggtgactgagacatttggacacacatgaagtcgtggtagcaaataacttggacaacttgcccggagtggagacagtcaggcagccttggggcaggaatattgagagcaaggaatcagtatggtggtgaaacctttgaataatcgtgtaacattatgttaaaaaaaaaagagagagacattctttggaaatgatttttttttaattagcctccctgttgacagtggcagcagcagggatgttaacacgaaataaaattacacctataattttatgtgcacagtatgtaatctttaattccctacctctgcttgaaagctgagcggggtggaggattcctgactttgaaatgaacgagttttccatgtctttctgcagcatatgatgagaccagggaagcatttaagcggcttcaccagtttcctttattaaatatttctttggtgtgtcagttgacatgcctccccaccccttttcttctcagtcaagaaaacaaacgatacaccccaaatcagaataaattcccaaacaaaacaacaatcccacttaaagaagagcagcagactttagaatctgtgctaattattcactctgtttctgggactgggagagatctcagggccatttgcattgctcagccttgagagctgaaggaacatcttagagcctggaattttataagtaacgtatttgttaaaatgtgtcttccatagaaagggtatttaactctctgttagtgtggagagatggaaggagggggagggagcaattattgtctttctcttccgttattgtttttctttttaaagtcctgcaacgacttactgccctttgagggcctcatggtcaaggacttattcatagtgctttagcctggaacgctcagaaccgagttcttgaagtttatggtgagttaatgacttgaatctgcaagtggatggttattggagttctatgtaaaactgctttcgggccatataaccaagggtttcatgttaacttccaggcagtatagtatagcaggaacagagttcaagggttatttaagtcattagtttttgttgtagactatgctatttcgtctggagcagaaagcgtcctcacagtttgcatgaactgactgacatagcattaccagcccctagttctccaccatgggctcaatgacgccatagcttttaatattaagtcatcgaggttaatgattcagaaaaggcttgatttgagtatatgaaaccttaaaattaaaagcttcccgtctcactttaggtttcctaagtgtccttagtaatattaacatttcaaatgggccaagcacaagttgtctgtaatgataaaacattgtcataaggcaatactggcagtatgtgatgacatctaccaattttggacttacctgtaaaccactttgttattctgtttgctgtatgtggcatgaaaacatgtattggtgttggttaactaagtcttaggttatactttgcatgtatgttcatatttatataaatttcattttcttttctttattttggttagaagcatctatgaggcagttctttagctaagagtataattttatggtgaggaaatacaaactaataaatgaaatttaataatagttatatgaaagtttttaatcgaattaaaatgacaaaatatgtataaaccttcacccacttatagaagagactatagagagctacagtattgacagttgaattatccaaacctaaatattgaatgtttagtttagaaatattatgttctacatgctgctctatatgacttttctgtaaaaacacaatgaataaaattaagttaatgagttttttcatggataataaagaagcaggcttattttgaaaccaattaatcagtttttgtgctgttacgattgctttatgtcttttgtaaacgcagcataacttatgtctcctttaatattatgtgtgctgcctgacctttttcttgtaaagattcaaaggaagaatatgcatttcaatgaaatattttcaaggaactggctacttgctgcaatggaccgatatggcaatttattgttctcttcttcttcctcccagatcttagatgagttttgcaatgtgaagttctgcatagatgccagtcaaccagatgtaggaagctggctcaagtacatcagattcgctggctgctatgatcagcacaaccttgttgcatgccagataaatgatcaggtatgttgtaaagattttcttgcctttctttgagagcactaacgtatcagggaagcctgaagagtaaaaataacagggagctgcagcagacccatgtggcctgtttgttgataacggcagaaggtaacacacaagtccaagatgcagaacgaagacatattcagctctgcttgttttcacggatgttttctttgggtgattattcatgttgtcttagcatctttataaatactgcagttgttgtattgtgaccctaagttcttctttgatacttactgttacattttttttctttatcatccaaatggatacattcataggatgtatagagctaaaacagtttgagaatttgtacagaatttgtaaatgatatgtgaatagttttagttttatttgaaatggtagatgtatatgtctgttattggtgtcgacttatcaattatacattatagaatacataattatagttaattttctaagtcagcataataaaatgagatttttttttttactctttgaatagtcaaaatacttttcctttatataatgtataagtttaaagttttcacgattggagaattttgtgactttatggatgatcaagcagtgagactttaagaaaagtaactatgaaatacaaaccgtaatatcatcataaaactaattttacacttaatagaatttcaagtctttgaactttgagagtacctacagaatgggaagcctcatcctgttgattttcttcttacaaacatcactgggttaaaatgtaattgtgttacagtcatctagtgtttttaaccccatggtgacttaaacatgtttctaagaccatgtagaaatggttgtttggcagcccacaacaccagaaaaaggaaagtttaaattagctggttctgaatgaaagctgtgtagcatcatgagcccaagagtctcagtcatcgttaggaggttgctctttggcatctcaccagctctcagataattcttactggctaaacgaaacatgaggtagtaagttgtaaaattacatttaaataggaatcacttaaattgtcagcataatcaaaaataataaactcatcaattgagtttttccctttgctgtaagagaacaaagtgttattgacaaatgaaaatattattaaattagttattgattttgaacagaacatatcccaagtctgtcttaggagttattgtcaccaccagcagcaaatattttttgagcacctactgtttagaagtatgggaaatggttaggtgttatgagggggtaaaatgtttttgctgtgttttctagtaaagaaagtgtaggacctcaaaagatacctttaagatgaaataatataattacatattatgtatatatatatacatatatatcataatgattatttgctgttcatatttactaaaaatggatatgtttcagtatttatctaaaacaattttatagtcagtgaaaagatggctcaagaaggctacttgtagctaatacaaggccacatgtagccaattttgaatttgacttttatgttttataataaagtcttttgcaaagcttaattgcattgaaaaaaagtcccatggttcctgactatgtatgaataaggttgctcattacagttgtcacttgtaattagcttgagagtacacattgtgtaggcattgtttccaaagaaaatacattaaccttctctcaagaacatcatgtttacttgttttaactgaagaagtagcaaaagtaattgagagagacactgaacactgattttaggttcatatttatcatttcttagaactattcactttaagcctctgtggcacacaagccaaaattaagatgataacacagtgaatgtacatcaaataacacaatgatgaaactgatatttcatggtcaagtaggctcatccataaacaggagagaaagtcaaaggtgagagacacatgtgtgtggcaggtatggctctgtagaatgttatactgggcccagctaacagaacaaagggggacaagcaccttgatactgtgcacaggtagattataaactcctttactaataagctcataaagcagtccaggaagacaatttagatggacatctctggacagctttgacatgtgatgttagatcaggtacaatgagacagtgctgacaacagagactctccaggtctatcgctgcatgttcttttccatggtaggggctgccaaatggtgaatagacacagttcatcacatcataaacacactcatttactaccaagacatcaagggacgccctgcacaggggaccgactgctcagtgacatcaaccattcctgcacagcacaaacctgtaatattctagaataagtcataaaaatggtcctttttgctctgattcttagaaggattttaagtttttaaaagaattatgatagcacagtaggtaaatattgtaggctcttaaagaactgcaggtaaacctttcagctctgatctaagtctggtgctctgtagatggcccagtaaacaaaagtaatggttatcctgaacaaatgaagggcgtgtatactacattctgttttggtgaatatatatattcaaaaacgttctaatgtttaagttaaagtttaatggatttaaatcagcttcactcttgtatgaaaggagaagatctacaaaagaaaataaatatgcatgccataatgctgaaattgagagtaggaaactgtcaaaacatgcgtcctggatcaaacccatgcttgccttgtttgattggtggattttgttttttgagtaatgctaataatgaatgtaatctgatttgtgtcataaaatagaaacagggaccacacaattaaccatttcccactacttttccataagcactttatcccaagtgattttccttggtttaaactttttaacagattcagatgtgtgtgtgtgtgtgtgtgtgtgtgtgtgtgtgtgtgtgtgtgtgttttactttcagatattttcataccagagtgagccttaaaaagatagtgtctttttttgacactgttgcctagaaaagactgaggtcttatgattttagatggccttttatttcacattctcagagttattgctgtgatgtttgagaggatggaaattctgggtgtgctggcattgctgctaaaacataatttctaagtagctgtgagcctgactgatgttgtattctccaactggaagtacagagttaactgtagtaatttatctttatgaaggaaggccacaccaaagacaccaggggagtgagacctcaatcacagacaacccatagaataccacgaccattcaaacatccacgtgtcctgcctcttggtgtctagattgttttcccatgttccttaaagtttgtattcaacagcacatagcttcactgctgacacccagtattgagctgggacatcttcacagtgacagacaatgagtggacacattagagagcttgggtggcttacagaagcagcaactggttctgagcagtagggcggggcagcagcaaaggcaggagttaagttggatactggaagttgtcccaacctcagtcctcaaggggaccaaacacagaaaggacacctgaaagagctttatcaattgttcagagatttttctttatctccaggagctcctcccattactacatagttaaagtcaaatagtccagacatctaatgatttgctcaggcttttaaaatttcttgttatgataatacctttctcttgaagtcttacatagctcccctttacaaaccagtttgattggaataagtagcacatttctttagacttggtctcatcttacctgtgcatctctctccatccttgataaatctcctcttaatcttacctttctatattctttacctaaaatcaaaggcatgcctacctacagggtattattgtccacaagcaatgcttttcttatcatcgttgaatatagccacaagttttgtgtacttttttttttttaccctgaagcatctttcttcccccccacccccgaaaactcagactctttgaatttccctgagagaggccattaatactcagtacacataagttgatctttcagatgaaaaccaagccagtctttctattatggtgatcagaatgacctaggcatattctgtaggatgttttgtctgtctgtgtgtgtgtgtgtgtgtgtgtgtgtgtgtgtgtgtgtgtattaggattctgcatcatggaaaggaacatagtcatttgaattctctcctgccctcacatgggcctcaaatgtaggaaagctctcaggcagccaaggtattgttaaccttgtcatttacccaaagtgataagtactttcatttttaaactggctcctgtcagctgggatttagaatgagagaagtctactgttgcctctcaatcaaaagaaacacgttaataagagattacccaatgcctgttgtccattctgaagcaacgagatatagaagaatgtgtgccccacaaagaatacgaaggcagaattcacttaggcgatcctgccagctccctggtggttaatgaatggcagcaagactctgcagtgttttcagttggaatgggcattgttctcatttgtgctttaccttataaacttttaactgcttccaggacgatcatggttgatttggcacacccgcttccactctgctcaggctcatatgagtgatgctatcggactgcctgacactagaacagtgttgttattgcaagcttattatgggctcaattattaacttattttctttggccttttactgaggagaggaaaatccactttccttcaacattcacttaatatacacggtgcaaaaacaatgaggccaaaagctccgagtgtagagaacggcaagctccctcggctccccccactttgtagaatatgtttgcctccactgtcaggtaatttgttaatttctcctccactacaaggatttctgtccacgttccctatgctttcttttgatgttaaagttattattggctttgggcatttgctttgctttgcttttaagtcaaatcctacttttataccaaagttgtactctgctgttttaagatgaatgccagctggcagtacccagggaccagctttgagtgcagcgtgcgagctgaccctggaggatgctatctgcctgataagttgcttcctttaccctaagatgaaactgcctcggacatagtttgctgtttgatatttgcatgagaaaaacagtcccacctcccttcctgtctataatgctcagaccatgatggggcacaatacatacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtaagccctttccttacacaggcaccttccttgtgggccctgtgggggagatcctgagacattagttcagatattggtgcaggcttctacactgggtaaacagctctaaaggcacactaagtggctcttcagctcttttctttttatagaaactaaacccgaaatcaaatttgtcttctttaattcattaaattatatttggctgttttctcatagtattaataatgagttgagaatgcatagaagaaaaaaaaaacttcaatgatgttttctactggatgtttttaaaagagggaaaccccactttgtctcgtgtgtgtgtgtgtgtgtgtgtgtgtgtgtgtgtgtgtgtgtgtgtgtgtgtgtattaatgcaattatttattttaggcacatggattgacctcagggcttcatacatgccaggcaagcttgaggacacaaggctacctctatccattccaatcccctatgtcttgatttttctctgtggctataaagatagatgcagaacaccttctgtttggagaaactaaagggtgtatggcttatgcaaggcttaaccatgataaagctaacattctgttgggagggcttatttcctggctgcccatgtctgtcttccaaagatgcttctctgcctccctgtaaaattagactcagaatgtacactgggatctttttatccagaggtcaaaagcttgacttcactatagctttcttgagttagggtttctcacattgctctaggggtagatgaggggtctaggctgtgcttcttgggatggtcaagtgtatatacatatggtgtatgagcccaggctgtctctgcagcaccaagactgagagctatgttcccaccaaatgttgactctgtttagacatggacactgtcactcagactccctcccagccacttccaaatacacaagttccacttggctttccctgctcctgcgtggtcctttgaatgaagctatagaagaataaagcactccagccaaacattaggagttggaggagggagaaatcaactgacagcttgaaaggggaaaaaaacagtgatagtctgaaaaagctgatttttcatatagattctgcagggagtatatttctctattatttcaattattagaacttcctgaataggttgcaggtcactcataattcacacttctgtcatttttaaacatgccaagtgcagaatattatgcataaataaaacttccagtgctttaccagagacataaacggaaaaccataacaatgaggccttgttcatcttttaaagagtaaatggtttattttgtttcttgttttctcctggacaccggtttaccttctaagttaatagtacaaacatagcactttgaggtgacccaagtgtagtagattatcagcaaagctgttctgaaagattcttaaattttctcttctgcagaataatgaataagaacgtagttttaccttttgtaagggcaaatggaaatatcgttatcttgatggcagatttggttggacagaggccttgacaaaattgaattagtctgagagccttctgtggactcttaactcttctcagaatgcttttgagcatctctaccctctgtggtgtggccttcttgagctaaagaaactgaaggaactaagcatccaatgacatgtacttaatgttaattctcattttatttttatataagatatatatatatatgtatgtatgtatatatatatatatataaaaaacataatatataattaattgtggcctatatcaagcacaattagagttaatctggtcattacacattaacaattaatgcatatgattgttaatagtttatgtaaaattttaaattcattgaaaatatgaactttgcttattagatgtcacatgtaaagtacataatatgtcttagtaaaaattatttatgtgtaatactgagtgacagttgatctctagaatcttagaattggctgacttctgtccataccactgctatttttaaaaaattctttgtattgtcttgtggacttgcttttttgcattagaattggtttcagagtttgcttaaaatatattaattataataactatatctatagtaagtgatgcccatttacaagtatacttatgcttaagcaataaatgtcactaataatgaaggagaacaatgttgactatttttcatcttgtttttcaattatgtaaacaattaaggattctttttgaagagtcatcaattttgctagtgagaggaaatacaatgagagttggtgataaaagactatggcaaagtcagttagtaaaataagtgctatagacccttagttttttaagttgaagaattcagaagtccaagatatcagtcatgctttttggaaaagaaaaaaaaaaaccagtctatccgtatgctagaaaaattaaatttttatgttatgaaaaagtttaactgtatggaaaactcagtcattttcttaatatctatttctgaattttagtatcatgtatcaaatttagatttctagagagatcaatgagtttgagatatgtaataattcgattgagtttgagatattcaataacacaattattatattagaatttccatgttcctgtctcccaaactgcaagaaccattcttctgcctttccactatgtgctgggattacctttcattttagcatagtctttatgagtgagagagagagagagagagagagagagagagagagagagagagagagagagaaacaacttttgtcttggttgaaacttctttctgaatacttaatatttctgtacttgtattgaattcatcacaaaccctaggacattttaattttggatccagttaagtttttccacacaactacaatggggaaggagaactgttaactcttttatggaatttagcagacaaatcaactcccatttttttccacagcacaaaccccagaaaagtagtgtattttcttctgctgcataactcagatgacacagggtttacaggcttgcagtgcagccaagtctctggggatgccctggtcttaaaggcgggctgtctatagcatccacaccggtaagcgcctgcacacaccactcctgacgctgtcagtttcttatttaccacaagatgtttttataactcgaaaggagagacatagcatttcctgagaatagagacacagcatttcctgaaggaggaggttcattcagggttgtctcccatcgttttcccatgtaattcagtttgaggggaaacaaaaaaaaaaaaaaaaaaaaaaggaaaagaaaagccattttgtcttgtattataggacttctctcacatgtcaaaagcttgatagtatatttctattgtcgtaggcatatctgggctcaagtatttgaattatactttggtgccattctaattagaaaaggccatggagtttgaatgtgggtcttctaagatcccagggaatggcagacagcaaggaccacaggggcagaaacaccttgagtggaagaccggaccctcgagggtgtggagggtgcgacttcgaggcacattcttattgctgcatggggaagcatgcccagaatttgccctcgttatgactggcgcttgccagttcttttcaaaccccagtttcatgagcaccataaaaattcagttaaaatagaaaagaacaccctgaagttaaaatccactctgctttgccttgcctttcatggcctggaatgtcaccttttacctccagtaaataaagccaacgtcaacactcttccatgtcttttatattttatgcactcaatattcttcacatgacaatctggacacttaaagggtaattacaggagtgatctatgtcccggcaaagagaattgtcttcataatatatagttgcagtgtatctatcattttcttttgttccttggactgctcacattggattgagtaaatctaaaatggaattaaaagagacatgattaatagaggactggaaagaaatcatgatatcataatactttcttaaagtggcctgacatgtgtgtctgggaagcgttcctcagccaatacaatccttctctttgaccgtcttgctgtgctttgtctttttaacctcactgtttctgagaagcgactgaaaagtccgaatgtgtcacgattcaaatgttagcatgctgttggaaaggaagctaataagttaaacgtgtaagagatgccaggacaggggtgattcaaactgctgagagaagccattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccatttatcttataagccagtttacacagtatttcctcagtttgaaacaaccaaacagtcctggttagcagacacagagctagtccaaagctggtcttaaatgaacaaacattttcttcaggttattcttccaatttcttggttgcagttgtcttccctattgttttatatatatttttttcctcctacatttgtcctggtgttcagaataatagggatggagtgcagtcttgtttatttaaggtttagctagtagaagtattggtgtgtggtaacaggaaaatagaatacaggttaccatgagcaagatgaaagtgtgagaaaagacatagggccgatgcacactgatggttcacagggctaaaagttttagtgtttacgaggtgcagtatagcttctcttttatccccccccccaaacctccacttgattatagagttgttatttaataaataacctccggataagacaaatgattgatagcattctggtggtaaggtaaatacatatcttgaagatatctgtgattaaatgtgtcatttatccgtgataaaagtccggagcctaaacacacaggaggtcacggcttctctgtcactgagctcttaggaaaggtaggtagtagatcttggatatttcagattatgattcttcacacagcttccccaacccactagtagcagatttattaagtctttcctgtctgtcttgccttatcgagaaagccagggcaaaagaacccaaatcagcagccagatcacagagtgaacaggaggcacagtgcttgcatgtgggagctgcaatcgggagctggggcacaaggtcagggactaggtaggggatcaccttttgcatcggtggaagcagagagtggtgtttgggaaaaatgattctgttcttcagagaccatagctgttgagtttgctacgatccatcagccattccctttggagtctgttgtagagaaaggatcctttgctaagcaggggcccctccgggttagctagggcactgccggacaggacagccaggagtgttaagctttgcaaagacgtggcctgctaggtgctttgaggaattcaaggatggaaaagttcttttctaaacatatgtagattataggtaacacagcaaactcacattatgaaattttgtgtgtatactagctaggatttggaaatgtcttgtaaactccttgagagattttttttttccaacaaggagattattttcttctcttagttaataaaacagaaattaccatttcctttggtaaaaataaaaataaaggggaatatgtttatgaaaataggagaaaatttaaagctgccctggtgcatcctgccttttgttaacgtttgctcatgtctgtctttcctgccacctgtgcctgctctttgaagatattctaccgagtagtcgcagacattgcgcctggggaagagctcttgctgttcatgaagagtgaagaggacccgcacgaacccatggcgcctgacatccacggtgagtgctgagtgccaggcgcagtggtttcaagagcagcatgtctaagagggtccttcgcacctgtggtttcttcctttacttccttggctgcacagtgccattttggcagacatgtttatctcagaatggatattttctggagttgacatgtggctacattgatggagaaagcagttagctgaggtctaagctgaagtatacataatgaaaaacctgaaagcttgatcaagagcatcactttaagtttggttacaattccctctgtaagaatctttccactctttctaaagagtttgttgtttagtgcgtgagtgttctggctgcatggctgtatgcgcacaatgtacacgcagtgcctacagaagccagaagggggcgtcagatcccattagcttgagtgatacacgattttgaaccaccatgtgggtgctagaaattgagcccaggtcctctgcaagagcatcaggtgcttttaacgaccgaacatctttccagccttctcttttcacttcttgagagtcaccataagtagccaggcttggatctttcttcaaataccaactgtctctcccatgtgtatttctattactggcaaagtgtctctgtgagagcaaaatcttgattgcttgtgtgtcatggaggtgagttgttttcttttccttccagttcctgtctcctaatataatgtgatttggttcaacactgtatgttgaaccaaaaatacttgagttagaggccagtctccagtgactcgagggagaccttttgctttcaaacctagttattttaactcaagtggtatcccctgtagttgggctccattttgtttgtttgtaaagtattatggtgatttgggaatgtctttggggcatgtgtttcccttttggaagtctgacattgaaattgcttttagaaatatagacttcccggtcaacctggtaaagtttgagcctgaatggggagtctggcctttcttagacagtacagcatgcttcatgctacgggctcctctggtgtcccatgtcatctgtacatggtcattgagttctaggtgtttcaggtccaaatagaagtgctcattccactcttaagtgttttaagatactcattaaagcataaagtattcttggggctagagagatagtttaccttgtaagtttgtaggcctgagtttgatctccagaacccatctaacaaaatccaagagtggtagcaggtagtcccagtgcttatgaggtggaaacgtgtggctttgggacattgactggcttgcctagctaacctaatgagttccagggcaggcatacacacacacgcagcacacgcacacgcacacgcacacgcacacgcacacgcacacgcacacgcgcacgcgcaggcgcacgcgcacgcgcacgcacacgcgcacgcgcaggcgcacgcgcacgcgcacgcgcacatgcacactcatccttgaaccattagctgtatgttgtttcaatgtatcaggctgttctgaaacatataaccaaatactgaatgtttaagtggttatttggattttttacttctagacaaaataaatttaaagcatatgcattctttatgcaggatatagtgcattttgcatatattatcctatttaaccttttacatgcagattaaaatttctgagtgaggaatttcacagatggagaaactgaggctaaggcaatgtaggttatctaggaagaccacatggctagcatgtagagttggcctccagggtagtgcccttgctgtctaatattgggctttttctatgcattttaaagcctggaagttttctttctttatgggctcctgattgagattggaagccaagatcttgaatgtataagacagtgttataactgtaggaaaaagtttctttggttgctcctgttgagatttctgtctctaaggcagaggagattgattgaagagtaacccacccttgtaactgggcatccaatcagatgtctctaaggcataagagattgattgaagagtaacccacccttgtaactgggcatccaatcagatgtctctatggcagaagagattgattgtagagtacacccaaccttgtaactgggcgtccaatcagatgatgctacctgagccctttgccattggacccttgtaaccttgttaatggtgtcatttaagctaaatccatgtcccagtggattatggtagcaggctcttggtagttttcctcttagatctgccccactgcagatgggtgaattcttctacaaagcaaacctgaacacatcccagctcccaacttccagtgatgttctgttcctttcttaacatgaccatccatgcccttctgtcccttcacttccttccttccttccatgtgccttaaatccctggcatacttggctacaggcttacccctctgtgagtcacgtgtgtgagtccctctagccatcccacctggctgagtgttacccatgaaagccctttgtgagtcagtttctccagcttagctgagttatgcagttccccattgctcccgtgtgttcatttgtcttggcattgcagctatacatgtgcctctgagttcctgcacacgcattctctagcaaagcatatggcaactcagtaggcaattacaatgttttcccccaaacacttagtcaattaataactgaagaataacgtcttccttggttatgggtctacaaaacagtctgtgtgtcatggtgttactatgggtgtttttaggcatcacgaggtatacacaatacctcttgggtcatacctgtggacttttgtgtgggttctcagccattgagtagaaagagtaggaacagtgctctttctaaccaacttcattaagctcattgtattttcaactattaccgtctatgtactctactgaattaaagtataaattcatgtttgctatctaacaaagctatgccaattatcgctggcccctgagaaatataaattagcctcaaagagttctggaaacaccttgtgctccactccaggtaattgatggtttactaacaatgatgggcataattgcacctcagacagggcctctgtgtacatgcctttggcttagggaaaagaagtgagtttgggttcggacccagccacttctcttttgggtccataactgattacttagtcgctctaagccttagtactgtcatctgaaaaattgggtgaaaatcagacctatatattcttatacttagctgttaaggaatatgagtaactcctggattggcttgaaacttgagattatgatcagtaaaaggcaattaccacttccattatcccgagaacctacaaagattcaggtgctaagttttacttgaaggggagattacctggtagcctctgtaggtgcattattctcccagacatcttatggggtccttcgcatttcttatttttactttccttgttaacttgacttggagaaatgctggtcaaagctttcagggttgggagtggcaaagtgggtaaataaagtgtttgctgtccaagcctgaggacatgagtctgaatcctcagcatccatgtaaaagcaagcatggctgcgcacatcagtaaccccattgaagggagggacagaggcaggggcatccccagggtatcgaaatggtgagtctaggttcagcgagaggccctgttttagaaaaaatacagtgaggagtagagtaagacacacaatagcaacctctatgtgtgtacacatgtatgggtgggtccactgtcatacagtctatctctccctctccccctcccccttccnnnnnnnnnnnnnnnnnnnnccttaagatacttacagtggacctggatcatttttgtcaatcagaaaatattccatcccttcccttcccttcccttccctccccatcccttctctttcctcatctttcttttcctcccctccccttctctccctactcttccttccccttccccttctcattttcctcctaaacctagggattataccagagccttgactgtataagacatcaatatgtcattgagctatattgctagtctatagatactatgatttaagcagggttatagtgaactcaagtcttaactttacagggaattatgactttgaggaaaaaaatacagagtcagaagaaaaaaataactagtgatatgtcaagaatagtaaggctacttctagtaaggtgacctctacctcatttaaatagcaaggctacctcgatgtcatttaaatagtaaagctacttctatctcatttaaagggctaaaattctagatctcaggctcactttcagagataaattttgacagatccatataggtcacagatttaactcaaatcatccatcaaattgcatatccacaaaagaaccagactatgttcaggttcccagtgtagcattttctaaagggaagaacagcactgtagggatctaaatgaagcaatgctttaatatttaagaagatgaaaatcagatctcagcagtgtatttgctttgcatagccttttgaatttagttcctgaatgttctttatttgactgaaggaaacaccagcactggaacccccgccccccctttgaaaactatgttgataattatactacaaaatgcaactttatgttcagagatgtcaataggttttctttttgtttatttctacctaatgcctttcatttttgctttgcaaaagggttttaataattgtgttcattacttcttttttttaattaggtattttcctcatttacatttccaatgctatcccaaaagtcccccataccctcccccccactcccctacccacccactcccactttttggccctgttgttcccctgtactgaggcagataaagtttgcaagtccaatgggcctctctttccagtgatggccgactaggccatcttttgatacatatgcagctagagtcaagagctctggggtactggttagttcagattgttgttccacctatagggttgcagatccctttagctccttggatactttctctagctcctccattgggggccctgtgatccatccaatagctgactgtgagcatccacttatgtgtttgctaggccctggtgtagtctcacaagagacagctatatcagggtcctttcagcaaaatcttgctagtgtatgcatggaaacaatctttggaagacataattaggcttttcaagtgaaaccatcacattgtgtttctatggggatgctggtgtgtcaaatggccttgttctacaaacagcccccactgcacctcaccctttccttccttctttccttacttcctggatgcttttcctcttttcctttacttcctcttactgccctgacttctttttcttctcctggatcatgcaaatgtcactgagttgaaagcacggatgactaagaaacattgaagtgtaaccacttcctcatcaagactgagtcaaatgatgcatctctagctttgaaaattcaggcccaagtttgttagttaccaatgaaaaaggaaaatggaaaataagagggtttccctaataccctttacactcatctctatagatgtgaatctaccaagagtgtaattcaataaattccctatatatgtctagtaaaatgtaaatttatagtaaaaattatataatgtcttttaaatataaacatgcccctatattataaaaaataaaatgagaccagaaaatgccagtaagataacaatccacagaaagaagtgctatctctagtaccagaaataaattatttcactttgatttttttacaagaacaatggattatattactgcacacaaaaaactagattctcacttcctctgggaagtggatagcaaccattcctaggaagaaccttctggatctattcaaccactggcaaaagctccaagaagctccactccatgatgaaggcaattgtcagttaatcattgagtggaccccagtacagaatcctccaaacgtaacatctggaagctcaaccagacgagtagagtataccatcaagcagttagacaccgctctccaagtgtggaaggcggtcatgcatcctatactatagtcttaacccaaattcacatttttgggtatttccttcttcattgaatgctgccattgttgctgatattgtcatgagaagacagttccatcttcaatgtgatacaatcttctttctgcatcccccatctaaaatctctaaaattcctttattgaatttatgtgtgtgtgtgtgtctacttgcaggagttgattggttctctccttcaattatgaagaatgtaatttggtatccttggcacctctacccactgatccatctttttgttcttaagagtttttaagctaatgcagaggtgggggctgctgaccaaagctccatgaactcttaagttatatgaaaaggagcgaagactgaagactggctagtgtgcttctgtgtctatggaagcaatagaattgcctttttgagagcttgtttgtgttccccactttatgtgtgagcttgaaggctatgagtgtgtatgtgtgtgtgtgtgtgtgtgtgtgtgtgtgtgtgtatgtatgtgtgtgtgtatgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatattccaggctggtcttcactgatattcaaatatcgatctcacagaaaaaggagacagcatcaaacactcacacttggcagttttaatagcgttcaattgtagaatgcttcacataggcacaaatcagagagaaaggtgaacttacaaacacccctgtgcttcaacatcttcaggtaccacaggaggccagctctattttggagtatttgaaacaaggcctggacattatttcatgaaatttttgtttgtttgcttgttttgtaatttctgctggataagtctagatatgactgtagaaagtaaagacttttaatgtgttggttcgatagagccctttaaatcacaagactggagttatcaggtcagagtttaaatgctaatagttagggcttttaggactgttatatatagaaggtccatgtatgtcaactgattgtcagaatcatgtctactttagactagtgagcattcctcttgtcaaacccttccactctggctatctagctctccagctgttggtctcagtgcgtttcttccctgtcaaattctgttgtttatatgtccttggtagtgcctaacacctttcttctttccttcttttatccataaaggcattattacttcttaagccttagttggactttagatggtttaacaaaatggacattatcacttatttatatcaggaagcatgcagtagatcacccaaattcagggcacatgaagaattctggtttcatcatcctttcatcatttattataaggattaactaattttatctagaaaaaaacgattccttattgtctattttgtctccctaaaatagaatttacatcacaggaaaaacatgacatgtttgtgcattttccccttacagtccggttctgcaataaacatcctataagagtgaccggcaaggttctgtttgtgcattttttaaatactctttttgttaaagagtattgtcactgttactggtgcttaatgtggactacctttggataatgagcatctttaaaattggcatcctaatttcttttgaggtcatctgctccttttttgctctctgcaataacaaaatgttcagaacgtagcctgtgtgctttatcagattggaaatggccaaaggctctcaggggctttggctacagtgggtgagtgcagtataccagtgtgccaaggacaatgtggtcaatgaacaaaaaaagcctcaggtagctttcaactgcagcagtagcacattgtctatattttctttccattgtatttgtgcagattcatgtacaaatgtagaaaaagcaaaaagcaaaaaaaaacaaaaaaccatacaacccagaactttctaaactttaaaacatagataaactatcttatgaggacactctaatcatgtttttctcccattagaagtcttaatgctatattgatttaaattatgtatgttattctttgtaattcatgagttatctatcatctatttatctatcatctatctactgatatatctatcatatctatctatcctatgtatatctgtctgtctatcatctatttatgtatgtatatatgtatgtatgtatgtatcatctgtttatgtatgcatgtaaaatgtatgtatgtatgtatgtatgtatgtatgtatgtatctacttatcttcttttttgttatcattgcagtcaccatcatcattgtcattgtcatcacctgtgatttgtacacatgtatccccatgtatctacccacacatcgcatcccttatcagggccataatatgaagttactttcagttctctttcctctatgactaaaaatacaaatatttctgaatctagaggttacatatattagagagaatgtctaccttatgttcttaagtattttattaacatgatttttattaacatgattaatatttgaatgaagtaaatagtaatcaatgttgataattaagatcatagcacaaatcttaatagacagataactctctctcatagttccaaattatcaaataacccttgatagctgtgtcagattaattccaagcagggctatatctctgtaatggtggggcaaagtctacgagagacaacatgtacttttatctatctaagaccatttcttctctttcttcttcagcttctttctctctcaactctctccttgccagttggattagtaattaagtggaattctgtttgtggccatatttcatgtcaccctgtcttattaaatcaattgttctcttgacagcttggagaagcacatgctgtcacatactgaggagagggaatacaagtgtgatcagtgtcccaaggcatttaactggaagtccaatttaattcgccaccagatgtcacatgacagtggaaagcactatgagtgtgaaaactgtgccaaggtacagtgaatttgtaggctactcacctctctctatcctctctct

SEQ ID NO: 1490 - DNA, 238 bp, Mus musculus
atcttagatgagttttgcaatgtgaagttctgcatagatgccagtcaaccagatgtaggaagctggctcaagtacatcagattcgctggctgctatgatcagcacaaccttgttgcatgccagataaatgatcagatattctaccgagtagtcgcagacattgcgcctggggaagagctcttgctgttcatgaagagtgaagaggacccgcacgaacccatggcgcctgacatccacg

SEQ ID NO: 1491 - protein, 80 aa, Mus musculus
  VARIANT (1)...(80): Xaa = Any Amino Acid
ILDEFCNVKFCIDASQPDVGSWLKYIRFAGCYDQHNLVACQINDQIFYRVVADIAPGEELLLFMKSEEDPHEPMAPDIHX

SEQ ID NO: 1492 - DNA, 80332 bp, Homo sapiens
ggcagttcacactcacgttacccaatttattttcccaacactcgtaatagtctgatattatgaaactgtcatggaaaccaactcaaaggttaagtgacttacccaaaggtacacagctaggcgtggagagaggaggaaaatcaagcttccaacaaactttccccacaagattatgagtctaaaagcactcttagatggtgtatctaaagctcgagggaagaatctgatcctggagttattgcataatgtgctaaatactatattgaaagattgaattaattaaaattaataaaataatgaaaaatgaattccttatagagttgaggttttttccaaaagcacttactacctcactaatttagtccgaagttaaaaagaatgagggatttcaccttttgagactaatgataatcgtaagcaaagttatcttttataaaataaaaagataatagtaaatttttcctagtgatataaaacaaccagttgtctgaacaaccagattgatatgttatgcattttttgtgactgtctcagtttttgtatttattttttcatcatttatttcttgaatatatcttgtaataaatacacatcaaagagttaaacatccctacttttgggaaatatttctctattgtctctattttgctaccaaagttttacagtattttattaacatttttattttatcataatattttcatttaaacttggtataaatttgttgctgtgcattaaccactcagcatcatagcttaggactgaaacacatcaaaatagtccagcaaaaaatattttaaatatggcaaccttaactggagtttaaaaaataaaactttgagtataataatttattcaccagagcggttgtttcagcaaagtacttcatcttagtttccaaagagctgctagttgttactaaatatattttaaaatagaagcaaaaaagaaatctgctctcattctggccaaatatactataaaatattaaactgttaaaatctttggcattttggagaaagatcagctaggtgattatgcttgtatagttaattaataagaaaggaagtaggtaatggttcactggggaaacttttgttatcaccatgtctatttatgaaggatcccatgctgtagggacaataacggggtgctaattctgaacgcacacagtgccgtcctacaaagacatcaagatttgtaggaaatcaaccctccagcagtcctggcaagccagactgaccccagcaaatgaaaataatcaaaagtaattagaagcgtgctggactactcctcggagagccgaataggagagtaaacatgcctgaatcctcgagccactgcaaaggcccatgtctgagctgttaggtgccctgaccttgtccacataaagatgtgatttatgaagtgcagggcacagcagcagggcttctgtcttctcctggagaaccaaattactgaggtggagattaacatgctttcagtcgggcccatttccagaccaagggaaattttttatttaaatttgttttatctttaatttcctcttttctaacagcacaccccaatagataaaaaaaataataatttaaaaaaaataaaaaaaggcagagtccaccaagagtcaccagtaatctctcttcagtgcagttgtgatatgtgtgtggggctacggacagtcacagcatttttgttggtaaatttgtattgtgctggactgtttcactggatctgtctgatcaaagcatcacagaattcacattcatgcttagagaacaaagcttgcaaaatacttattaaattaaaaaacagaaattattaaaattaaacagaatatcaccttagatttcatggctttctgatctagtttatcttgcctaaaggtcatgcttcattacaaagtttactctattaaataaaaagatttgggaaaagaaattgtgggtggtagagaatttagaggagtaggagaaagacaaattgggagaaatatttatatatgaatcagtgggaagtctcttgagtcctaaaagacatacttacattatttcttatctttgtgtcagttaggttaggtaagattttacaaaatcctattctgacatggaaaaggaagcattgattttctttttaaacacacatcaatatctatacacgaagctaatttaattagcaggcacttattgttcagccaaatgtcaatttctcagattatttcatgcttcttgacatgaactgtatgaaacaggatttaacagaatctccatgaataaaactccacttgagaaatgtaaaaatgcacatgtacgttcttgaaaagctacaaaaaaatagagttaaaacaaagatgttaggcttggagtttagtgtatatttagccacctcaagaaacccaaagctgcagaattaagggaatttagactgaggttataaagtgccttcctctataaactaaaaacataatgtcagggtgaatgggaacatactttattaactttacggtattgaaaactgccagcaagttgtcttgtttttaaatattgtcctctgcagagtgttacagtgctgtttgtccacaggaagcctattaaaagtggacagtgcagtcatttcatctggctttggctggactgcttttctttcctttaatgatgtgctggaatgtaccatgcccatagggtctccattagcagaacttttacttctgggacgaccatgaagtttaaggcttaaaagaggcatcagtttacagtcttgtgggaatcacttgaatactggagcactaacttcttactgctttaactaatatattgacttattttaaataaacagttacacaatgaaggcagagccagtggccttattggaaatctttgggctttttaaagattctgcaatccacacagctggggaaggaaggaaggggcctgaggagggtttatgcccttttcaaaccaggaagaaaacacattaacctctcccaccccagccctgccatcagccaaagggggatctttacaactcctagaaaatctatcagcccacactcaaccctcatatttttccaatgcccttttcctggtaaacaacaattaacagatcaagaaagaaaaaataatcattccttctggaaaaatgtttttaaaatctggttctctttttaaacatcactgatgaatcattccatttttttctttccccgaagctatacatttgttttagtttgttctcctactccatccccttaatatttagatcatctgtcctgatacatgtttgcaaattaaagctggtttgagattacagtaaaaccattatttttaatagcccatttcaagggcagtgctaaacactgcagaacacgcatgttactgattactgctgagcagacagcggcttttgcagattaatttgtaactgggaactactgtaaacagatttcaccagaaatcccaaggaataaagggaattggtgatggtatttggctccttgtatttatttattgttttagaaaccttctgatggaaagcaagctaacaggggaagaagcaagccccttgcaaaatccttttcctctaaccttctttcctgtttcattcacttattggggaagatggatcaggtcttctaaataattcttatttaaatagcaagaagaccctttcatgagaaacaaggccagtctaactactgtgggatttcagaaccctatctttaaactttaagttgtgtgaagaaaaagtgagatgactctgcctttacatgaagttattgttatatacctaaaggagaaagggagtgggatggggtgggggagaggggagggagagacagacagacagacagacagacagacacacacacacacacacacacacacacacacacacacacacacagagagagagaaagagagattaagatttagtgttttgttagcttcctttgcccaggtccttctgatgatttcctttagtctttttcacaatttattcagtggagaacaagactgatgatgacgataatgatgatattaatataataataatgatgatgcaatgaattctccattcttctaggtacatcttccaaggtctcggagggtaagcgttcactcttggttgtatttggggaagagaagctcagacgtaggaatagccttctctcaggctgatgtctacatgcctggactgcagtgtgccttcctctcgtagctcggaaggacgcggaacggcgggcgaggcggaaggcagagctgtgttgccggcgcctggcgggcagaggcgggttcacctgggtggctggagccgccggcgctgcgctttatttcggagcgcaatgccatctaccggcgtcctgccgtacctgcaagtatccagaccttgaaagtcgctccgcctccccccacccgaagccaatataggggaaaaaactcggaggccctttccacgaaatcctaatttagccaggacctgccaatgattccagacgaccttttgttttcctaccgacgtttcctcgttttgaaagcagttttgtaaagggcaaggaggtgggggccgcagggttggggcgctgagctcccagaccccctgatcaggccgcactgtctgaagcaatcggttccccagattacttgtatttaatacacaatgcatcataaaacaaatccctcatcctgacaggaagaaaatagaacagctcatagctcgagccggtccaatttatggctaaattaaaaaaaaaaaaaaaaaaaagaaagctccgacaatgggcaagttgagggagggcaggaaatcaatggccacgaaccaggagctcttaaaggttctcaagcgcccaactctacgggaatatctgaccgggttttaggttatttacaaaggatttttcctgtcctacctaccactgctgtgcgattttctctcaaacaatggccattatctgaaataacagttcaatgtcacagataacaggccaccgaaacaaattagtcaccacctcttgtcattttctctcccccaatccctcccttttgctactatttttgtttttaaatcaatattttgggaaaatatagttctactggatttacacgtttatttgcacttggagaaaacaaaaagtgggtggcacttgtgttatcccgtttgcagctaaagtttaaccgtcagcacactttccagcccctcttgccccacctctcccccgcaagtgtccctagactcgcttactttgcttaactttccattgttgagctggggagttggattttgtccatttgtttttatgaatggagttttgtgataaaaacgcgtttacttccatttagccagtgggatttactaaatcttacaaagttggccatgaataaatctgtagacccttttgttttgctatgtatccccttattctttcttccaatgtcttttctacaatgtattggtttaaatgtacccaaggtatattagaaagttattaaacataggatagtaccgattactaaaagcagcatttatgatgttaaacgttcaaaaataatctgagtcgtcaaattgcttattgcacgttttggcgttcaaggtgttttaattaatgtatcaaagaaaatggcaaagactcaccagacagtcatcaatctctctaaacccataatatgctgtttgggcgggttatatgccaataatttttcagattttaaaatatctttaaagaaaaatatggtttgaaaattttgcacgcccttcctctgacctagctacaagaatgaagggaataaattagagtatgagtttcaattaaaaaaattttttttaatgcttagcagaaaactggaaatgtacatgtcaacttttcactcttgaggttgctgttttctgagaatttctaaactatttatatttagtctgaactagcgtccctataccctaagctttatcctccccactccagcactacctctcccccctacccccgccccctcctgcctcggtgcacacaccctcacacccctgaaagcacttctctacccttccccatccctcccatcccccatctctctctctctcacacacacacatgcacacacacactcgcgcgcacacacacacacacacaccacacttgtgctttcaagacatcgaaacggaggctatttccctggggaaagaaatcctgcctggcgagatctccccattggttgtttacccggagaaatctacatgtttaagggggatggtgcatccataatcagtctgtccctataggacttgggtcttggcgacctttttgtgacctctcccgccagaggaggctgctgtcactttaaaaatttaaaagaggagcccgtctggcttccgatcagatcactctgggcggcgggagatagctccctttctccctcgccccgggttctttctggatggccgagcagatcctctttaaagagacagttcatgaaatagaaacccggcggctgagcttggagttgcgaaaggggacgatcccgtgagggtccaggacccgcgaaggcgctgcggaggatctgaaagggggatagagctcccctcgcctccccaggccccccaccttttcaaactctcctcctcctgcttgttttcccccattggaactgggaaggagaagtagaagttttagtgggtttcagataactttcattacacatcgggctgataagagcaagagaaagtgagaaaagagggaggtgatgtgaaccagaaggaatagctccgagctcatttaggaagggggaaaaagccaaaacacaccaaacccgggtcacccagacgaaagaagacttcatttcttgtattaaaaatacactgttggcggacaataaatccgaaacgcgtggtcctggagagcagatcctagagacggacaaagttgtcagagacccatttggaaatcgagacgcgaggcttttaaaaaattattattattatttttaaacatctctaaatgttgctcgggatcgtttgaaaggattttcgtgcaggagcgttgggggctgctgattattttattttgtttattttgattcttctgtgattgcctattattgctgagttgaggccatagaaatctaaaggtaagagaactcctcactttaaaaggaaaaaaagtctgggcgatgtgaaagtttgtcacttcggacagtttcctgccggggcaccgtttctacgggcgccccccgcccccagccttctttcctcctcgcccgcagtctcgcggagccctgctgcttatctacgttgctaagccgggcgatttccttgttcctcctgcgaaacggtgcggtctggacacgtctccggggtgggtcgtccggccttcggtgggtttctctgccggcttgtcggcctcttttccttgcgctcttctcctccttcccctccctccgtgtgtctctgtccgtcggtttcggggacgcacaaggtgcggttgccaaaatctgaattcctggcactggccacgcgactttggagccgctctcggccgagttccaccttgccaagtaacagctttgctgtccaacatcgtgtgctgcttcgcgagaaagtcacattcggaccctttggctagattgtggggatttttttttttttccttttgctgttggttttttgaaagggcctttctctaaagtctacctaaacggtttttttttaagctatctttggaggttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctaaggggatggatgcttcttgactttgaaattaacaagttttccacgtctctctgcaaatatgaaatggaattagtattgcatttcactggctttattctatgtcctttattaaatatttctttggtgtgtcaggagaactgccttttctttttctttttttcttttttttcttttttttgccagtcaaggaaacaaacaacaaaagatcaaccagaaaccaaacagactgaacaaaccaacaaaacccagcaacaaactccaactttttactatttaaaaatgtgcattgctattatttatgtaccttctcaacatctgggatggggggaaatctcaagttgccatttgagttactcagcactgagagttgaagaaacatcttaaagtttgtaattttattgataacaaatttttagaatttgtcctcttaatagaaaggatgtttaagtgtacacttctgtcgttgttagtgtgaagaggcatccttgaaaaagaagagtttgatttctctctgtgtgtgtgtgtgtgtgtgtgtgtgtgtgtgtgtgtgtgtgtgtttaataatatccctatcttatgttcgatttttcttttttaaattttgggacgacttattgcccttcaatttcctcatggccaaaggcttattcatagggcttcttgactaaagcccttggagcactgggtttttcttgaagtatatggtgagttaatgacttgaatctgcaattgggtgattgcctgaattctatgcaaaattgcttttggtctcagtactcaagagtttaattttaacttttatgtggttatgcatacagcagagatctgtaggagttatttaattcaataatttttgttctaggtatattgcttagtctttgataggaaacttcctcgtttgtattaactgattgacataacattaccatcctttgtagttattcaccatcaggtcaacaactctacagcttttaatattgatgtttaagacattattgctgttagtgaatcagaatagcttggtttaagtacacatgatcttaaaaatggaagtttccctcttcaatttttgtttagtgtgtcctaactaatgattaacatttagatgggccaaatgtaaaatttcatgaaaaataacaagatacaagtatacctaatgatggcagttcattacagtattttaatatattttttatttgttcacaaggagccagctttattttgcttactagacaaaatattgaaacatgcgttgacatgtgttaactaaaacctgagtttgccatactttgcatgagtgtttccgaattcattattttaatttgtttttctttagtttgtttggaagcacctataagacaaatcttattatctccttcaattaagagtgtgatttaattgtttcatggtaatgagatgctaaccatgaaaaaaaaatttagatggaagtttttaaattaaagtgcaaaaatgtgaaaatatatgcttacatgagactatacgaatatgaaatattgactgtaatgtttagaaatattatgttaatatacgctgttcaatattattttttgcaaaaatcacattggataaaattagcactaatttatgcatatgaaaataagcatttttgaaaccaattaatcagtttttgtaacaaattgcaagtgctttattcctttttaaaaaagcagtatgttgtcattttcaaggtaacttctcatttcccctctattaatgtgcttgtgatctgactttttttaaggatccaaagaaggaatatacatttcaatgaaatattttcaaacaactgattattttaatgagtgggccaatatggcaattgattgttctcatcttcttccctccagatcttagacgaattttacaatgtgaagttctgcatagatgccagtcaaccagatgttggaagctggctcaagtacattagattcgctggctgttatgatcagcacaaccttgttgcatgccagataaatgatcaggtatgttgtaaagattttcttgtctttccttgagagcacaaaagtatcactggagcctgaagaataaaaataacagtaagctgcagtagacccttgtggcctgtttgttgatattgtgaaagataatgcacaaatataagtaaaatgcagaacaaattcatatttagtactactttctttacattctttgggtagtctattcagtttgtactagtatccttcataaatgcaccagttttcttggtgtgactgatttaaaaactgagtattattactgcctaccgttcagtttttctttgctatcatagtaggtacattcataaaaggtattgagctaatcaagaacatcttgtgaatttatgcagaaattggaagtgatatacttgaaatgttatataggttttatttgaaatgtatatgcatagtatcagtgttatcttatctaattatgcattttatattgatttgcctaattataaatgagaacacttacttttagattaattaaaatactttttttggtatatgttaaaaagtttaaaaataaccctgctggaaactgctttgtgacattatggaggaccatgcagtgaggttgactttaataacaataactgtgaaataaagatcatgaaaatatcgtgaaacatattttacacttaataaaattaggttatgaatcttgtaatatcatatgacaatacctaaaataacaagaaattcagcccattaatttttgttttataaacattgttgagctagaatttaattatgttataatcatttatttctcttaacccaatggtttcctaaatcaaatatgtttcaaagaccatattgaagtggttgcttggcaaatctactatgaaatcaccatcaagaagaagaatagtttaaattaaatgtttccaattgaaaacttaaataaagctactgtcaattggtctaagactctatttcattcattattatgagattattctttggcatcgtaccagctaccagataatttttactgactaaacggtgtaagaggtagtaaattgtaaaattaggtttaaatggaaatcatttaaaaatcttcaacatatatcaaaaataataaaccaatcaattgttttttctccttgctataagaaaacaagaggaattattgacaagggaaaacattattaaattagctattgattgtgaacagaaaatattccgtctatcatatgagttactgtcgccatcaacaacagatattttttgagtacctactatctgtagatgtgagaaatacataggtattgtgagtgaattaatgttatactccttacaaaaggaactggaggacctcaaatgatagctttaagatgaaataatataatcatatcataataattgtttgctgttcatatttattgacaatggaagctatttccttagacagataaaactgttgtagaatccgtgaaaagatgatttaagaacgggacttgtagccaatctaagtctatttgcagccattttttcatttaatatttatgtgtgtagtgttttataataaatgtactcgtattgggaatcttgattgcaaagggaaactgttttcctgtttctcactatgaattaggctactcattagagtaggcatttataattttaccatagttgcttttgaaatatacattgtaaaatccattgttttcaaaagaaaatatgccagttttatgacttaatgaatagcgtgtttacttattttgactaaagaatcagagaaaatacttaatctgggaaaacagacaaggacaatattagacacacatttttcttaagtggtaatttttaactcttatgctgacagaaatctaagatgctaacagaatgcatatcaaataatgtaattgtgaaattcaagtaaattcatccataaacaacaagggaggaaagtcagaggtaaaagtcagatttgtatgatacgtgtagatgtatacaatcactcttagcccaattgacaagacaaaagggaagagacacccaaatagtgtatgcatatattataagcatattcacctataagcacatatgaatattctaaaatccaattaaaactagcaattctagacagctttgaaatgtgaatgttggactaggtacaatgataaaagagctgactaaagagattctctaggtctgttttttgctctcttttccatgaggaataggagctgccaaatggtgaataagcacaactcatcacataatgaacactcccattgtgggaggtattatttaatatttagctatagagagagaccctggtataggagtaattattaagcattaatgacatcaactcacctgtctaacacaaaagcaaatggaacgctctacaagaaattataaaaagtgtttctctttgctctgatttttagatacggataaagtttatcaagtgaattttagagcaagacaggtataaatcctggactctgaaaaaacggaatttgagatgaagttttcaattgcaagttagtcatggtaataattaggtcatctaacaaagaaataaaaagattacccaggacaaaacaagagtgtataaattgaactttactttttcaaagatacatatttttaaaaattctaatgttaaaagatcaagtttaatcaattcagatcagtttttaatgatatggaggagccatattaaagaaaataaatgtgcttgctaagattataatacagtttgatagtagaaggacagtcaaaatgttgtatgctggataacctgtatttgatttctttgtgggtgaagaagttctagaaacagcatggattttggtttttaagtaaagttgataaaagatgtaatctattttgtatcagaaaaaaataaaaatgaaagcaacccagttaccactttccccatacctttctaccagcattttatttaaggaaattttcctgagtagtttaaattttccagtagatttctgtgagttatttcatttcagattttttttttttcagacagaatgagctttgtggcagctttctttcttgtcagtgctgcctagaaagactcaagttttgtgattttagacgtctctttcatttcatgcttccaaaattattgcagtgatgtttttggagatgcacattctgaaaacattgacatcactgctaaaccataatttctaagtagctgtggcttctgactgatatctttattcacccctgaaaaaatgtattaactacagtaatttacctctatgaaagaagctataccaaagacactagtcaattgagtcacagtcacactcaagtcataaaataatagatccattaaagatacccaagtctctttatccttaacattctaattatttttcccttaaagtttctctacaatgctacataggtctatggctgtggcacggtgtttagctggaaatttttactgagacagacaatgcttaaatatttacattctaacaacctgaaattatccttggttgctttcaggagcaagaattggccctgaaaggcagagcagggtaggagcaaaagcagagagttggttaaggaaatctctttccagactaggtcctcaagaggaccaatatagagaggaagcataaaaatgtttttttttcattattcagaggtttcatttacatacagaagcacctatgtgtttaatgtgaagtaaaccaaacatctacatgatatattgttttttttttttaaagaaaactagttatttagatattctttcctttaaagtcttgtagctgtcttacttttacaaaccattttgattggtggacataactcattgctttaggtttggtcggtctcaccctgttctcacctctctctccatcctttgataagtctccttttgaccccacatatacccttcgcctggatcagaaccagggctacctacccatagacccccatccacctcagacaaggccagttctcatgtttgaatagattcacaaagtttgggtacttatggagtagttctctggacacaacagctttactctaatacatcttcatagtgaaaacatattggtaataatcagagagtcactaagacacaatttacctaagttggctttttagatttaaatgagacctgcctttccacttacaattaatacaatttatgtaagttgactttttagacttaaatgaaatctgcctttccactgatagttagaatgatctgggcgagtactttgggataatgttttgtatatgtaagtgtgtgtgtattctgtaccataagaaggaacacactcctggcctgccctaacatggtctatgagtagaataaagttctcagaaacccaagacattattaatcttgtcatttacacaaggtgataagtcctttcatttttaagtaggcccttgacagctggtatttagtaagtagaaaaagagaagtctgctgttcactctgaataaaaagaaatgtgtcgataagagattatctaatgcctgatgtatattttgaagaaatgagttacagaagaatgagtgcccctcagagaatacaaagtcagaattcacttaaggattctgccagctcccttgtggttaatgaacggcaacaagactctacagtgttttcagttggaacaggcattgttctcatttgtgctttaccttataaagttttaactgcttccaggacgatcctagctgatgtggcaccccgcgttcgctctccttaggtccacgtgaatgattatatcagactgctgtgacactagaacagcattttattgtgagcttattatgggctcaattattattttctttggattttactatgaaaaaaaatccactttcctgcatctttcgattagtacaatttgtgcaaaacagcaaggtagattagctatgtatactgcaaaaatgtaatttgttaccctctttatactttttaaaaatgtttgtgtctactgtcaggtaatttgttaatttgctcttcctttacaagggtatctgtccacattttgtaccacttcttttgatgttaaagttattattggctttgggcattttctttgctttgcttttaagtcaagttccacttttataccaaagttatgctctgctgttttaagatgaatgccagctggcaatacccagagactggctttgtgaacagtgcctaagctgactttggggggatgttgtctggctgacaagttacttccttcacctgaagatgaaactctttcaaacatagtttgccatttgatttttacatcataaaacaaacatcacctcatcccctgccccagtgaagtttccttcatgtaacaatacctaggatgcaacactgacataacgctaggatttttgttaagattcacaaactgcataagttgaaagagagggtgacctgaagtattaagtgtacattttaagtagttagtgtttgcatgtatatatcgcctttcattcaggaagatcacaaagcatcacatacacaatagactgtaactatttctgggagggcatataaaagtcataagaatgctttacaagccatgaaggaggataatgttttggtcaaggacacaagagaagcctccagccaagtaaaacaccaaagatgatctttttagcttctttgtaatgtaatgatggaactcttcccaaaggtttggaaaccattcaaaatgaacatcagtttttatacagtcagatgaaatgaccacattaaagacaggtggctaatggatatttttggggggtctgtagatagaccctcagaggttatttaaggagacatcttgcaaggctttcaggctgggtacactgtaagcttcgtgtataataatgtgcatctttatcaattgccgtatttatgcaaactagaactaacaattctctctctgttttgtttcattcaataagttatacttggttttctcttcatgttactgacaaagagataaagatgtggagaagaaaaaaattccacaccaaagatatcttggtctcgtggagtcatatttttcatttaggaagtggatatagcaaggcagtacttgatctttttcaattaatattttcttgtctttagactgtgaccctgaagacaaatatgggatactttttctttggagaaactaagggtgatttgctttggcaatgcttagccatgataaagcttccatagtgttgaacaaatttatgttcagtcatcaatctctgctgaagacacttctctttacctcttattaattaggctcagaatgtataataggatccttcctgcagatactcctattaaaatttacatcattcctgaattggagtttcccacattactatggatagatcagggtccagactatgtttcctaatgcatatattgtatctgtagacttgatgccacctctctgcagtaccaagactgacagatatgtccatatgaaatgctgactttgttcaaacatgcaaacggctacctacctcctctcctacccaccctccaattgctgaagttccattcagcttttccttgtcttcagaaagtatattgaatgaaggtatagaaaataaagcatttaggccaaatgttgggagctggaagaggaagaaatcaactgttaacttcaaagtgaaaagacaccaatagccagaaaaggttttctctcagtacagattttgctgggagtatatttctctattatttcaattattacaacttcctgcataggttgaaggtcattcataattcacgcttctgtcatttttagacatgccaaatgcagtctattaagcataaataaaacttccagtgtttgatcaggaaaaataaacggggattcataacaataaagccttgttcatctttttaaaagtaaatgtgttttccttctttcttattttcccccttgtgtgcagaacttttctgtctcaacaatacaaacataatacttcaaatcaatccacagataaagaatctgacagattccagatttttgttctctagtataatgaacaagacccacctgattaccatttgaaaaaactaatgatagaggatttggttgaaagcagtccttcaaagtataaaacagagttagactgaaagtcttttatggcatattaactttcctatcaaagtgcttatgagtgtctatgcctgctttactgctgtcatcttggacttaaccaaataaaatgaataatgatatatgattaattctaattccaagtatatataatataaattttataaaacataatctataattacatataacttgtatgatatataataagaattaatcatgtgccatgaagcattcattcttattatatagaattatatacatgagattactaatatgaaaatttaaaaatttctccaaaacatatactttgccatgtttatgtcaaattataaaatatgtaatatatctaagcacatttatatttataaataacaccacatgaaaatgtacagtttggaagtctaaatttgctcaatcaatttcatatcaccactgtcttttatacttaacttagccttgtgagtattagctgaatggatattctctttgcatttggaattgctttcagggtttgattaaaataaattaattataataattctgtttagggcatttaatttctatatacatgtataatattataattatgccttaagctgtgggttttaccagtggtaaaactgaacaattttggatttctagttttacttttcaactacttgaatcatttagaattttaaataaacatttagaaatttcactagtgtgctatttgaacaaattttaaaaataaaagaacatgaagaaatctgttactaaaacatttactataaaaacttatccttataaattgaggtatccagagatccaaatataatattcatacttacaaaggcacaaatattgcttcatagaaaaataaaaagagtctagcaagatactgggaaaatttaattttttatgtgataaaatgaaaaaaccatctcaactggcaaaagtttcagatgtatgggagttaggttagttcataacatgttgtgcttctggattttggtattagctaccaaatagaaagttttggaggagttaacacggttttaaaatatttattatgactttttaaaaaaatggaatttccatataatctattttcttataggccccattcttcttgtctttcaccttatattgggaagaattgagttttttcttctcatagaacattctgagagagagagcaaaaataacaaatgaacaaccttttcatattaactcaaaattttctaagtgttgaatatttttgaacctctctttatttattgggggtatattcattacaaaatttcagatccaggatatttttattttgaatccagagaactttttacataaaaccctgataggagaagagacccattattaactgttttatggaacttaacagattaattgactcccttccatttttctccaacacaaaaatgagagagttatattagtagtgtctctgcttatggcacataacacagatggtatgtaattcactggactgcaatatactcaagattttgagaatacagattttaaagacattataactctattttataagcatggtcaaacatacttattatatacaaatatgtgagaaaatctatataaatcactcctttgttgcatttttatttgctgaaagatctattttataacataaaagtatattttctgaaaggcctgattcctctaagatgacatcccatcatttccccactatattgtttcagggctacaaattttcattttgttttcatttaaattactcctgtctcttctcaaatgcctgctggcataccattaatgttattagaaagtaaattaaatttatatgtagacatccctagattcaaggattcaaattatacttttgggccattgtaattagaagaggaaaacaatgttgcttaagtgtctccaaaaccctaagggatgagaggtaatgaagatcaggtggtagaaacaccttgagaaaaggactagcttggtaagggtatggcaaatggaacttcgagggacattcttattgctatatggggaagcatgcccagaatctgccctcattatatctggcgcttgccagttcttttcaaacctcagtttcatgagcaccataaaaactcacttaaaattgaaaagaacaccctgaagttaaaatccactttgcttttctttgcctttcatggcttggaatgtcaccttttacctccagtaaataaagccaacatcaacactcttccgtgtcttttattttgtatgcactcaatattcttcacatgacaatctggactcttaaagggaaattacagtagtgatctatgtcttggcaaagagaattgtctttataatatatagttacagtgtatccatcaatttcttttgtttcttagactgttcacattggattgagtaaatctaaaatggaattaaaagagacatgattaatagtggactacaaagaaataatgatatcataatactctcttaaaatgacctgacgtgtgtctaagtagtattccccaatagagacaattgcactgttttactgtcttgtagggtattgtctctttaacctcactatttccgagaagccaccgaaaagttctaatatgtcacaattcaaatgtcaacatgttgttggaaaggaagctaataagttaaacctttgagagatgccaaaaaaagaggtgattcaaactgttgagagaagtccattgttttctaaggggaaatagaactccagaatgaaacagtgtacttataagtatttaactggaaagtttaggggaaaaaagcaaactcacacattattttattattattttaaatctggtaatctttaaaaagaactgttctcagtgtacttccaaggaaaagaaaatgtgaacagctagggttaataggatacaaagtgcaaataaactattttttttatagaaacagcacataatgaggagtaattttgccaagttagtctggattctatctgtggacaaatacaaagaatcttaggttatattataacatattatagcaacattttatgtttagcattgttttctataaaccagcttcaggtggttcaactactattgaatgaaaaaaaattattttattttgacaggaaagaagctaagcagaaaatactcctcattaagttatttttcaaatttagcacaattttgtgctccggtcttgttatagaaaaataaacaattggactttagagccacctactggaataaagaggcacgtacaaagttctcatctttccaaaatataaatagataaataaaattaaagtatgagcatttctgctgatcttataagacatcaacttatgcagcttttcttagtttgaaatatcatgtgatcttgcaaaaaaccatagttaacagtaatatcttctaagaatatattcttagaatatgatggtggttgttgtgttattgttttggtagtgtatgtgtgtgtgtgtgtgtgtgtgtatgtgttttgctcagatatttagaatctggacttttttggcttaataagattgattctgggctgggtgcagtggcttacttgtaatcctaggacgttgagaggcctagatgggcagattgcttgagcccaggagttcgagaccagccagagtaacacagtgaaatcccatctctaccaaaaaatacaaaaattagctgggtgtggtgttgcatgctgtagtcccagctactcaggtggctgaggtagtaggatcaccagagcccagggaggttgaggctgctgtgagctgtgatcatgccactgtaccccagcctgggcaacagattgagaccctgtctcaaaaaaaaaaaaaaagaaaagaaaaaagagattgattctgtttgtggacattcttaggaagattgggagaaaagacttattggcactgttaaagagagagaagaatatatgaggcaaaggaataatttccttctcagagtactctagggttttgcaaagatactgtggtataatataattggtctcattttcaccagttaatcgtagaacttcattctttcttctaaaacctctatctgattatgggattgtttaataaataaccttagaatgaaaaaaaactgatgacatttttatggtagaatgaataaacatctaaagattttcatgcttaaaagcttttttaaatgaacaaaaaccaaaaaacaaaaaacctggtccctggacaggtaagttggacaatgacttgcctaagtcaccaagctgctcaggagaaaggcagtggctcttggaaatttcaggtcagggttctttccacacttgctccactgcttttgagtcagtcattaacagatttattaaatgcttcctctcctcagcactttgctagaaagcaaggggaataagcaccacccccaccaccccaataaatgaatcaataaaatgcataatgcctactttcaaagagagaggatcaggagctgggcctgagggcaggaccctggtatgggagcacccttctgattggtgagagaggggttaagttttgaaaaacaaaatactctcctttgttgtcatgatcctttatgtcatgtcctttcaacctattaccttccaaacacgttgttgagaaggcgctacttttgcaaacttgcttaagtggggaaggtacaaggtaagctaggctactgctggagaattccaggcaggattcaactctgtgagtacgtgtggtttgctagggtgctttgaggattcagagaagggaaagttcttcgttaaacattacacaggatatatgtgacgcagctagccttgcattaagaaaatttgatttgtgaagtaggatttggaaaagatttgtgaactggcttgagagtcacagctttccatttgtcaccagagggctggttttcaatatataaaacaggaaatcacacttcttttgataaaaaagaaaaagaaaaagatgtttgttaaggtgtttgtacaggtatcttagtgtatatcttgccctttgttaatatatatacatctctctctttcctgattccatccacctttattttgtctttaaagatattctatagagtagttgcagacattgcgccgggagaggagcttctgctgttcatgaagagcgaagactatccccatgaaactatggcgccggatatccacggttagtaccactcacgccaccctccttatcaccttatcatcgcgactataaagtagcatcgaaagcatccattgttcctggtgtttgttagtttccctggcttttcaatgtcagtttcaacaagttccttctcttgaagcagctattttcttggtttgacatctggccactattacagtgaagctgaagtaagcagaggtcttccttaaagtggaggtcaaaggaattttgagcatttgcgcagaacctcacctagttaaaccttttgtcaatgcattagtttatggtgagaatcctttcactgtgtaacggatctttcagggagcttgattttgagctttcctaaatcaaggggatgtttctgtcatctaatgttctattactgggaaaagtgtttctactgcaggaaaatcttagccaatatgaccatatgggaggggtgtcagggaagaggccttgggaaaaatgtatagatgaagaaattatagaggcagaggactttttatttgccagaggcctattctaaatcaaaagataataaaaaataatgataatcagtagtgatacatgtttaggtcagataaagagaaaattttgcttatattgatttgtgtcattgagatggaaatttaatatatatttttctttttcctctttctgtgtccaagtatactgtgatttggttcaacataatctagtggcatctttagaatattttgtagttggaaggtctattgggaaggattacccattccaacccatcacagagtcagggatcaccacccttcatctctttagcatcccagatgggaaaatctcagcttttgcttttatatctccaggaagctgccactcttggcgggttctctttacttgaacaatttttcctttggactgcattctgcctctttgtaggttatacaagagtagttgtatttgcagggggagggggagggctggcggcgggggcggggggcgcttttggtactcattttcctcttagcaactctgacatgcaaatagctttagaaacctagagttcccaattagcctggtagagtttgagcctgaagagggtgtctggcccaatgggaaagggctcttcggcagcaaggagttcttagatgatgaagaactgcaatctgggctttctctggtgcaatgaatatttcatctgtaaatgttagacctaaaaaggttttcaaacaattatttttatttaatattaatgattaggttaatactccaaaagttttaaatagaagtgactgttcttttagggctgccattcataaattactttcctttacaacactcttgaacccatcagttgcttcttgttttcaacatatcatgtttacatccatacatacactacatatgttacatataattcttataatatttaaatgatgatttgtattttatacttctaggattcaactcttcctaggaaagaaaatgaaacacatgtattgcacacctactatatgatagatattatatactctctctatattgtctcatttactcttttatgcatagaacctgtgggaaagaaattatatccattttacatatagggaaactgaacctaattaaggctaagtaaattgtccaagaatgcatggctagtaagtggtgaggtcagcattcaacccaaaatctttgctgtctctgatacctaggctttttccatgcatgatgtggcctagagattctgcttgtgttcggactcctggctgaggtcctaaatatagatcttaaacaaatgaatagtattacagactataggaaatgtttctcctaaccagctaatgtcattgagaatcctgtctttagagccaagttgatttttttagaacacttccctctctcgaccctctaaatccaaagatttctgttaccactgttactggtttagtataaactaaaccagcatcttatgtggatttctgcagcagtgtctcacttggtctctctgcttgacttctcatactgaaactggggaaaattcttctaaaaaccaagtctgaatatatccctgctttcccactttcaatggctgttttccttcttagcatagacttataaagcccctggtgagctgcaccccctccagcttcattttccactcctcccttacatgtgctctgtgaacctaccatactttactacagctctacctttctgtggatgtgccatgttcttttttgcctctgtctcttcccatttcccgaaatgtgccccctccttccacttcacctggctgattcttactcattacagagccttttctgaacctcttttcagaaaaagaatacttgactaaaagaattcttggactaaagtattccccccaaaacattcagtcaatgaacaattgaagagtaacatcttccttggccataggtctataaaagagggattatgtgtcatattgtttgccgtgggtattttttagcagtgtgagctgttttcaagacttctgtgattgtatctgtgtgatctgtgcggagtgtggctttatgagtgggctgaaagctattcaaaagacaaaaatagaaacaatgccatcactacctgacattttataaccttgttatctctataccacactactaccatttatttatcttattgatttaaagtgcaaattaatgatatgttttctatttaacaaagctatgacaattagcactgaccctggggtaacataaattagcctagaagggtactaaaaacatcctgtgtcccattattagtgatgatgaatgttaaactatttccaagtttgctgacattaaccaggcttaaacatggctcagatagggactctgtgtcccatgttctttccagataatatggcactggcataataagaagtgtatggaatagaaatggtttcaaaaccttatacagccacatagctctatactccctgactgtttacatttgacttctgtgaacctgaaattctcatctgaaaaccaggataaaaatctgacttacaattcctcataatcaggttttaaggaatgtcagtaatccacatacagggttgagaaaatatatgatgctcagtaagtcgtatttattatttttagtattctctggacctgaaaaggtttagtcaaaaagttttactgatcaggaggaatatactctagtcacagccattgcttatgttattgttccagtctctgtccttggttctttacatatgatatttctaatccagattaaaattgacaagatagaaatgacaatcaaataatacctattatgtcttgtaaaatttggtaagattggctggtttgtgatggcaattcctgaccacccaatcctaacacctgaattgttttcacagaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaaggttagaaatggcatgttgtaccatacaacttgtgtattttttctgcaatgttatgctgaattttgaggctttgtgcagatggaaaatttggaactccagtgagctggacaaatgcactcgtgacatgttcagaaatcatatttgcctggatattctcatctgtaaaacatttacagtgaaattggaattagttattttgatgtcagatgaaaaataatgttatattattattaagtagtgttattaaaaactgaaggcttaactttatagtaaattgtgatttagagaaaatatagtgctggaacaaattaaagtaatcatatgtcaagaaacaataaagctacccctaggaacattcagatgattttttaaaggactagatctggtattcacttaatgacaggtaaatgatcttttgatagagcagtaattcatggatttaatttcaacaattgatctaaattacatatatataaaagaataagagaagcatgtttgatttcccaaagtgttgaatttcctaaaaggaaaaagagaaacacaataacgtaaatgaagtaattctttaacacttatttttaacacaatgaaaattatatttcagtgacatattaactttttatagccttttgaattttattctataactttttaaaattgctgataacaacactagaacctactttttgaaaagtatatactaattgtactacagaatggtctttaagattagaacagtttagaacagttaatgggtttttttgtttgtttctacctaatgatttttgccttggtccacaaataattttaataattgtattcactattttgcttttaaatctggaaattatccttgaaacttgtaatcagaattttaaatgaacatcacattatatttaaatgggaatggtagtatatcaaatggccttactcaagaatgggaattactcagattttgtctttgacagtccaacttcagtttacccttttgtttcctttccttctttcctggatccttttcttcctctcattttcacctcatgtatagccctatatcctcttctcctggttacgcctcttttaggaaaggatttcatctagtagttcattttaaggcataaatgactaaaaggcattaagcataatcctttctgttgagaagactgaatagaaaggataagtatctagctttgaaaatttaggactaatttagctattagagagtaaacattttaccgaacaagagggctttcccagaactttttaaactcacctctgccacttcatataaatcttcatagagaataaatcaattatgtatgtttagtaaagtgtggatttgtaataaaaaagccacagcatgtccctttaatataattgtgcccaaatttaaaaaaaatgaagctaacaaatacaaatgagtaggaaaaaatatttaaactgtaaagtaatatctctggtgtcagaaataaagtccatttccttcagttgtgttataaaaaataatgaacggcattataaagcaaaaattgaccaactaaacactaaaatgtaattcttactttctactaagagtgtacagcaatacttcttgggtggagaaagcctcttaatctgcctagctgtaagattaagcctgagtcaactctatctaatgctgaaaccaactgttagtttagttgattcagtcaaacatttagtagaaaacaataaggaaatctaattatctgtcattgcatgaattctcaacatttatattttggtagtccagccatatggataaagcatgtcactatgcaattgaatgctaatcctccaactggtatttttggttataaattatatgatctagccacattcagaacctttattttctgaatattttttcctttattgaatgctatgttgtcactttatgctttaaatgacaaaaattactttctggatttgatctgttcttctgctgtctatcctttatgtaaaatcttgagaaaagaatgcaaacaaaaaaataggagcaagaaagaaacaaaggtcaatgtgcaaaaggtgaaaagaactgaaaagaactcaaaagtctgatcaaggctctatagattgagataaaattccacgaaaagcagagaagtctcactgactgactgcattgcttctatgtttatgaaagcaatgcacatttacttttgtgaaaatgacttgcttttttgtgctttttattactgattagctggaagctaataatactatggaacaatatggagtttctgcccgattagaaacaaagaagggaaaattccttttgctttgttatctttttacacctacatgttcataatatactcttaaaattaaaccatatccttggaattagggggaggaataaaactcaacatataggccaagcttttgccactagatttcagggtttatgatttgatatatagcatagtagaatatatatcataaaatggcttgcctgtatgggttgctagggacggacagtgagaattgcaatctgtacagtgattttggaggatgtccctgactcatttcaatgttaacgacagttgttggtatctctgtcttaactcttttattaacattccactctgtaacaaacagaggattacatatcgtagataaagttagggcctttcttatgactccacacacctgtactctcctagtaccttttgttcacagaggtatcaccacctgtgctcagaatagcatttccaactcaattgattcatggggcaggaaaaatgagttcttgtgccagtacgaatagagttgtggggaggaagctgagaaagagaaaattaggaaatgcatttctaatttatcaagatatgagaatgggcacttcattttcttacatatactcccagtcacacagtctgtatgaccactggataatttattctaggtgcacaaaggtcttaattggtactgatatttatagcattcatcacacaaagaaataaaagaaaataaaagaatgctttcatggttggtactttttcttttctaaataacttttttattgtggagcgcttcaaatatacacaaaactagagaggggataggatttttaaaatcccatatgttcagctttaataattatcacatgaagccaatcttgtcattatacctgctttgaattatttgaaacaaattctggacagtatatcatcttattcaaaaatagttcagtatgtgtctatagaaagtaaggactccttaaaaacataagttcaataccacattaaaaataatttcttattatcaaatattcagtaagagcacaaatttcctcagttataaagtttactgttttgtttgaataaagatcaaaataaagtccacatatagcaattgattgacaagtctgttatgactatttgaatctaaaggctcccccagagggcagtctctttctctctgtgtctctctctgtctctttctgtctctgtctgtctctctctccaccaccttctttctcttattacaatttatttatagaaaattatagaagaaactgagttggattctgctgtttatatcattgtggtgttaacatctttctctatcccctctaatttcctatagacttgtagttacatcccaagcctttgctgggatttacgctcagtgtttcaccaagaagatttcattgatggtgccatttatttctacccgaagtcacataatggattgcctagattcattaattctttaggagcttcaaaacgaatgtactctaactctatcattgtttcatcatttattacctggattaatttcgcgtagagaaccttcccttcatagcctatttgtttaccccaaagtgcagtttacataggaaaagcagatatgtgcacaaatattttccctttatttaccagttttaggaataatgatttggctttcctgcatcttccttgggagaccattggggttctgtttgtgttttgaatatctttattgataaaagagttgctgttcttattgatgcttcacttgccccacctttggtcagtgggcatctcttcaagttggaaccctaattttttggatattatctataaattgcttgccttttgtcataacaagatgttcaagggccatcttgtgaatttcatagttcagatttgaaataagctattttaccacggagctctggttactttatttgggggtagtatcccagtgtgttatgtatttaatcaataaaggtgttgcagacatcttctatcacataatccattatctataatatttgcttttcattatattcatgcagatttcatatacaaattttagaaaatgggggcaaacatttgagaagataaaacaatttaaactttaaaacagagaaactatgcttgtgagaaacttctaatcatgtttttcttttaggggacttaaatgttgcatccacttaaaatattacacacttttttgctccccaattcttaggttttatatattatgtaatatatatatatgatacacacacacacacacacacacatccatgcatatatccatgcatcagtccatccatccatccatctgtccatcctagattcactagagattatatacattagacagaatacttttaagcattttctgtttgagtgtttgtgtttcagttaagtgagtattaagctcacaagtgagcttaatactcacttaattgactactcacttaattgtgagcttaatactcacttaattgtgtttcaattaagtgagtattagcaatacgtgttgttgttagaattgtgtagtgaatccaaaactggacaaatagcttgttgtttatcatgcttttaaattggcagataatccctgccagctgtatcagatttattttctaacaacaagaacacatcttcatattggtgacacagtccaggagacacagtccaggaaatataaaatgcacttttgtctgtcacaagcctgtttctgctcttccctccttctcagttcaactccttttccttcttgtttctttaattaccagttggattaacaataaaatgatgttccgtttatgaatgcatcctttgtcttttaaaatctattgttctcttaacagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggtacagtgaatttgtaggctacttggcctctctatgtcatcctgctctctcttaatccatcacttgctacgatatataaaaacaagccttcagaggggaaactataaatatcttgagaaaagtacactgagtgttgtatgctaaaaggcattagtagagtgtataaaaacacttagtgggtatccttttatttttgtaagggaggaagtgaggcttaatggtgagttccagaactaggtgtcagacatccttggtaaattcctggttccgctactgatttgccagtgtggagttgttttatggccttgcggagaatgaaaattttatccaattcatgttactgatttcttttaatagcaatttgtgaggaagtcacataaaatttctgaatgcctattcagaaagaatgggtgactcttatatttgcagatttttccaaccaagggctcaccataaattatgacttggttctaattaaaatgtatagagcctctgtcagtgctgaacaacatagggatgatatggaagtactcaacttagaccataactgtgaactatggtaaaagtaattcacttcttttaatttcatgtttcttgattaactcaaagatgtcctggtgtcattaaagttgctttctatttccaaaacacatttcctagcattttaatagctttttttttttcatgccaatggaaatttctgtaccccaccaggttactgggtagtcattctcctgtgattaccttgttctatgcacattaaaattttgtatgtttttttctcataaaaattaaaaaatacatttgaaatttctttagggatgttttgctctcagatgtgttgggtggcttttttatttttgtttttagtacaatgtctaaaggaatggttttagcttgctagtaactcactgaaagagtgttagaattttacgccctagggaaactctttaaatagatttaatgtagttagtcaaaatcctccaaatttttgtacacaatgtgtctttatttaaagggtgaaaatagcacaccagttttaataatggcttaaccagcattttattattcaactcaagtcactctaaatggtatcaaaaaggccttgaatatggcctaatagtgccattcattatttggttcaactgataccagtggatacaccatgctaaggatatagagcagaataatttacagttcctaccctagaggagagtacattttggaaattagaggagagtacacttttggtctttggggaaaagaaaaacaaaacaaataagaaaaatttcttcttgagtcatcccgggtcttctttattgtgcccttgagttaagtttcttgattaatcagtactcatttcctagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtaagttttcaacactccagccctccttcccacatctgtctcttccccaaaaggcactgtgaccaggagagtggctgcacatggcctttagagggtcaccgtgttagctatttatggtccaatccagtagggctatttatgattacaagtaaatcttttataatcagatccatggtattttgtccttgattcctggggtgttttctttcagaagaaatcaataacaggtagagaaaagaaaattcattagataatcaaagggaaacctccacaggttgtaggatttaatcaggacaatcagatttgtctcatattgtaaatgttcatggctttgtaaagcagcaaatagcagccatcactaaacaagatgaagtgattaaaaacctgttctggatcagaaagagctggaagaagcccacctgggaagtaggcttacggctctgtgtgcatgtatgtgagtatatgtgtgtggagagagcgagggggatgaaatgctttttaatctacccattgttgccgatcacaggctgtcggatctgtagttctctgttacttgaagaaaagcagaacattttcacttagatgctggacatgctgtttctcttacccactgcaccaaagcaagtttataggcagtgtgcttttaggggacatctgatctgaccacctacttagaacatccctgtacagagcactgtagtaacatccttcaaatacaataaaactcagctctcatttgctttttcttctctccgcccactcctattctctgtattgtgctcaaacattttataagtaaaatcagttgttcttagtctacctgggcaaaaaatctgggcttcttttaatccattgcttggcggggcatataaatacaatgacttattgagttgtgctacaaacgtcaagactgattttggacccagatacacatagaattggttgaagcatactcagcacttggcaagacctctgactttggtttgtagtaggtatatgagacactactacaggacctgatggaaaaaactatttttcagtgccaacatggagatgccagagactaactctcctttgcctcgacacagctttcttttgtgtgtccaagcaccaaaatagcttttctttccttttccagcttacactagagtcctgttttgctcatatgctcttctgttccccgggtgaagaggactagcagattaaaaaagggtgctctcatctcccttggggaagctctattgaaggtcacgggaaataaagcattcaatagaaattttagacttcttgtcgcaaaaaggcattcctgactcttaagtcttaatgccctgaaaatgtacttggaagtactacaggcatacgatattaaatagttcatttatttctgattcctcagaaataaattttggtaagttttattatgttttgatgtgagaaaaaactagaataaaccacaaggaattctgatcactcatttaatgctttctctattatttaaaataaaagtcagaaaatatagacttctgctatcgaagattctgggatctggaattttaattgtgttgaagacaagtgtttcactttaaagtgccatagggtgtccctttccaatcagattgcataaagtatttcccttgaatgtattttcagtaattattggtaaatttaaatagcagatggcattcttcaaatttaaaatctgccagagaaccatggagtaattatgaataatagccatgtaatttcagaacaaaagagattaaagatcaggaaatggtgtggagacttgagtggaggaggttcacctagggctgatatctgtttctcaccagaaggccacacaccacgatttacccccactggtgtgtttatggcaactgtctcttattacagtgtgctgccacgcttgagcccaaagtcaccagtgctaaggtaattactcactgcctttacagaaacctacagctttcccaaatagaaaccacatgctctaataggctgaatatattcaaaatgcctcttaatttgtttaataagtagaaaaatgcaatgttaactgctggctaattccttattactgagaaaattacagtagagtataaacttcaacatcaattgaaccagtttacctggaggcctggtagtttgtggtatgccaggccaggccttcaagtgccgaaaacaaagcctctgcctaagaaaacatcccagattcgatgttcttgagcccagacacagacagcactcagccatgtaacaacgggtgccaccagaaaagtcagctgaacttctgttactccaatagagagaagctcttgatttttttttttaagccatctgattgtaagaaagaagtgtagagagcaacatttccttgccaaaaaatgacaagtctttgaaaaacttatgtcttggttgaatactcatcaagacattttttcaatgccttttaagaggtgttgctttcttactttttataattccaataataaaatattgttattgcttgtagctataaattattctaatatatctagtaaacatctgatgtttctaccttctccattatttgattttaattagtgtatcaaacagtttaaattagatgtatatttatggtgtatggttaaattgtatatacttttaaagctgactctggtcgatatattctggtaaaataatttgaaaagatatcacccacatcttctattcccattaaaatgcatgttacagcctctgtaacgttgtgattcatcccacaattgaaggcacctttaatattaccaaacactttgatatatgcaacaatacactttaacctttagtagtaaaagaaagagatatacccttacttggtacttcctgtttggatgtatgtgggataatccaagctctgggtgagttttgcttgactgaaagtctataaaatctccttgacatgagtttttttttttaattattattgctttgacttagaagcacaatcattctgcacttaaaggcagccatcatatgaaagcaataactgttgcattttgtcttcaatttaatttcttaaaataaatttgcttcaacaattaccaacaaggtacatcttgtttctgcatgtattgaacatgcacagaagtgttaaaataagctcacacataacgtggctcaatcccgtaaagtaaaataaaaaatgtgatgctcagggtactgatactgtaatactgctggacagtgaagtgagtgattcttacctggtaaaggagttattaagggttacaaagtttggtcttaaaatatacttggctatagtggcacatgtgtgaggaggaagattctactttattgacaaattcttagcaaagaggcatatttcacagctgcatccaatgctgtgcccttctttctggattagagctttcacagtgctctcccctactgagcatagttggctataacacacagaagtcaagcctgagataaccagtgtagatatgacaacaagtggacatgtttcccaaggacggggttttcataaatgcaggaaggttagcacaaccactggtgtgaggggaagtcagaggacgtgatcatagttcatgggaaccagcaatgcaggatgggctacattcaatttagtttcctttgcaggcttaaaatagagccattgtaaattatgtcagtctttctcaaatcatgaaaatgattgttaaaaaaagtctcagaatacacaatgtgcattgttgtgtggctttgatgtgtgaatgatgagagcatatgatataataccaattaaataatagcagggcagtcacaggctttttccccaaggggagaggcaataaaggtgaagtttctggttgaggatattttattttgttttggtgcctacaaaatagaatttttaagtactctaaaatttgaaaggggttcttgttgtgttttgtacgtaatgcattttaagactaattttcaacattatattagtataataattgtgtggagaatcaatgcatgatggaatttaacttttcataaatatttaaatacacaaatattatgcaaaatattgcacaagggggtgacaagatatatatatctatatatatgaaatatttgtgctgcctcaagacatttgtcaggttggttgccttgctttggaatctagtgaaatggggttttctgtgtttggagcacccagattggtgcctccaatgtcttttactggcttcctaattgaaattttgagtaaaccaattgtgatatttgctaaattcagaagcaattgacataaagcctgagattcttttttgttgtttgcacacaggtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacaggtaagcgtgtatggaagatgacgaaatatgagcagatgtatgaaaggcggtatttccactgtaaagtgatggctttttaacacatcatttttactattattataaaacagagtgaagttgtttgatctagtgaactcattttttattctgaaagttggatcattctgtttgaacttatttttggatgtttctgaagttgggggtttggaataggcctacagaatttttttcccttgacaataaatttatttttaaacactttttttggagtggaaaatatgggaaagtcatatttaaagtaaattgtcaagtggcggaagaatgaggatcctgaaggattaatgcaaatatgcgtgggtacttaaatgggtcaggttctttggaatgggggggatatataacagcaagagtccactcttttttgacctaccaacacatccttaataagggctggtcatattgtttctaaataaatctctcaggagcccccaagtaaatgaaatattaatcacagaatatgttttgtatataatatgagtagttggcttaaaaaatgtctctgtttaatagcttcattatccggtttcctttgatgtagcaaaaaaatcttggggtgaaacatacaagtttaataaaaggcctttttggcaatattcagtaatattcacctgaccaaagtgatttagttttaaaatactagttttctttaaatgggtatgaataataatatgtttgttacatattttgaatattacaaacattttcacatttactttctcattctaatcttgaacattgtcaagagttcatggaacatctggataattttttattgaacttatttaacatcggagtattttcatattttgcctaattctctttcgtgaagagaaaatgtgctattatttaattcaacaatatttatcaagttcatattacttaataggtactagagctgcaagttcttctcacttacaattcttcttctatgtatattatctataatgcgttaacaaggaaacactgtcagtatggaaaggactaccctcgtttgaatatgataaagtagtatcaaaggacaatacaaaataactcagtgctgtcagtaccaagtttggctgctttttaaaattattatatctcaattagtttggcagtcctgttaccagagaaggaaaaaaaagaaaaacatgtcttccgtgttttgtgtgtagattgtatgtcacacatttcgggtaaagtcgtatttccaactcaatgatgtgtctcagtcctttgttaagataatttttcaggctttcctttttgtaccctctcagtagcaactggcttctgattcttccacatatctcttgcactcatcctcatcacctactagcattcctcttactcactgtgatctccaacatctctctggtgcttgtctcaattaagacctaggcctgtcattttgccaaactcatgaaagacctagaatccagttttagtgtcagacttgggttgcaacctcagccttctcatgtctgagacttaaaaaaaaagcataaaatggatataacatcacctacttcaaaaagtgaaatagtatatgcaacacacatatatcacatatataatatcaataagtggtaggtattttattctgctttaagagtgcacatatctaaaagtttttttaattaccaagttggtaaaagaaattaattcaatgaattaattcaacatagggatattatttccctatgtgcttaatacaaaatagaatggcaaacatttctaaagcagaagggatatataggtaagttttatgtgtctctctctatcttcagaaagctccccattctcttctcaccacacccattctatctgcctgccttctttatcagcagtggcatccaaagagcatatattctctctctctctctgaatatatattaaatataatttacataaaatatttatatatcaatatattatgctatatgtttaaatataaatatatattgagagagagagaacctcaaagagtggctagcagtgtatatgcttggaaatgcccttactattattgacaaatatggaaggaataaagtgcacatttgggagaacaccttcttggtagaaaattgctctaatattcaaaatcagccttgacctcatgatttcaaaatcattaagcattcttgtctacatttggaatggaaaggtactgaattcatgacaaatgcctctaatttagtgactccttatttttcatgttttctcgttattcctattcctagtcattcagtagggtttttccattataaataggaacttttctccttaagcacctagaagtgtcatgaggaatctccaagaactggacagatgtctctatagttttatgagtgcgcttcccagaaacctaccattgactttattgttagttcctttaaatgtcagtgattatgtagtgattgatatgtgagactgcttcatctccaaaatctaattttaacctttcagagtagagaaaagaaaactaactgacccacttgaagctttaaaagagaaatacttgaggccttctccaggattcttgtttcacccacaagtaagtattttggatttgagatttccagcttgtaaactaacttgttgatcctgaaaagcaggtgcaatgaaatgaaagacatcttgagaacattaggatttcctatgacgctggtgtggaagaacacaggaaattctagcagaattaaaacccaaactctttaaagaaaaattagttaatatatgtgtaaaaataacatgatttcagtgttaaatgattgtctgctattaactgtttattgagttaaagtgcattttggagtgagcaggattcagttaagaaaataaatatccaagatgtgttttgtgtgtggtggttgctgatactaagaaatagatcatactgtgactcgtcccatactcatgaaggtcattcttgttcttttcgggcttagataaaaacaggaaatgagtctacctgacaagttgttaccatagagggtgaaggaatttatctagagaccactgagcattccagcaaagctctgtaattgcacaagaattcaccacaatgcacagtgctatttgcagaatagaattgtgttcatttatcaaaatatatacagtttatcattgcaaggaaaatgcaaagcagcactatctctaattggttcatcctaaagtccttatacatttagtaattttaaaaaacaggtttacatattttccaccatgtggaaaatcgtattgaaagaacaaatacggtatataaacatcttgaatgtggtttcttaatttaaaatttattttacttttgtttaaaggatgcaagctctggtctttatagatagcaacattttaataaaaattcttaaaaatagaataaactaatttgttctgttgtaatatgttcaaacaaaaaatgatggttctctaataaaatcaggggaagtttatgcaagctgtcttatggaaagctatgaggtaattaaattaattaaataaagatcatgggatatggttcttttttccttttcctttctgttacctcttttgtattttttcaagtatctttctagagtcctgaataaagagtatgagagttgtaacacaatcttctgggttagttggataaatctactattactaaagaactctcactccctttcaaaatgagataatatgtggtttagcagtaaaagtttcagaaacattccagttagtattaattttatataggaagattaaagaatgttattcacataattactttatggaaaagaagtaagttacaaaacagttaatgtttatcgggactatattttatatttagactgatctaaatagtacttgtaaagtttcataggctaataaactggaatgtagcacatattttgtgtcagatattgtacaaaaagtacatctctcttgatacttcctttataattataaataaatacttatgaacatataatattcatgtatacattaatgttacaaaaattaattacagtaatattaattacagtagtcaagtgattttcatgttctgataatctttacaatttagtaattaaccatttcaaaattgagtgctatgggttcacggtagaatggagaaaaaccaaaaagggattcagtgtctttgaacatcttagtctacctggctcttagttttcctgtttgaaaaatgagagagtcgggtgtaaggtttctatccactttgaaattcaaagatgttttgctaactaaggtaaatttaccagttcataagatgggcagttttgtcaaccattcattctgtatgaattcgcagctgttagcaatgtagtaggtatatattttaaaataaaatcataagagagcaaatatgttatattttaacattcccaaagttaattaaggatcacaaaagatgaggcatgtgtccagtgcttcgagcatagcagtcattcctcagatcttcacaaacacgcctgtgggagcacagtggcagtgattccctcctacaccagaatgtcacgtcttggtgtaagggattccctattgctgcatgttgctattagaacaggacccaagagtggtgatcaaaatacttagaacctgatgcgtcatgaatacctaccaatcggaatggatttctgccattctggagcaggatactggaggcttttgctgcatcaactgccaatgttttatttgctggatagtgggactatctgaggggtgtttggggaagaggccaaggaagcaggggaacactcagggtgcttagggcaaaggctatttaccgactattacagaaatatttcattgtttttataaatatcatggctgttttcttgtgtcatgctatatatagctgggatacaagctgggatacaggtgagccctcttcctctttcatcaagtcttacccttcccagggtagctggaagagctggcatttatgtacgcaacatatttagcattgtgcttggcatgtggaaggacctaaatgaggaagagctcttattagtgggtgcaaaagcattttattataaatataaatatttatgcccaatttctttgccagggccatgccatgtatctaggagtgcttgaaaagatgcttattgtattcttggcatgacctcactgcagaagtaaggggggcacagatcaaggagccaaaacagaatgacttgcctctgttcttagtgcttgttatgatttcatagctaatgtgcttgcataaaactgttcattgcttcattttccatttaagtatattggagtaaatcacatggaccctctcagcatctggatcttcatttcaaaatgggaataatatctgccctatttcttgggttatcataataataaagggaggatcaaattctcaatgttttagggaaaagaaagaaggatgcttcatagtggtattctctgggcaagtctggttttacaatttttgaatatctttatattgttcccagcatattccttcccattccataattcctaatcagtgataagtgaacacctcagtaaataaaaatatattgaattttattgaaagattattaggctatattattgcgttttggaataatacgtattttaaaaattctgtcaaaaatacttagaagaggccgggtgcggtgactcatgcctgtaatcccagcactttgggaggccgaggcgggcggatcacctaaggtcaggagttcaacagcagcctgaccaacagagtgaaaccccttctctactaaatacaaaaaaatttagccgggcgtggtagcacatgcctgtaatcccagctacttgggaggctgaggcaggagaatcacttgaacccaggaggtggaggttgcagtgagctgagattgtgccattgcactctagcctgggcaacaagagcgaaagtccaactcaaaaaaaaaaaaaagatacatgaatgcatacatcaaaattaaaagatgaatgctgagggtctaaagtcttctcttagttcaattcttgaagaagcatgtttgctctatcaggccaggtgagaactatttagtcttctagttttcttttacaaataagttagtttactctaagggagaaataagcgttgtagaggctttccctgcatatgtgattgaaaattatttatggtcactgtaattttgaaaaggagttgaatggccacaaataggtaagatgcagggaatgttattactgtgtgacctctgaatgtccatttcgtttgttcctattttggatcctttgcattcacactgatagcccatttgaacatccatggaagtcattttgcaattacactattgtaaaagtggctattattccttggtttgattttactatacttttaatattatttttggttatttgcacattttatttccaaatgtttggctttgagtacatctgcaacagactctcttttacttacatttctatcctttcttcattcttttatattttctttcttttaaattggctgattatcatgctactacattccaaggaactgaggagacagtcttttcctaagttataatttacacattgatgtgaaaaatcacttaaatcttctgttcttcatcttctattttgctttcaacaagtgtttcatatggttagatttcttctgcaatcaagttttcatcctttaaaaactacatatattccttattaaatataccaaaacatgtataagcaaaatatatatctcctttaaccaagcaaaatgatatttttaagcgtatataacttttgtgtctcctggaagagcttctaacccactgaaggttttcccagtgactcttgtcagaatttgtcattaagagctagatctttttagttttccattaacgttcttaactgttctgactactgatggtctgagtcctatgctaataaaaatcaagtagtgaatttccaagtacattatcctttcattatccttttgttatttagtgattcatatttgagtaaatatcttttctttgttattaacattatacaaatgcaagagattggatttttacaggaaatggcctaatttttagtaattaaactaagtttaaggatattgttttatagcaagtagtagttaataaaaaggaagcatctgctttgctgtaagatttgctagtaggtagcatttagctttcttgtggaaattaaccttgattcaaacattccatttaggtaaacagaggaaattcaacagagttataacaatatttaatttttatttccaaagcttttactcaaggtacagttacatgataagcaaaaattactaagttagtacaaatgttaatttctcaaaggatagattgcaataaagataccaacacagaagtaattttttgtttttgtttcaattttgctcccagttccaactgcctgatcagagaacttgggtaagtttcctacttatatttttgactaaagtgatgtagcattaaaaagaaaacagcttacattctaaattgctgtacagacataaataattctgaacccctttccattacgtgatatggttccagcagatagtttccctgctttctcaagctgcattctttcagttataattgggcatttagtgggatagaaattgtttacagaatgattttattcgataaatctgatgcattccacataattataccttgatacggagctctttctggacacctgggaacacgctgttaaacgaggcttcgaaatgggtcactaagtgaaaacaaccattatttggtggagcctgtatcagcatgtaaagatgcttttgataaagccttctaaaggataaaacctgaactcgtgtgtagatacaggctgacatgggaattcacatctatatatcctagggcagaaattggttctggctatttgaagatataaaactaaatgtttacaaattcatgtgtaactagtgaatggatcttttagcatctagtttcacttccttgactttcagttactatttccagatccagtcagtttcaattaataatattaggggatagctttatttttattgtggaagatattcaggatacaaagaatactgcttatttagtttttacccccaaataaaacctggtcagtggaaataacatatagttaaaaatattctctaagtatatgtgtttttgtttctctttttcactgaaaattatgctgatttctgatgaatgagcaaaatcttgggatatagtttagctgtccttttaaagtcactgaatcattatatataaacttaattgaagcattttagcactaacctatttcctctatttgatgttaatttttctttatgagaaattccttcattttatctcttttgtggaatatgtaaaattgtgatttttctcattctgatagacttttaaggtttaagtttatttcaaatgtacacaaatatttatggagagagaggaagagagatcaacccactaacttaggcaaagttgtgcaatagatggggttgttttctgattatcctggcctacatttccagtattcttcctttgcctttcctggtagagatctgtcttgagtattgtgcctcacggtcctcatcttttctaaggtacagtatgactttgacaatagctctcttgttaggtggttgaagcttaaggtgttgaccccttacatacatggccaatgattgtaccaacttaccaaggcaatatagattttaagttaaactaccttttcttataatacaacagcatagtgattgccgttgcaatgctttgaaacattcccattccattgagtcacaggtttttcagagatgtgatttacatttgtattataaaacagatattagtaggaaatattaaagatatatgtttataatttttcgtggtaaaaaaacctctatgtggattgtttgtaacacaaaggatacatgcttgaggggatgaatattccattctccgtgatatgattatttcacgttgtatgcctgtatgaaaacatctcatgtatcccacagatatatacacctacaatgtactcacaaaaataaagaaaaaactaagtgatttcataatcatgactgctgaatgtgatacatggagtgggataaccataaaataggaatatttacttctcccccatatgaccatgattttgagatttctcaagattatcaagtgaataaatatagaaaatcaccaaatctacaaactttcccatcataagttatttatgaaaagttagttattttatgataaagtcatgtgtaatcgaatttgtaaaacattaggtcacataattcatggtgttgttggacatatcatttcatataatcaggttgtcactttaatagttttaatgagaaacctttttgtcatcaattattggctgccagataataaatgttaagtgcttaggacccagttgataatatcttgcctgctgaaatgtttttaaaaatactaactttatttgactagagagatagctacattttttggtaggagctagggaattgtgtctaaatattagtttgcgtcagtataaagttaatagcctcttggggactggaacagggtgaaatgacttcctcttccagacatctggctgcagataacatcaactattatatatgtaaataaaaattactgttccataggaaaaaaactgtcatttactgatcttagattagcctatgacattaatggatcacagggtaatatatttttaaaatatatgatctaattttacccctttgatttccccattctcagcaaatttcttattcctagtagtacatattgctcttttcatttgattttttcataatttaaaaacatatagctagattctgttccatttattccaatttatcttgatttttaaaatttaaaatgaatgtcaaaacttactatttctcctgcaaaaaagtgttacttttggaggaacatcacgtgactcagaccagatagcaagagagagttggggttttgatctgtgcactcaatagagttcgtgttaatccaatatcttaatctaaggtgttgactagggctgatgttgatcacagaactgccaagttaccccaactagcagatgtctgagtcacttctgtttatcttaatgtggaaacttattcttttcaactgaggtcaactgctataagagcacacattaggaagatgaaaagaaggattcaacgaaggcttttatgttgcttcagtggttgctggctgggcagaaaatgttttgtgtacgtgtgtatgtgtgttaatagttaccctcagctcgcttcccatcgtctttccctccctttccccactccaatttaatcctcttttcatttgacaccagaagccaaaggtgggggaggcttgtaagacacttgcgtaacccttattctttttcctattacctttaagaatgtcattatttagccatcaagcccataatatattttcttgtttcttgatggttttcccaaatcgaaacagtttgaggtaaagtaatcacagtgatctttcttcaaaaggagctagctattagcagctactaaagcaagacacatttctcaacagccaattgctctcaaataacttgaaggacttgtggtttatgtgtgctgaagatgaaagccgagaataatagtcatgagtaagctattttccatataaaaggaaacgtgtttctatgagatgttttgttgcaggagtctgagtatgtcagcaagatggacactcaaatgatttaaaaccactagataatgaaattttacttaaatattaaatgtacataaataaaacatttataatcattacccatgcattaactgttcttcccaataaatgtgtgtgatcatgacccttacccatgcttgttagtagtactaatcagtttaaaggccagagttcatttttcactcagaaaacttatttcttgctgggtggaatatcaaaatgattttctgcaaggaacaattagaaggaataaatgcaaatacaagagtatcataaaatatttctggattgattttttaacaaataaatccaaagtaacatggacatgctaatgctctgtctagaagggaataatgaccatattctgcagagacagaatttcctccaacctctgtgagcagcagcatcattccatatctctgccctgtgatcagtatgtgtcaaaatccttcatagtgacaaatgtgctgtccacttgcatctgtggagaatgttttagcagctgagtgattatgaatcaaacccctgagcttatagcccttactgcctcccgatgcgttcacatttgtcgtctgacaagtaaatgtatcttgactttcctctgagatttttttgtaccgtgtttgatgaaagacatttggcaaattggcagtagtaccctgtacgttgcaatttgtagctaacattaggagtccgggcatgaaatgagagggcaggctccaggataaagggggaaaaaagagaactaactagaacatgaatagtcacttgaagaatcaaacacacaatattccttttgtgagaagagatcatgttcaggccatgctgttaagactttgctctactttaagaagctgatggtattctgtccagctgtgtgtccacagaatatatgtcttgttaatttttccttctgagtaggaaatgttgccttttatttttaacttgagctcataaattaggcctccatctctgtcctgctgtctcattagcaaaaggatagtttcttgggttgaccagttgtttgaatttgcagtgatcatctcagttcttatgtgtcttctggtctagcatcacagctctttgagatttttatgtaatgcatatagaatgcaaacaccttttaaaatagcttcttgagctttctaatggcacactgccctgagaatcaaataaataatgggtgagttgatttaacaggatggcctgaaagtttgtttttctacttaaaaattcagtaataagcagcttccaaataaaatgtgagccctgaggaaacacaacatgttgagagggtcaaaggaaaggggagagtccctctggctgtggagcttaagaatcaagctaagactgggcacagtagcttatgcctataatcccagcactttgggagaccgaagcaggtggaaggattgcttgagaccaggagttcaagaccagcctgagcaacatagtgagactccatctctacaaaaagtttttaaaaaacagggatcaagccaactttaaaagtaaatgccatcttctgcttgtgactctcaaataagtgtgcaggtgtacaaaaacttgaagattataaacaacaaaaattagattactagaggggaagaattaggcagggatagttttctttcaagaatgtttctcgaaaagtgtggttacataaactgctccccctgtcttacaaggcacatgccaagttatgttatatgaaattatattaacatatgatgaactgtcatttcaacttagtctttgtctttgataaaattaatatttaatcaaaattctttgtatatgatcctacataaaaatatggcatatccagatgttaatttaatgtagtcttaggcaataccctcctatacatttagttttttctttctgagttacccatatttggcttaagctgtaattctgtaatacttcatgttctcccatgctttcagttcttttcttgggactgcatggttcttacggttttcattgcctaggtaaggcatatagcaacttttcctataatttccgttatgttaatatccataccatgatactaatgctgtcatttaatcaaataaaaagttaacttggctttattggctctcttatgtatttcaatgttcaattatatatcagattatgataaaatggcctaaccaaggtcttatggaaaaagttcgctcagcattttataagcttggttctacttatggtatttcccaaataaatcaattctgttgttgtttatttaatattgggatactacagtctctttctacaacccgtcgcagatttcatgcttcccttttaatgatgtccttggtttgccagagattattatagaagacaagatgccaaacgcttcatggtcttgtgcttttacctttcagatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcaggtaactgcacagttaattatggctgactttccagaaatctcccctctgatttcaaaaggccttgctgtttgttttggaaattattcctgattagatgattaatagccaccataatagatctccagcacttcaaagtgttcttcatttagtgaaatataaaaatagtgtttttaaaaaattattaaatgtgaattttaacacaggccatttggttgtgataaatgaggttggaaacaatccaaatactatctacttgtctcactttgatatttatgaattttctttcacaattaattattttcatctaaaggtatactactactgtcctcaagcatatatttattaattgtcatggcattaaagaataaggccattaattaaagagaagtaaggtccataagtgaataaaactagctagtaaattttttgttactcatcagtagtaaagcttattttatgtttctggttttgtgtgtgattttttttttgctaaataaattgtgcttataatttctgaatcatctttagaaatgtgtaggtatttgactcaggcatatcactttatcttctctttgaaaaatatgtcactttctttccagaaataaagcttttatgggtacataccttgatggatgaagtctcaggattttgtctgatctgataccactctatgcatagggagttatcactgtggctgacatgtaaaatgagttgaaacatttgaaatctgtttacatcaacccagaatcagaaactcttatcatatttttatccccttatctggttcaattttgtgaatgtaaaaatattgagttaataagagagatgtataggagtaatcaaaactaaagtctattttcataaattgcttgcttataagtgaacaaattcaaccagatcttagaatgcagtctttatttgtagagttatttatattaatatctgtgaaatggctttgttgtaaattttaaataccaaagaaatgtgagttccatgcaagattaattgaatcaggaataagcatctggctgctgtgtggcatgagtgaaatatagtcaactgtgctgactttctcttataaacatcttttcataacagatactgtggcaagatttttccaaggtctgcaaacctaacacggcacttgagaacccacacaggagagcagccttacaggtctgacaatgatatttgctaaatatcttgataaatattgtaataattaaagtttattttaataataaaataataattaaagtttataataattaaagtttaaattttatgcatgtctgaatatatgtctattcaattttgagtcaagaaagaattgactaatggctaggatcaaaattagaagagttccagtttctttaatcaaggcttcctacctctcagtttaaaagttctagcacagtgtctaggacagaataagtacttaagaaatgctagccattttaaatattattttttattatcatttgttctcttttctcaataattaggatgatcttaattgacaaaaatcataactttgcagccttccttttccaagcctcaaatctctgctaggagttaataacccatatgtactttttttcccccagcacagctaagtcattttccatggattccaataggaggtttaaaggatagattttaggctgggcatggtggctgacgcttgtaatcccgacactttgggaggcagaggcaggtggatcccttgaggtcaggagtttgagatcagcctggctaacatggtgaaaccctgtgtctaccaaaaatacaaaaattagccaggtgtggtggctcacacctgtagtcccagctacttgtgagactgaggcaggagaatccactgcacctgggaggtggaggttgcagtgagccaagattgcaccactgcactccagcctgggtgacagagtgagactctgtcaaaaaaaaaaaaaaaaagaaagaaagaaagaaagaaagaaaaaaagaatagatcttaaacctgggaagtcgggggagaagaaaatatgaaactagaggtaggacagataaaatagagtatattatagaaaaacgggcaattttatcaataatttcctaaattacctcttagtttattctattacatgccaaaattagtcatatgacacattggacacatctaattttaatattgtttagaaagattagattgaaaatagacaacattactctttccaattttaaaatataaactacattatttaatgttcaatgccttgcacacagtattagttactcgtaaatatttcttcaaagaatgaatattatacaacttaagtaatatcataatgtcattctcctttgaaattcttatacattgcatgtatgcaaaattattttttcctgagtgctaagtttttctattaaaacaaaaagtaagttatttatcagatttcaaatatttttttaatggtaaaataagaaaatgggtcatttgaggataattgaaatcttagaagaaagctagagggagctaaacttaaaacatcagttttctcaaattccttgctttcctacctgttttataaatcactaattataagtgatatatttccaatttatacatgatagaatgcacttgatataacaggtctcagagagatgtaatactgggaagttttagatgatttccccttttgagaaaattatattaccagaaattctgcttaagtggaaggaaaggtttccacactcatgttttgttatggcaagagtactggaaactatgttatcacgttcattttactctttctttgtacataaatttcaatggttttattccacccaataatggctctattattgtgcatatatatttttttaaaccacaaaccagcattttggtatagctggagagcttacacaattatttgtccagcccctctgggtttttttttttttttttccttgcagaagaattccaatgaacagtgtagaaaaaatgaggaaaacaaaatcacaagtaggacaccacaataataactgctacagggaagatcaattgaatgttaaaatgagtggatatagtgaactagatagattttatagtttagttaatgtatcagtgttggtttaatagttgtgacaaacgtacctgaaacatattaacaataggggaaaatgggtactatgtactatctttgcaaccttttaataaatctagaactcttctaaaatgataagtttatttaggccaagtgtggtggctcatgcctacaatcccagcactcagacaggctggggcaggaggaccacccaaacctaggagttgaagaccagcctggacaacacagcgagaccccatcttcaaaaaaagaaaagtttatttaaaaaataaaaaattagtgagtgaaagtttaaagaggatatttgcacagccccaaaatatcttctgcaaaatatttgttaattagaaagagaaaaagtaataaccttataatggacaaacctggcagatactaccttatccaaatgatcagggttaacaatgccagaagttagacatgtcagcatcatgtacccttgataggatgcactgagagggcatattgcctctgtgctattttcccccaaaatttataacctcactctaataatgagaaaatatcagaccaacccaaattaaggaaaattctaccaaattcccaatcggtattattcagaagtgtcagggtaattaaaggcaaggaaagactgaggaactgttagagactgtagaaaactaaggagacatgacagctaaatgcaatgtgggatcgtagatcagatcctggaacagaaaaagagcactggagaaaattggtgatattaaaataaagtctgtattttagttaatagtattgcatcaatgttaatttcctagttttaatgaatgttaggtaagatgttaacattggaggaactgaggtgaagggtatatgggaaccctttgtactatctttgcaactcttctgtaagtctaaaattatttcaaaaagaaaaaattaaaaaaagtaaaatggtatgtaaatgatacatgaattgtctgcttcctgtggctgacctgtgccttctggaaagttctattaggttttaatactttatgtagtaaaagttaaacatggtccctatgtagaaaattatctcttcagaaagataaataccagtagaccacaagctccttgacagtggaatccacctttttttttttttttttttttttatatagacagtaggtctcactctgttgctcaggctggttttgaactcctggcttcaagcagttctcccacgtcagcctcctgattcttagcaggagaagggattatagtataggcaggtgccaccatgtcccggagaatccatatcttactcatctctgtgtccttgatgcatcagcccctctgttttacaaatgaaaaaattcagatttacatatgctaattgccttccgcaaagtctgctactaatagagtcaggattaaaacccaggcccagagctctcacttcagcgtttttattttacatcatgatctcaaaggctcgtctgacctccatgtctacatccaataactaggaaggcttaatagtatactgcccatgactgtgttatgtgttcgttttaagaatttctaaaacttaggctcttattggaattgtgcagaaggaagtgatttttttatttagaacattctttttctggccaagactttagcagaggagagatagaaagtaacaactgatcattggttagaacatgcttatttagatttgagaagatggtgcttactagatttggaaaagaccctttgtgtgcaagcagaaagttagaagcatggcagaaacataatctctcttcctcatgatttgtgtagaaagtgttttgggtgaaaaattttttctaaagtgttttgtgggagtacgtttactgtaacagggttttctaggttattctgctaagcacagaataaattgtgctaaatatagcatggttctcattgcagtgggccttggaggtaaacagagttattgcagagaaggtcataactttatacgcatttaaaaaaaaaaaaaccggggctaaaatattacaactaccataatgtggggtttcacacaatttttattaatatcgtaagtgaggaaagttgaagaagcttattatgccagaacagttttttaagggggaaaaatcaaatcagtacttgtgttggtttagtgatactatgccaaagtaactagttcaacagattatttttcctactgaactgactagacttctggcatcacataaggacaaccacagaagcccaagaactctagtggaatggggtgacttctgctttagagcacttgaaccactgactctgcattcagaagtgggaggagaagggcccttcacacatggaaggatgagttaagaattttctgtcctctaagattgaagttttcatttataagtcatttggaggctggacgcggtggctcacaactgtaatcccggcactttgggaggctgaggtgtgtggatcacttgaggtcaggagttcgagaccagcttggccaacatggtgaaactctgtctctacaaaaatacaaaaattagccgagcatggtgacacgtgcctgtaaccccagctactcgggaggctgaggcaggagaatcgcttgaacccaggaggcagaggttgcagcgagccgagattgtgccactgcactccagcctgggtgacagagtgagactccatctaaaaaacaaaaaaaaaaaaggtcatttggagaaagttaactttttttttcaagtaacatgccccccaaaatcataaacaaatgatggcaaataatggaatctttaccttaaaatgacagaggacaataccttctcaattactaaaaacccttttcttcttcattaatgagagctaggggaaggaggccttgcatttttgtattttcattttatgactaaaggaaaactttaaaaataatttatgattttttttatcacatggaagacagaaacaactaaccaaccaataataagtgctttcatgaaaaaccaacctgattcagactgctagagactcgttcagaaaaagagaaatgaaaaatagggggtaataggaagggagataaatggaagccctttgctttcattccaaaaagagaacttagtggcattattattttttttataacagtttaaagattaacagagaaaaggctttgtggtagctgattcttgggtatcagactaaattatttacattgttttagttttaaaagtctaaaatattgattgctattttgaaactgataatggaattttctttaggattagcacctgagaaaatgaatttcctgagaaattaatcagactgaaattttgaattaaaaagtgatattttattgtatttgaaaactatatgaatgttttttgtttgtttacaaaaaaattagttgtattgtcctaagcagaagataaaacaatgctactgttcctcaatgtgctttattttatgaggtttacttaaaatattggtactgattaatgaatttgggagcaatcaaatcactaatattttattatggtttctgataaagtcatgaaagtctttaaagcaatcagagtatattggaattgaaatcttaattgtgtgaatagtattctccctgtgccttttctttaaaatgttgttttatgagtggagatgatttttgatagctggctaactagtcttgagaaataccttttaatgtgcttgctaatattttctctttgtttatttttcagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacgtaataaattgtgttataagtcaaagatgacttctttttcgtgttttaaaagataataagataatgtgatctttcttcttttattccattttgacgccaaaatcaggtcttattgtaaaaattcccaggaagtttctgttgagattttagaataatgtgagcaatgtgatcattaatttataattcagtggccttatttggattatgtttttatcttcctaatgggtaattttaagcaaagaggacaatgacctaaactcgcaggagacttatgaaacaagatttcctaaaatacaggggacagtcttttcacctgttggcacagaatgtggcctctaggcatggcagagtctctagagtagcagccccagaatgtcaccctctgaatattaatctagaaagcatagctgcttttgtaaaaggcctgcagctcagagaacctctcttggtaatttttgttaagactgggaatatgagactattgacatgatcagagcaacccatagcaaatgatagtagtgctttgtttttgtcacaaattcttatatgaaagtaagataaaagtaactggcataaaactagacttttcttaactgggaccttgccagcacatatttagcagaagggattgtaggttttctagtctttggcttccaatagttagataataagtcattaagtaacatttgccagctggcatatgtgtgcagagccaacctgtgcagtcacaatttgtctccagagaataaaggttatgctttgggggtaggggaggagagatacagaattcaggcaaagagatttaagaacagaaaaaatttggattaatacagactagcaatctttatttatggaattttttaattattaatctttcttcccctataaaggcacattatttatgatcttgtctgattagtacttaaaagtatatactgttcgtctccctcaaagtcagcaatttaatgatcatagttttaaaatattagattttaggtagagaagtataatccaatgtgcaaaactggccactctaactgtgtgtacccttatagcatacaactataattttcttatcaaagttattttaagaaaaaaggttaaacatgtaacatgtcaaagttaatactttttgaccaagattgtaacctcttttaggtgaggggatgttctaacctcctgtttttgtcatatagactattgtgatgaactattatattacagatactttgtaggcaagataaacaacaggaagctaatgttggtgtaaagctcaaccacatataaagtgcttaagtgtaaaagtggtttaagtttatgtaagccttacaccaatccagtgatacgggtattgtgagtcttgcagtgcataggcaaggaaggggaagatcatcctgtaatcagcatatctaatattgtccttttaatactgcaccaacccctggactggagtgttctgagtcaactcacagcttcgcccagcaaaccaggatgcagaattttcagtgtgcctttaaactgtattttgttatatgctttagcatagtagccaaaaaataaataaataaataaaaaggcatgttgactgcaaccaggacttcatatagagtgtctcttggcagaatctatttaaaacttgttcataatttgtctcactctaaattctcattatgtgaatacaaatattctcatgtcacaatagaggtaaggaaaagctagtgagagaagcaccttctttgcgagactgtacttcatgatttcagtggttcaatatattcccaaaggaccgtcatgggcatgtgtattatggtaaacttgggagactttgactttctaaagttattattattaatattcatagggcatgttttaagaaacaacactgatcaaattcataaggagtgagtttccaaataagttgctagataaacaataatctttgtcataaaaggctttctgctccacacaggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagaggtaaagctgtcttttactttttaaactctgtgacgactgaaatgaacatgttttaaaatatacttgctatgctcacttttgtggcactactattacttcagtcaccaaagactggtatatatttagtacatattaaataccacattaaatgcttccaagcattttacatgtgttaattaatttaatttcatcataaccctatgagatagccactataattttagcagtgaaggaatggagacattgaagcttaaaccattgtgtcagaggtcacataagtaatcaatgggattcaacctgagctctctggttccagagcccataattttaccaggatttagctatctgatagctgaatagaatctgttatcaaaatttcagaagtagaagagaaagccgtcacagggattcagttgaatcactgatcaatagtggctactattatacatcataaattatatatattacaggtaatatatgattctatatacctgtattatacataaatacatatatgtatattctgtatatatgtaatatacatattatagtacatatgtatgtatgcatttatatatgaaatacccatggagtttcccccaaatatattttacatagaagcttttatagtcttcttaagattctattgctactttatgtcctcttaagtgactactcatttaattctggtctgtttgtttcagtgggtatgaacatccttgtttttactgccctgatgcactggctcccttttatcatcaccaacattaagcatgaatagcttaattcatttaaaaaagcttttaatgctgttaatgataatacttaacagttacccagcacttcacattgcatatgaagttaatgaaacactatttcaccaaaactactggatttaatttttcttatctgtaagctataattaaatatctattgttgagaagtagacttttctgaacacgactatatagtgacctattaaattcagatgctacattgtaaatttcaaaataacatgaaattagttaaaagttccattatttttcatcatacaagtattattggattagtgtcctctgtttttgatgttatcaaaagtcaaaattattttatgtaattttttcaaggcaaacatcaaataaacattttttactaaaataacaaaaaaaatgaccacttctgtttttcaacttgtataaaagtgtatcaaagaaaaacaagaaaaaagacccttccagtctctgagaagtctgataactacaccagtgtgcagttggatgtacctttccctttacttgcccatttgtgtgtgtgtgtgcgtgtctgtctgtctgtttgtgaaagggagagaggaagcagatgatcagaaggacaaagtagcaagaacaagcaagaaacagtgacgatcttatactttgataatgatatttacttgatgcaaataagaactgttgaacaaaacacaccatttgggttctgagatgcctattcaaattttctagcctttaattggcgatttgtgagcctgtatagttgcaacatctggcttcagcatgtctaaacagcacagaaataagaaggttgagtcatctaagtttttcccctgaactcctaccaggctacttttgatgaataatttattctctgtaaattgccacatttgaaaacttaattaacaaatagattttcttaattatgttggcttttgttacttttgattttcatccatgcactctttttgttcttttactttttctttcttttttttaaataaaaattttaatccactcatgcaagcaagttggcagtgtgtttggaaactaatttatgtctgtgcaaaagatgttttcaccattctttgataaaagaggttaagcgattgtttttattaaaagcttaataatgatatgactttttctggtcaaatggatttttactatgtgtgtttgtcacatccaagattgttttatttattttttaatcctgggaaatctgaatattaaattatactcatttttgttatgtgggaaagtgatgggggtacattgtaatacctgagctttttccaccctggcgttttcctgagaaacaaggaactatttcacattcagactgtaaaaaataatttgaaaatagtacaaataagtgagctgtcaattacttccaaatatgggtagagtggttaggtggaatgtaccacaaatgtcatctagtatcagtaaataccagttgtttcttggtaactactttaacattgtctttggacttttagagtcactttaggcatgtgtattgtagctacggcccatgagtgatatgaattttccagaaatctattattttaaatggtgggtacttacatggcaattaggtaaattgtgctgagaacatacttatgtgcctttttatatgatatatatagcaatatcaattatcaagcaaagtctgataagaaatgggagaccgagattgtttttcgggttctgccagaggcttcatttataatctgaacaatcatacaattatttttttctttatcttcccatttgtgaagtcacattattttttcatggttgacgtagagcataaacaataaaacatttccgatgttaagtgttgaaaatctaaactgttgttgggaagacataataaaggaacaaattacaattttaaaaatgaaaccaacaattggactttttttttaatgcttttgaaagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtgagtaccttgggtgactttagaaactaagctagagtagatccatgtacggttgcaattcctcctgtgataagcaatttgtgagttataaatcacaaaaattaaacttgaattagtaagggatacatggtggatcagatttaaatagatgaaaataaggtggctatcaacataatccacaagcatataaatacatcaggtttggtgcaactctgattaacctgaggtgggaaagataaaatgaaaattacataagtacacaatcatttattgttagactctacctataaaactcaaagaaaaatagagattttgacgttatctaattatacaataatctggcatggtcatcagttaagtataattgagataaacttcacttcagtagatatatatgtgatctatatagatgataactttttaaatgaaaagaaataaccaaacagttaaattgatgggactattatattttcatgatggatgttgactaaatattgtcataattagctttactttaaatggaaataatgaatatatgaattctgtctctgcctattactgactaatgtgtcactgactttaactctttatctcaaatatatgcttggctttagttactaaaaatcttaacagaaatatatttttaagacatgatgtttgtaagtatttataaaaacccaataattgatgcatgctactttaccttgcagatacaatatgaagtttgtcagttgtatagatagattcaaatgaaagtgatttgattagataacaaatgaaaagaaaatttctgtgtttttcgttggttcattttaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggtacagattttcccatagtacagcatcatggttacattatgcatgaaacgtacatttcctttgattaccaaaaagcaaatattctatctttgaaatattttagaatccaaatggggtcagatgcctttctaaaaatgttcatatctttactgtatttatgaccaaatccaaaatagttaagcaagaaagcaattaatttagctgcattctgtatagaaattttatgacaagccccatcctacacttatctttccttgactttgcaattctcttacttttgtacagttagttcatcatgtttgtttacaaatatttatgtattacctcagagtcattttccgtgtctatacttttgtcaatgtaattatattttaagatttttctgaaaagtgaattctattttttgtccccttctatgtctagtaaattgttaggtgtagttaattagcaagtcatctcatgttgtaatttaatagtaaaatgaggatcagaaaggaagtgagttgccaaaggtctacaccaacttactggcagatttggaaataaaacctgtcaatttaaattcaacaaatgaatgagtgaatgaatggtactcaaatttattaggctctacaacattgtatcagcactatggtaactaaaaataaatctatttaagggtccataaatagcaattaaaagagcctcagtgtttttgttacaaaataaaggaagtcggtacttttttgtttgacatccacactcaaccggattgttcattcaggtcaattaaaaataaagaaacttcctattaccatatttattgggcactgtggtctaattgcctgatccattagttcattttgtatgtggcctgacctgcaatgtgaccatattagtttgtacatttggaaatgattttctatttgggtaagatgtctgggtttgtcttaacagcaaatgtaataatatcccaaggaagttgggaaaaacattgtgtcaatgggataatacaaatcattaaataatattcaatttagtaaaaagttctgagatattatgtatggtaataggcaaaataaatgttctttctcaactgaagttaaagcagccaccatctacagaggctcctagagcctacctccatgaacttaagaacatcacttaaagactataggtaccatttcttcattgtaaaaggggtaagtggatttttattcaatggggataaaaatgaagtttccagtttttaacattaaaggtaaactagctagagtagacatttcatttttacttagagacatccataaggggtggctagtatttttttttaacccttgatttcccattcttccatccttgttgattagagataacttgagtatcaaggtttttggttttttgttacttgtttctttgtttttgagacagggtctcactcagctgctaagactggagtgcagtggtgcaatcacggctcactatagcctcgacttgctgggctcaagtgatcctcccacctcaggcatctggataaccgggactattgacactcaccactatgccaggctaatttttcaattttgtgtagagatggggtttcactatgttgcccaggctggtctcaaattcctgagctcaagcaatcctcccacctcagcctcccaaattactgggatttgtataggtgtgacccattgcacctggccatggttttttctttttaaatttcttttaattagtccaccaaaaatgcttcttatttattgtaagatataatacctaaacactccagaaactgccagaagtgacagaaagcaaaagggcctgaaaacctacagataagggatataattataatacattttagtaccagcattttgacataaagtcccaacccagctggactgttactgttataagaaacactagcattttgcaatcctaagtcatatttttcttgttacttgatcatgttatatagattagtttgaaaatggtcaggcccttttgcaaattcactttatttcataatatcattcattcgttcatttattaactaccagctatatgctgggcactgatccttatatatgaaaatgtttatttcctttgattaccaaaaggcagatatgctgttttgccattttctagaatctaaaggctcagatgctttagtcaaagcattcatatatttattctgtaatttttatagtctgtaatttttatagtgattgaattgaaaatagttgaccagtacaatagtagctgcattttgcatgtgctctccctcaagaaactctatccggtaaaaattaatttcatggtaataggtactatttatgtattacctcagtcaggcacactgagctaaacactttatgtaagttagtgcatgtgattcctccacaactcttggaggccaatactgttattactatcatctgttttataggaggaaagtaaagcttaaaaggttaagcaacttgctcaagatcacacagctaggtgagtagaggcaggtttaaaggcaggattaaaatttaaattccaaaattttctttgtactcctttttatcttcccaaatatcagaatttgttttaactctttcagagtactctttatcttgttctctaaaagtaggtacataatcagaatagataatttaggttgaatgctcacttaacccatactttaaactctgccaaagataagtactctatattatttattcttaatttcttaggatctatcacagagcctggcatagagtagatgcttaagaaatatttgttaaatggatcatgagatattgtagaagtccaaaaggcaaattgcatacataaaagtcaaatgtgtacatttagagcgatgacccagcaaatcaaaaatcagcctacaagggtaaattttctaactaaatgcaatgattacggaagaaaccacagactggccacatgtctcagcatgactcccagagatgaaattctgcctaacaacagaggcattttgtctttgtttacagacagtggaatgtctttggcaggactttaatgattccacttcagcagcattttgacaagcaagtttagcaatggatgagaccaacaatagcaaatcaacagtgaaaagttcacttacaagtcaagaccaaacatttcatttgaatattttgcttggcagtaaataggggactctctgaacagttatttaaaatttgacatgataatagggaagaaagagtacttcctcacagagcacctccatgcaccttctgctcagcagacactggaaaacaagttgattagaacactgttgggtcttgtgtttggttttatttttttggtagagctgatttgatccacctcaacttatgggtgccaggactgagtatgtcaagcatggagggaaattggagaaaagacaatggattaaaagttgggcagaaatacattttagttatgcttctcccactatctatctaattgagtgactttgggcaagtcactcaagcaccttcagtgctttcggttataaagtgtaggagtcaggctgtatcctctactaggccacagctctgtcaaggtaggtctatatcttattaatatttgaggtttcagtcataagcacacaataatatttttggtgaattgaacatatgtagtggatggatgactgtatttatagttgaacaggagactgactcatttttctcaatggaagcactatttgcattttaggtaggatagttctttttggttctgtagcgtgtgtcacttttggggcccctaggcactaaaggccagcagtaatcccatgtggtttctacaaaaaatatgccttctttgccaaacacacccatgaaggatgcccctactcagggtcccatccctttccatttaccaacaatattctttgaactaaaagtgatgtttttcaaatgccatttactgagtctctctcctttttaccccaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtatttttccccactgtgtggtatttttccttcatgcaattttactttccctttgggatccaatgatttaaagatatgatggctgagatcttgatgccctacagatatgtggaatgtagagtatgtttgttttgttttgagatagcataaatgatagttcttgggcaacaatgagtctcgcttattgttctgtactttccccatgtggtgcagtcagggctcaagtgcaccacaacccagtcctggtatcacttcacgttcacagcatccacttaaattaggacaaagagcgacttacaggttttctacggattgtatgccaaaaggaactcagtttcttatttttgtttttcattatacgagtagtgttaactgattcacaaaggggggaaacctttgacttttctatgctccttttaattttttgtccacatgcaaaatatccttttttcattgttataactgcgtgtaaacaagatttattttttctttctttgcttgtgtcaaaagaaaaaaaaattacactgcatagtgctacaaattcttcaaaataataatgtagcagtttcccaatattccatcatttgatctactataatttcctccaccactttaattttgttgaagatttttctgctatttgctagtcagcaattatattttaattttcaagcatataattgtttctgtgtgttcatatatgtacatacagagttggaatgtgagtagtagtacttccataagataaattctctgctgggggagcagttatttattttttttgctctttaagcataatgccaagttgttttagagtagacttattctaattttggctgatcgtagagatttaacaaggcctgaataaattagtatgacatgtagaaatagattcagaccgattttttcatttgtttattcattcttagccacaatatcagatacatagagaatctccctgcatcctttctaaatgtgggtagaataagaattaaaaatatagggtatgtttattaattttttttacagaaagtacgcacaggaagtattcagaaaatatatttaagctataaatccattaactaaggcaaataagaatttagtatttacgacataagaatggcatatttgagaaaagagaaatctggaatatgcagggcatttttcattgttttaaagaatgtaccaggctgggtgtggtggctcatgcctgtaatcccagcactgtggggagctgagccaggaggatcacttgagcccagaagttccagactagcctgggcaacatggccaagccctatctctataaaaaatacaaaaattagccaggagtggtggtgcaggcctgtagtccctgctacttgagagaggctgaaaggtgggaggatcacttgaggctgggagatggaagctacaggaatgtaccactgcacttcagcctgggtgacagggcgagaccttgtcttaaatatatatacaaattctgaagcagttcaagtattcccaatgcaactggcttcttgttaggctttgagcataacttttcagttgtttgctaatacttggttcctccgatttccaaaaaggcattcaaccttacatttctgcttgtttcctccatttatttagccagtagcccttcactacatggccctggagagggacagtgagatatggtggagacaatcttggacttggaaactgaaggccagggtctgagttctggctccaccactttactggcttcaaggtcttgggaaagtcatatatctcccattccatctgtgaaacaacagtaataataactgctgcacctactaattcattgggtttctgtgaatgtcaacaatcaaaataactttttgaaaatatttgataatacttctataaatacaaaacattttataatttttgtggtaacaaaggaatagaaaatgtgtgtgtgtatacagagttatgaggaaaaatttataatacaacagaaatctaaacttaaaaaaaaactggatatggaagtttagggaaaagttaggtatttcttgaaaaaatatgtaggtttaaaaaaataacacaagccaaacttctttaaaacataagatgcccagaattattgtttatttatttatttatttatttatttatttttctttctttttttttttttgagacagtatctcccctctgtcccccaggctggattgcagtggtgcaatctcagctcactgcaacctctgcctctcaggtataagggattctctcacctcagcctccagagtagctgggattacaggcacgcgccatcatggccggctaattttttttgtatttttagtagagatggtttttcactatgttgtccaggctggtctctaactcctggcctccagtgatccacccgcctcggcctcccaaagtgctgggattacaggcatgagccaccgctcccggccctgttttttgaattggcaaataaaaattgcacatatttgtggtatataacaggatattttgatatatgtatgcattatggaatggctaaacaagctaattaacatatacattacctttctttgtgtgtgtgtgtgaggagagcacatatactctatcctcttaacaattttcaagtaatcaatatattgttattaattgtagtcaccatgatgtataatagatttgttgaacttttttttttcagtataatttttgaggactctcaaaaaaattcaagaaaaggtaagaaaacacattcataattttatttttagataatgaccatctaccaatattaatttccgtaaagaataaagaaaattattattcatttttaaactgcctgttatgttgatagcacgctggaaatgggtatattcattaccgtaactaaccttcacaataggcctacaagccggcagtcttattcctgttttatggataaggaaaactggagctcagaaaatttaagaaccttactcagaggagcccagctgactgcctgggaatccaggagggctgactccttagcccacacttagctgagagtctcagacctcctggttcaggcacagctgaagaaaagccaaaatggggccggacgcggtgtaatcccagcactttgggaggccgaggcgggcagatcacgaggtcaggagatcgaccatcctggctaacacggtgaaaccccgtctctactaaaaatgcaaaaaaattagccgggcgtggtggcgggcacctgtagtcccagctactcgggaggctgaggcaggagaatggcgtgaacccaggaggcggagcttgcagtgagccaagatggcgccactgcactccagcctgggcgacagagtgagactctgtcacacacacacacacacaaaagccaaaatggaatattccaaaactgaggaaatgtgcacccctctaatccccacagtgaggctgtcaggatgcaaatatgccgaggagacatttaggcatctgactcttggctgtgaaggttttgaaaggtgagcgctaaggactggttgccaggctttttaaattcaggttatctcaagtcagaaccaacaatactagtgcttttgaaagattctaaatgtttccttaataagagccttagttaccttgtttgcaaattcctagcaggtggcttaagtttcctctttagttattctttttgtaaaaaaaaaaaaaatattatccaaaacctacattttgaatgtattaacacggaaagacttaagccctttctgaaatgattagcagactcatcatgagagaaagcaaatgcagctcagaagtattctcatttcattctctccaggcttaaagaaacttaatgaatggaaggaatacagagagaagtgggaagaacggaggaaacttaccaaacaaattgggtccaggagccctgaagagactttagtgaactggacagctattccacaagagaactgggttagtattgaattgttccttatattccgcataaccatttgtcgatacaagaggctgtccttggtgcaacatgtatttcaaaaaagaagagaactacttcacatccattagaatataggctaatatttttaaaaaatcactggtgagagtgtggaaaaattggaaccctttggattgttgatgggcatataaaattgtgcagccactatagggaatagtatagtggtttttcaaaaagtcgtgatttcacttatgggtatactctcaaaagaattagcagggtctctaagagatatttgtacactcatgttcatagcagcattattcacagtagtgaagaggtggaagcaacccaagtgtgcatcaacggataaatgggtaaacaaaatgtggtatatacatgcaatgggatgttattcagcttcaaaaataagggaaattcagacacatgatgtaacatggataaaccttgagaacatcatgctaagtgaagtaagccagtcacaaaaaaacaaataatgccactgggcgtggtggctcacgtctgtaatcccagcactttgagaggccgaggcaggtggatcacttgaggtcaggagttcaagaccagcatgaccaacatggcgaaactctgtctctactaaaaatacaaaaattagccaggcgtggtggcacacacctgtaatcccagctcctcagaaggctgaggcaagagactcacgtgaacacaagaggcagaggttgcagtgatccgagattgtgccacttcactccagcctaggtgacagagcgagactttgtctcaagaaacaagacaaaacaaaacaacaaataatgtgtgattgcacttatgaggcacctagagcagtcaattcataggaaagtagaatggtggttgccaggggcttggggaggtggggaatgggaagttgtaaatgagtatagaatttcaattttgcaagatgaaaagagttctggagattggctacacaacagtgtgaatgtacttactactattgaactgtgcatttaaaattttaagatgataaaaatctttgttatgtatattttaccacgaatgacaaagaaaaaaaaatacaatcccactctgtttatatggttcttttgacagaaagaatttaattctattcagctcaaggagagaagcaaattatcaggtggatgtggaacagcttacacaatcaaagggaaatctggaaaaccaggcctcatacacaacccagaaccagtggataggcaagagcaagaaccaataggtagccttgggctgctatcatcaagatgcatcaattgtcatcattttcagtctttttttttttggtccctctgtgtccagatttaaattttagaaatagagtaagaaattagccctgcttgagatcccagcaccatcaagagcaccattaatcccacctgaaggtgtggggcaggaaagactagttcctatacagtcgtatagagaggctcctcacaaataagtgggaataagttatggacatcaaaaacaacaaatatccataccacctgtatcactggaaaactaacatatataagggccaataatttcaggccaggtacataatttgttaatgtcaggggtagagggataacatagatagcacatacaaaattagaactgctccagaaggacctgtaatcctaaaacattacagttctttaattgtcttagagaattcttgaagaattattttgctttaaatgcttcagttattaattttactgatgactctgcaagactcacaatgaaactgtagccaagtagccaagtgttaccgagaattaaagcacactgattcataaagacattttgggggtgtatgcaaaaaacatggtcaggaagaaactaaagcttttgtctaaatcaaaagcattcaataatcaatatctagaaaggagaacagaaaccactctaaatattttaagcagagaagaaggatttaatgcagagggttgcattcaagggcattggaagggctaggagaacaaaaggaagaaaaagatgtaaaggagagaccaggaaataactaagggccccactccccacggagttacaggagtgtggctgctgttgctgctgcctggatgttgcccttattgcggttgctggaaccactgattgccttcacttacctgtcactattactgataaagtcacccctcctcctgccttcttacctccctcaactgctttccatggtacctcactggaaaccaggtagcaagagagtgtcgggggtgaagatttggctcatcagggcccctaagatacagtggaatagggaaatggtgctggttaccaacagactatatctggcatagaactgcctaaactggacatacatacctagttagtggagaaagcctccaatagctccctattgttcttcaaatgaatatcatcaggtcgacatggcctccagggcaccccatgacctagttcttgcctacctgtttagtctttccctacttgcctttctcagatttaccggattactttcagtcaccaaattcaatttcacttccaaggactgtgcacagcatatgtgtgaacttggagcactcctatcttcctccaatccagaatcccactcctccagtcatcccctatattctcacttggctaatttagtttattcttcagattttaatgtacatgttagtctttcagtgaaacattccttgatatcttctcactttctctcacctattagtgtaaattaactagtcctgttgtgtctctcatcaaacaatttgccacacattcaatgcacctattgcaatctgtaattgtatacataggtattagtgtattatttaagaactctattgctaatgtcttaggctccatgaatgaactaactgtatctactttgatcaatgctgtttctccagtgactactatggcacattgtgtctattctatacattttattaaataatgaataaatagataaattatctaaaaggacatataccaaactagtattcagggttacctctagggagcgcagtgggtaattttttatattacacatttttgactatttgatattttcaataagaatgaattactcttgttttattaaaaacatacttctttttatgagcataacccatgaaaaagagattctcagtttaggaatttaacctaaaaatttgttagcattacatactaagatttgcgaacatggatgttgattaaaacattgataataataaaataattgttatctacaaagtagtcagtgaaagagactcagcaaagtaaactatgctgtctgcctgtttaagtacatgagcagataatctctatatgttattaactgaagaagcaagttacaaatatctggaagctatatcatgtaacattttactggttggcaagattatgcatgaatttcatttgctttattcttgttgtttgtctgcatttttacattatctaaaagaatgtgtggctttttaataagacaaactttacaaaaacaaacaaattcttttaaattagttaagcaaagagtaaattacataaagagaacaaaaagaaatcttgtgtgtgagagtgacaggagccttctaatcatgcactgtgagggagggctgagcccaacctgctcactatgcaggtaacacagtgagatctcaaaagagggatggtggttttgtctaaggtgcaagatcacatagctgatttggagtccaaacccaagtttcttctttctaggccactacaatgaggagtgggttatgagcagagtggggtaaaatcctggtatccaacaaaggaggtcgggtcaaagacttctgtgataagttcaggggttagattacctccaaatgtgctcagattggctctatgccacaaaagccaaactcaacttcagcttgttttcatgtgtcacaaatgaaacaaaatatgtcttaatggcaacaaacgtattgtccatattataaaagtagagtgtattatccatttcccacatgttgattcatagcaatttcgttcctgtttggagctctaactacttatcagaaatggtgatgaactaatagtgatgaacagaaataaccaactaaatagtactgagctcctgtaagcaagaaagaagtgttaaaagcatcttatgtaaaaattctgccctattttgacatctcagaaggcaaagctcactttcaatactttctctccattatttccctgcaggataaaaagttttagctccttccaagcatttcttgtaggaagcagtatctttaaatcaggttaaagaaatcaggagaaaaaaagaatcagagatctcccaaagaagcaacatttacgagtctagcaggaggccagctagtgtcatgaccttgtcagaaaatatgtccttacctccaccgttgaagtcatcctggtctgtgataatcatatgcgcttcctttaaaacaataatatattattttacgagggatgacatattaagtgatttcaatcagcagtagtgaatctgatccttttctccgtgatagttatgggaggaaacgtatttttaagaggccaaaagaggatgaaaatggatgtaaggggacatatttgaggccctccctgagcgggtaagactgggctgtaagaagctgaggatggtggcagctatctgaacaatctgtcttcatgggctgggagaaggtgccataggtggagagagaagaatacagctttcatttttgttttgttctgctttgctttgtttttatcaaggaccagttctttcatcaacattcactttctaaagatgaaattaaggactaaggtcttcaatttgacagaataaaaaggcagtaacagaaggataagtgggaaatctcaatggacaattttcaataagtgaatatattaggatagtaggagtaggaagattcaattggccccatggctttgtaaacctcttcagagcaaaacacactgactaaaacctaaagatttagattgtttacttccaaatgtctttacagagaaaaatagtctttatgaaaaagcatctccccattagtatcactaatttagtgtcaactgttatttaaatgggtaaattggtggcattttttttactgttcttgcatatatttaaaattaaaaattttctgttcgtattcttctaagtccaataatttttgtgtataactaactaaaaagtagttgctgggtcatttcattttttcctaaaacaccatccaaaggtacaaaatgttaaagaataattagagatggctcgtgcctgtaatcccagcacttcggaaggctgaggtgggcggatcacctgaggtcaggagttcgagaccagcctgaccaacatggagaaaccccgtctctactaaaataaaataaaataaaataaatacaaaatacaaaattagccaggcatggtggcgcatcactgtaatcccagttactcaggaggctaaggtaggacaatcgcttgaatctgggaggcggaggttgtggtgagctgtgattgggccactgcattccagcccgggcaacgagagagaaactccatctcaaaaaaaaaaaaaagaaaagaaaaaagaataattagagaaagtggaattgctctcattcatgttagcattcagaagcactttaggactattgcataggctttactgggtaccacagttcttagaaaggcaacagcaatgttggaaaggcacagatgtagagtcaaagagatctgcagtcttatcctttttgccacaaactagttgtgtgatctcacccaagaacagtgagccccacattttaatgatttagatagcaacacaacttttgccttatctctaagccacttgtatcattatttatttaacatttctttgtcttgattcattttttacagcttgataattttatttgaaaagaacatgtaaatagaaaactacttgctataaatataacttaataatagaaatatgcacaatgaaaaactacaatattattagattttagtgagatacagttgctctttaacttatgat

SEQ ID NO: 1493 - DNA, 4653 bp, Homo sapiens
atcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtatttttccc

SEQ ID NO: 1494 - protein, 1079 aa, Homo sapiens
ILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 1495 - DNA, 194049 bp, Mus musculus
  misc_feature (1)...(194049): n = A,T,C or G
cctgtgtgttccttagcaactcacccacccatccagattatttgccttcatattcaacaatatgttttcacacttaagttgagagcacacctttctcatttggtcaagcagttgtgaaaagagatgttgtttgcaaatagctattaatcgagcactcagtttcttgtagatataatgaaagaaagagaaaaaaaatcattacaattgaaccctatttgaaggtaacgtccttggcccctttcaagttaattgtcatcatcacttctagaccctctaagcaccagttactgcgcctgcataaaaatcattacatgggaagtgagagcggggcacaggcagtgagagatccaaactgattcttcatttaacttgagctgcacacaggtttgttcctactggagtaacagctctcaaatagcatgccaaaggaaacaggcacactatgaaggaaatgtatcatagatggactccaaacacatagcctttcaggtattagttgtaattttatctttaaattttgagttaaaatgataacacatttgtccagactttcgaccataaatcttccctccctgctattttagatttggtaacctcaaatcgcctagggcgctcaagtttcaattccttcaagaacaactttatggctttggcacagagcagacttctgcattagctgctatgcactctgaagtctttgcccagactggcagccacttttccatcctcaatgggtttcttataaggctacccttgggtttcccaccccagtgattgagaatctgtcgggaacagcaaaaccatgaatgggaatttccatgggccaggtctggaagtgcaggattacttctgttctcacacctttgccaaaaatacatcctcaagtcaaggatgcctgctataaatattcaagctatgtatgaaactccatacctatttctgtagtgggatggagcacatcttggtgaataggtttagcaacatgtgttgtgtgatgagggaaacagattctgaaatctctttctggtttttgaaagaattaaagtgtaattatataaccaatgttgggaaaccccccaaacccaaaaatgagaaactccagtaccttgatgatcttgaaacgtaataagtagaacctgaattataataaattagttgaacttctcaatatgtaaatagtataaacttgtcataattatatatgcttggtgagaacagattaataaatcgatcttgttctagtttcattactttgctgtaacaaattccatgacctaaacagcttagaggagggaagggtttgtttgacatacttttctaggcaatagtccaccactaggcataggacagaaacttaatcaggaacttgaagctgagcctgccctctactccaggcaaaattgcttctgatcaggtaactcacagccaaggcagaatagcagaaaggggtagaagaatgcccctagatgacttaagtaggctcataactagttcaaacagcctagtaccacatacgcagggaatagtactgcccatgataagatgggccctcctatattaattaacaatccagacaatcccccttcagtcatgcctgcagccaatctattccaggtaacctctcacttgagagttccttctcagatagaggttgtttccagctgagagttgaagctaaccagcacagaggatcaggcccatcctgcacattagaataacataaaacaaattctcaacttttaatcattttttcaatttacttatttttattttatgcacataaacattttgtttgcctgtgtgtctgtgtacctcatgtgtgcctggtctccatggtgacaagaagaagaagtttgatcttctggttgtgagccaccatgcgggtagagcatcctatcctctagaagagcagcttaacgtaattgctcttagccattgagccatctgtcctgctcccagattttcaccttttcataaaagtaaaccttttaagttattttagaattagtttttaaacacaaaaagtcatgctctgcaaatttgtaagaaactcacaaaactgaacataattgaacaatgaagcacttttgggtataaatgaatgtatgatttcttagaaaggcttttctggtaagtcatagtgatggactccttacttaatatattggtaatattgtgaagctgattgttgtaatttggatgtaatgtggatggcaacaaaccccacatgctgaaggcttgatcccctggggcctgtggttatggagaggataagacctgaaacaccatcctaatactcacaagctgatctctgagtctgaggccagcctggtcttcacagcaaggtctagcccagcctagattatacagtgtgaccccctccaaaaaaaaaaaaacttaagtgaaacgtagtttagctctttgcatagctatggctgctgtacacagacctgatgttagaagccaactaaacctgtgtacagccttattctttatggaaaaagaaagcaggcccttacttcctatcatgcacacacaaaaactcaagtcaggtttaaatactaaccacacacagtcagtccaaggttaaaggaaaacagttttggctccggggatttagaaagacttcctaaacagtgtaagattcagagcgagatcgcgtaaggcttcttgaaacatgaaagattttagtttccatggtaagatcatcaaagaagtgaataaaaacaaacttcaatatttcaaaagacatgactctcagctgtgtgcaggaaacggaaaactgtacaagtattaatgcaacgctaaggctgttccatcaaactgggtagacagagaagtgcagagaggcaactacataatctagaaatctttaggactcgggatgtggtggagacatgggatgaatatgaaagtgagcagggcccagacatctcaatgcctggtgagtgtatttttttttaaaagaaattagattatgttcctatagaaaccaataatggtacctacaatgagatggggcacattaggtttccttagtaaaaattcctgggagtacgctgtatgcatgtctgactttaagtgagaatgtgtgaaatacaagacttgtgatgaactgtgggggtgtgggagtgaccctgaaatcccattggaatggcctccagtgagggtgaagttccagaaaacaaatttcaagaatttctttgcatttgttcaaagaaatcaaaaaaagaaaaaaaaaaaaaaaagaaagaaaaagaaaaagaaaaaaggaaaggaaaagagaaaatagactcccgaatgaacctcaagacaactaaatgaaataaaggagttgccacatggtaaggaagagaaattcaataaagagaaaagctgagtgctggatggagggatgacttagcaggagagggcattggctgctcctccagaagatcctgctttggttcccagcacacacgtggcagctcacaaccatctatgactccagttctaggtgatgtgacgtctttgggcctcggtgagcacagcacacacccatggtgcacagacagcacacattcaggggtgttttgagggaaggggaggaaaaatcaaacggaaaggcaagaaatgaacgtgtgaagtcaaacaaaacacccagcagaaggcctcatcagcaggatgggtcagcgtgaggacagcttcaagactgggtggaaaacttggagcatcctgacaaggaaaaaggtgaacgtgtgagaaagaaggcacagtatttgagtgtttcaagtgctatacgaagtgttgggagcacagaacggagctccttgagcccacacatctccagagaaaccaggactggtaagaatgccagattgtctttccaatgagaaagatggggggcgggggagagaacaaacaaacaaaaaacaacaaacaaacaaaaaacaaagcccaacagacaaactcttcttccacccagaaatctgggaattaaaagtgaatatagcctggtgacctggttatctgctgagctaagccacatcaagctcctacaaccaggaccagactagtaatctaaatgacccttacagctaggagctccccgaattcccacaaccaggaccagaggtacctaatactcaaatgacctctaccctatccctatgacctagaccatgccagagtgttccctaaggcctataagctagtgcgggtagcctttctctgggacccatattcttagaagaaatgccatgggtcccttgtcgagttttaatgtgactacattcccatgtgcactgggtattgtatcataccaggaaactttttccaccaaattctattgtgtttaaactgcccgagatcagactttccaaagtcttgaaccaggcttaggaagtcaatctgaacaaagtttgcaatctcacctctttgaggtttgcttcctggccataacaacctgcagggttcctctcaaaaaaaaaaaaacaaaaaaaaaaaaacagaaacaaaaaaaaaataaaaccccaaatctaaacataatcttaagtggaaggaataagttctaaaggcatagagaagattttcagtgaaatcttagtagaaaatgtctctaagttatggggataaatatccatcaagatcccaggggagaaaagggcctcccttgtcatattataattaaactgctaaatgtactgaaagaagaaagcaaagacagaggtgggggcagggtccatcagaatagaagcagttttctcaaaagaaacctgaagccaagagatcttgggatgatggtttccaagtctgagagacaattgccaacagagaattttgtttccactacaggtatctgtcataaataaagaagaaatgatttcatgatgatgataagggattcatgggcactctgcctgctatacagaggatacttgagagaacaggcttatacatccatattgcagtccaccattgagggaagttagggcaagaactcagacaggaacctgaaggtaggaactgaaacagagaccatggaagaacactgtttacatggattgctcagcttgctttttatacagcccaaggatggttacccaagagtagcaccccccccacagtattctcagcatcaatcattaatcaagaagatggtccacagacatacctatgagccaatcagatggacttagttcctcccttgtggtttccacttcccaggtgattgtactttgtgtcaagttgacaaaccaaccagtagagtatccaacctctgttcatttggatttatagccctctttacaatatggaacctgtgcttggcaccattattgggaccaagaacctaagactagacagtcataggccctggtggagaatagactgctatttcctctgaaaaagagatgcggtattacattgaattctaatgacttattgtgataactatagtgtagcactcaaacctcactagagaaatttcttttttaagagttagtgatgaacactgaaatcaaaactgttcaaagcacagagagtaaatgaacagggagtcctcagccataaataggtgagcctatgtcatgtatatcactctcattcctcccaagggccaagtgtcattgaagaaagactaagagtgagaggcagtggatgactttaaggacagtggtctttggatacaacaggacagttgcacatatgaattcacagcaattgtgacagcatgcagtcacctgtacaagctcaaaccaccaaatcatagcacagagggaagagttgatcaggcagtcccacccctaattgaggaaatattgctagttaatagcttctatgagagagagagagagagtttattttccattagggtatgtatgatccatgctccagtggatggccacacattcaatagtagacaggcaacactaactgaacttgataggcctttaaaagagtaaggacatacagttacagggtatggaatgggagatggatccgagaagaactgctaaagggtaaacatgatcaaaatacaatgtggaaaattcttaaaaataaaaatacttaaaaagaagaaaacaaaacccaggaaaaatggatggaactttaaattcatacaatgtattgagaaagacagaccgagtatgttatcacactcttgctagcctggaaggctctgattagagctttggtgattttgaaaacattggaatggtgaacatcaaggtcctaactacaaattatcttgctctatcttggccctccatagctgtttatcaccctcctctgtgtgtgacctaatagctctgtgactattagatgactctttgggaaagtacaagcagactcttagtttctgtcaatcaacaggctaagaatgatatcagataacatccgaggcctagagctgaggttccctggctcttcagttatcttcccgcacgatgtttccaccaatgtttttggaaagtgcctcgatttacgatttactttgttcagttaacacacaacttcacaaaactgttaactacattgggacatgggaattaagataaccagtgttcccgggcaatggccactcatatttggctccagagtgaactcttctacccttggaggtcagtgctgtgtttcctggaaggtttgtctgaaggaaagtcagggttaaggcttagtataccatgtatgttagactcgtgtccattctgagtgagaatactaaagttctgaaactcttagttccaagtagcaaaacgggacaagaggaagaaactgttcagtccgtgctacaccccctgccccccatatgttcctttgttgtcaatctttgcttgtcctcttttgagtcggagttgagaagatgaaattacaactgttcctgtcaccatggtccagttagaataaaatctgtcttaccattttaagcaagttccatgaataattcttttttttttccaaaagatttatttatttgttatttatgtgagtatgctgtagctgtcctcagacacaccagaagaaggcatcagatcccattacagatggttgtgagctaccatgtggttgctgggaattgaactcatgacctctggaagaacagtcagtgctcttaactgctgagccatctctccagccctttctgaataactattaagagtctcctttctttattactctttcattcctcttggttcactgcaatagtcagataaggacatttgactaaaggcaaatacatttgacactaaattctagtcactctgtttacgagtatgccttttaaaaaatttaactattttgcaggtattcctaaaataatgaaatagaactaagagaattataattaaggctggagagatggttcaaccattaaaggctagtctcacaaccaaaaataatcaatctgattattatcttaaggaagccctaactttaggaataattgtgaattctttaaataaaagaaacattttaatgagaatacaatatagatcaaacaacagagcatgtgtagattaaacattatttgtacaaagttcttgtctacaaatactaacttgataatgatacatcaaaagcagttacttttttgttatacttaaaattattctaaccatttacagttaccattattttaaacaactgagttaaatactgtaattatgtagacttcactgcattggtatttaagaaacaattttcttcctagttgtaaaaaatttattatgctcatttttaaaattttatttttgttttcacttttggatttggaaaagaatattaaattatgccattataaccgagagccatatatttaagctacatattaaaaatgtttagttaaggccaaattatatcttcctttcaatttttggcttggttattaatatttaaacactactatttctccttttaactttttagtttcatcttcctttctttgtcactacatttataccaagtaatccttatcttttattgccaggatttaagatccaagctcatttcagttttgttattaaaaatgttcaaatttagccaggcatggtatttcacacctttagtcacaggctggggaggcagaggcaggtggatctctcagtttgaggctcagcctggtttgcatagtgagttccatgccatttaagagagacacactgagactattccaaccaaataaaaatgttcaaatttaaggacataaaaaacaaaatttgcttttaaaaacaaaaaggaatcaaagctatataaaaaccacagaggaacttccaataagcttccaagggtatcccacaatgacgactgaacagcagaggcccccaggtaggaacaatacaagacaaagcgggacgtgtgctgatcccacgtgcttggcaatgtcaaaaatcagcactaggaatctagtgcgtgggcagaatatcaaatgatgtaagtaaaattgaagggaaaattatagtaaaacaggccagtaaatgacattttcatgggcaaaacaatgcagacattgaatgatgactaaattcaaaaagtattttcttgtgttgagtgggagagggctattagaagtatgagtaatatttgcaaaatctataacaaaaaaaagcatttaaaaattatatggccgtctgagtacttcagttcaaaggccactcagcattctttagaacagggaataaaagaacctgcaaagtagtaacttatagccgccctaaaagcatgtacaggctccctaactgaaagttatctatcatcttcccactgtgaaattttaagtgcacgatgtgattctaagcacgagcacataagcaatagaaatgcaggattttatggtttcctgctgtagaacaaaaagcaacagtctgaagaaaaattttttaaaagttcatgatgcgtctctattttccgtaggcctctaaatctgcaattgcctcgtttattaaagactcagaactgaaaagaaggctcagaaatgatcttagccaccacttacaccttaacccatcttacatgctaatttttttctccatgctaatttttaagcaacagtgtcagatatgcttaattgtacacacgttcttgaactcttaaatggttttccagatagccactgagggagtacactcctgtgcccctacttggcctgctctttgagaatgcaggtaaagaactcccaccctccctctcccttctccctcggcaacgcgaaacaggctaggcacgctcacgtgacgctaatgacgtcagccccctctgggtcgcgtgacccacagccaaccttcctaccgccccaccccctcgccactggcgtgggacatctcgcgagaagccttcttactatcagaacttgctgaggttacaggggagttactctggagaggaaggaaggtgtggcagagtggtgcacttttgggtttcattatgttagagtttatgatcaagcaaatgcttatggggatcgccctagtcgggaaaaggggagagaagggcgaagacgtgacagtaaaaactgaagcgaaacgtggtgccctgaccatctttgcccctagctaagggacagccggggcgcagcagaggtggccaaggctggcagccccaggcagtagctgcgagccgggggacgttggacccgggtctgggagcagtaaacgcgaaccgcgcccagatgcaagggttgcttccctctctcggcttccccggcctcgcggccatcccgcccgggtagaggcatccgggttgtgggagcttcgagtggtctctcatctttccgcccttcgtgggtcactgcgacatctcagtcccgtccccttaagcgcgctccctgctgctccgcgcatctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgcgggccaccagcgcctcctctgcccgctggtaacgaccggctgggtgttcactcggccgctgccgcccgccactccgggcgctgcgttgagctctccgtgcggcctcggtgaccgcggcaacccctcctgacacctctcccccgccccttcgggagccctcggcccggccaccgcggcgggaggaggagaggacaagggatcgcggagcgggctggtctggccacctcgccccgcgcgccccgcccctgcgcgcactccctcgccggcgagctactttcggacacggaaagtgagggcggccccgggtgacagcgcggcggcgccagtcccgggaagccaggtctgttcgcgtgtcgcccgtcgcactgtccagaccccgccatggcttcgaccaccacctgcacccggttcaccgacgagtatcagctctttgaggagctcggaaagtaagcgtccctgcctggcatctcctcctccccacgacccctcgtctccctcgtggggatagagagcctgcgggccgaggcggggagacggaccctggcttggtgcgggtggggcacacaggggaggaaacctttgccctactgtggcgggtgctccgaattcccagcccatcttctcgggtcctccacctctccacgggggacttagtgaatttatgatctctgcagttgtagctgtcatcctgagaagtgtgcgcgcacgcgagtgcgaatgtgtgtgtatgtgtgttcggagaggaaaggagatgcatgtaaaatgcaacatttatcacatttttggtaaatagatgtctcttgctcagcccgcgctgtatctgcgatctgacccaggttcggatgagctaacgagagaacactcgctctctgagatggtgccatatttatcgatgccgaaagttcaacttggcttggtggagagtctggttcggcatccaagtagttgttccgttcaggaaaagggccacccaacagaacccacgtccctgccatgtatccgctatccttctttgcactaagatgagtcgctcaccatcattctaggatttaggtgtacatcgtctctgagaggatttatttatccaggcagaggaaagccctagagcccgagagagcgtttccccagggtagcctagcttgtgtaaaacgacctcctccactgaagtggcaggacttccttgagatgttaaggagggacagggtacctactgaagatctgcacaggggcaactagagactcagtcaggagggagtgttggtttaccgagcatcaaaccccaaacctatcgctaatttccactatcagggaagggatgcatttgtgtgtgtgtgtgtgctgtaggtttccttacagttgcataaaaggaagtgtgagcacttttaaatcaaatgaaaatgatatctttatagatgatctgctgttgaaacatggagtatgtcggaagagcagcttaatttaaatccctcccctccccccaagcccaaaccaggcagagagaaatcaccttaccccagaatctgttaaagcacaccagtgagctcgagatttatgttttaatgaaaacaatcaccatatttacttagttggaaccacgttaattatgtttcctagcgaaataaacagtttttttttctttcttctgttccccagctcggtcctttgcagggtttgctatgagcatttggtgttttgtgagtgtgaattacaaattgttttcaaatttcatgtgcaaaaaagagtggtcataattggcattaccttctattttgttgattaataatctgcgtgtttccagtcaattaaaaacgactttcattccacaacattaaaaaagatctgggctggcaggaaagaattgtttattttctagataatgcttttattatgttgctatttgacagaccactaaaggttcatgaaaccactcagatttgtgagtttgcaagtggatactagatctgattatactgacgacttgctaattattggtttccaggggggcgttctcagtggtgagaagatgtatgaaaatccctactggacaagagtatgctgccaaaattatcaacaccaaaaagctttctgctaggggtgggtattttaaaccacatttatttatatatgttaatgttgtatttgttgtgtgaatggttggtgtcttctaagtagttatagcatgtagttataattgaattttggacttaggtatcatattacatattaccatttttccttgccaaaagcctcttgctttgtttcctttgaaaagtaggtgaaaaatataattgttatcagcgagttattaaaatgctgtctcctaagcaatggtatagataaatatgttgcaaagcaaataaatgtcatgaggggccttgctgaaatctgttcagaaggatcttgaaatggaaaaaatgcaagtctcataactgtcataattcccctttcacttctgagacaaaaaaaaaaaatgggtcatggttcagttgaatgtatgttacagttgtagttacagctgaacttaatacagcgaggtatatttaacttcagtggtttggggaagtaggaagagatttttactgtaatctaggaagttagcttggctttgatatgtgtaggctaggccttttctgggttttctgcatgaaactttccatcagatcatgcaatatattttacacctttagcttatagccacaaagatacttcatcctgagagctcttgacataagtttaaaaaaaaataaacaaaaaacaaaaacaactgggagcagtgtgcccacatgatgatgatggtgatgatggtgatgatggtgatggtgatgatggtgattagaatcaaacaaaagtccatatactgaaatgccggagttacagtgactaaggtgcctacggatttccaagggaattcatggtgtgatgaaatgaagctggaatcaaaaagaacagaatcccataatgcagccccatctcagtgacctggtttattttaagtaatgagaggaaattccattagacttagttttcctcactgaatacatcttttaagacatgccacttaaagacgtctgggtatcgttcgttgcctttgtcctcggctctgacaaatggattttcggattctccttttacgatatactttaggtttcagtctatgtattcactcggatggaattccacgatacttcccgtcatctgatttgctcttgttctgagaaagaatgcaaactgaccaggaacaccatggtgtcctggtgtgaaaactaatgagggacatgccatgctaattacctctccctttcgagcctccactctattggaagtttttatttttttagaatcacgagggatgcagaagtttaagtgccagtttaagggaaagaagaagactgaaaacattgagtcgggtttttttttttcttcttctagtgattatgttatttcttccagtgtgatatgtcctttggcaatggtgggctatcatttttttgggggggggggaggtattaccacgcctcttccaagtcctttaatagctttagatttcttctcagaacaaatggattgggaacttcactttttcttagtgagagtcatcactttttatccattttgtctcatatgccccatatcagcctggtggtattgctgtcaatgctcacccttttctcctccgtgggagatgagtgccccagcctgagcggcctccagcactttcttctctgaacgcttcctccagtgtcactcagctgctcatgcccagcctctacaaatcaccttcctgtctcagaagacactcttgttatcttcctgtgcgattttttgattatttatgttttatttattatttttaggtgtgtgtgtgtgtgtgagtgtgtgtgtgtctgtctgtgtgtgtctctctctctctctctgtgtgtgtgtgtgtgtgtgtgtgtgtgtgtgtctgggtagtgggaactgaactcctccagcctgcaagaacaaggatatctatccctcatttgttgagctatctctccagcctctttctttgctctatattccccagaaagaacgccatctgtcctggagctggagtgataatgctctcgttttcagtcctgattcctgcacctgctagctaggtgatcttaggcaatctactcattttaatctgaacctcagtcttttcatctgtaaaatggggtgaggtagaatccttccttgtaggggtttgattgatctgtttggcttagtgtgtagtgtagagaagtgcctcccattaagtgtgctcgtagtgaatatcagtttccatattagatgatgggaatgtggtgatgatcaaattccattactctacataaaatgtcttagttcacatgaaagtatgtgcaaattgtggctttagtgacagttctgatgtggcccaattcaaacagtggcttagacactaggtatacaaattgatccaatcatgtactttcctaagatctcagattcttcgtcaataaaatggtaaaacttatgagtctcatggggtgtcttgccagtctcacttattacaaatttacttattacaattgtatgtaaagaatataatatttcctaccaaatgctcagtagtactgctttgtattgacacacaattagagatggttatagattagttttattttgtagtgaacgtatttgtttccattgtactcatattgagttacaaattacctgaaggaaaatcccgtgctttctcctttgatagaacattcaagtagacagcactgggaacactgaaggccttcaagagagagggactaggatgcaatgtgcttctgacagtatttgtaacgtagttacgcacttggtttcttgctgagaccaagcacattctgaaatgtatgaagtctatttagagactgtattttaaaatacaaagtttggaagctggaaagatggtgtagctgtgaagagcactttctgctcttgcagagggcccagagtgtggttcacagcacccacatggctaagacctgtttataactcccgttccagaagccctgaggccctcttctgaccttgatgagtaccgcatgcatgcagtaaaacttgcaggcagaaaaatcatattcacacatgaaatgaaaatgaataaatactaaaaatatataatctaaattttcttttaataacacttcttttacagtaatctagtttaaaggttttgcaggaacattttattttttgtatttttaaaaatttaatttaattttttaattatttactttacatcccagctcactggcctcctccaggtcacctgtcaccccttccaccaccctttccccttccctcttctccctccccttctcctctaagcagatgggcgcctccctaggtatcccccctcccagcacttcaagtggggggggtgcagacagtggactaggcgcttcctctcccactgaggccaaacaaggcagcccagctagaagaacatatcccatgtccaggcaacagcttttgagattgccctcatgtaggaacatttttgtagtgagaaacattcaaagacaaagatagagttcactgcaatatagtattaataacccccctcctcccaatgatttgtcagagctccaacagacactttggtggaatagacaatttttgtgcaatatttttgtttatagtatttgacataacatgccttaataaatctaatccttaaggctgtgcattttaaagacaaggacatttctactactcccctttgtgctgggaatttaacctagggcctcctcacacacgctaggcaaagacactaccatttaactgtgttatctgccctcgactaatgctctttagctgtaacagagaaaaagagaaagtgccatttgtcaatcaatccaaggccatggtgggaactgccaaacatttggcgggattcctgcacacatctgagcatcctctctgctgtcacccagactgtttactgtgcctcgactgtaacgggctctcagcagacagcgttggctgcattcgctgtcactgttaggcacacacaccatatttgggagactcggagtctgttgaagaattccgctgtgtcttcatctgcatctgcccacagatcattctgtattagtgtaagcctgtacgtcagtaggctcaggatatcttatttggcctcttgtttttttttttttgtttttttttaatatcctaagggtggctgacatttgatattgtgtatgtaattacgagttctgaaaagctgttttaattaggcatgcttagtaaggagagaggaggacggtgggacatgtctcatatgctcatctttggtcttagatattctgttgttttgatccaaaccgttaggttagttagtatccgtcaaatgcttacttgttctaacctcagtctatattttgtctatcctctgggcgtggttagagccgttagctgttactaggtgatgtgaagacaacagtaagctgacggccttcagaaacagttcatgtagtagatggtgcattttaaaacttctcggtaggagtgatgacttcttgatagtcattttacatttgcgcgttctcatccttagaaagcctttactgctacaccgccaagcatgccatagttactgttttcacaaaagaaaacttcattataagcttgacataaacgtgcgacatgagtctctgtttacattgatttcattgctaaatttagcaagctatatttctgtaatgtagtaaatcattttaattttattatgctaattctattaattcctaatttcataatgttagtagaacacgaaggaggaccttaggagactacttgtccatgcatataaattcaatgttgtacgtatactccaagtaatattttttttgtttaagaaagatgtcaaaactgaggcttgctaattttgtttttgacatcaagcagttaagaaattatctgagcctctcaactttatgcctactttcttgacttggaattaaaattgagattagatggagggaatgaagatccaattctactttgctgatttggctgtttgcaaccaattgaacatcagtaacaccaaaatggcaaaaaaaagaacattttcagaaaaaaaatgcgagttgcttttgttctctatgtaagactgaacacaggatgtaatattcagatcgctttgtatcttgtttctgcattatacatatctgatgaagaggtccccacgtgtgcttggaattagagatggtttttagccaccatgtgggtgctggggacggagccaggtcctctgctagaggagccggtgagcttcactgctgagctttctctccagccccatattcttttcttttctattaatttttttcatatgatacgttctgatcacactttctattcttaactcctaccagatcctttccacctcctcatccctaaaattcccacctttcccttttcagaaaacaaacaggcaaaaaatcaagaaacataaacaagccagaataagataagaaacaccacacacacacacacacacacacacacacacacacacacacacacacagacacccctctcaaacaaaaacttgtaaaaacaacaaatcagaagccatgatatacaagcaaaaactagaaagacaacaacaacaacaaaaagcctaaataaagaaatatgagaacaaaacgtctattcaaacaccatagggtttgctcagagttagccatctaaccctgggcatggggcctacctttaacactggttaatatacccagtgaaactccgctggacaaaactaatctttccctttcaagcaaatgccaattggttaggggtgggagctcatgtccccacgcccctctcagtgctgagactccatctggcttgaactggcgcaggccctgtgcatgtatctaatatactgagtttttacatgtgcgttactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctcttgacatcttatccttaaaactttttgcctggagccattccagatggccattgatgctggaatacaggttttcagcaggttccttcccctccattttattagggaatagtatatttcacaatgtttttatatgtcactggcaattaattcatggctgtttacatagggatctgggtcaaacagtttgtcgtagcacatctagtgaaatgtcctgagacacactgaatggagtattcgatggcttttaatgcttaccacctatctgtctattgacaacttatagatcaatttcttttataagttattaaacatgtgcacatatggtttacttaagtcagtattcaatacttttgaatgtgattacagccgtcagagaacaaggaaactaaagatgacataaatagacatcatggacgacatggtacactacagttcatacgaatgacgtcataagtcattaaaaggcgacaagatgatttctgcccggggagatcaaggaaaactgtttctcttagtggaggtttaaagaggttgaaagtcacaagtccccacccctaaacctgactctgcaatttgaggaaatggacaaaatatttgattagaaagaaaatgacattgggttgctgcagtagagttattgcaattatccatgcatatacactgactttttttttttaatactatttggttttattttattttatttgttgcattttcagggattttgagacagaatttcactctatagcccctgctaacttggaagctcagggctgcttcaaacttgggctgtccttttaatctcctccaggaggagaaaatacatatgccacacccagctattttgtttattttattgtgctgctgggccttgaacccaggaccctgaacacactagcctagaataactctacccgggactgtatgcagttcagccctttgatatgaaaggactttaagtaaagcagggcaggttttagccagcagaactgctgggatcccagttaggatgtgttctctgatggtacacaagtgctcagcagacctcgcttgtctggagttgcagacctcgcttttcggatactttgttactctcccaatcaacaatgcagtctccagtaaggatttagaaacctgaaacgctgttagcatcatttaaagagcgccttgtaggtgagacaagtgcaagtcaccgcctgctaggtttcatttgtgtccatattgcgcctcctcctaagctgcatacctctagtaaggtgaggaagggggtgggggtgggtggggcgagactgtagctcatgcaggaagccctaggataaagcagacctgatagttcaggcctgtaatcccagaatttgagaggtagggcagaaagatccgaagttcaaggccatccttgtctgtatgagttaagaggtcagcttggggtacgtgagtgagaccttgtcaaaaaaaaaaaaaaaagaaagaaagaaagaaggaaaggaaaggaaaggaaaggaaaggaaaggaaaaaggaaaggaaaggaaaggaaaggaagaaagaaaagaaagtgatagagtgagtatttcaaaccagtttctcttactctgaagtctgaatccactttttccatgggctgctgaactctgctgtatttgtttgtatgagcgtggctccatacccctttttacatttccatggcctccagggtcttgagtggtacatttcagaaaatacatttagaattccaacttgtgaggaaagaacattttaattgccatggtaacataagatcaagttgaagtttcaggcggctctttgcgactttctagaaggaaaaatcctagagtgggaaatgttatcaaaatgttaggaaagtgaccgtgcaagagtgtgtgagactcggcagtgagctcttaggattcctgaatgatgtgcttcttgctgcagagaaaagcagacattgaaacaaatgaagaataagagacatgtatgcaggagaccgttctagttttctggttcattctgttagaccagtgaggaaagggagacttttgtttgtttgtttgtttgtagttccttttacaacattagtattgagtgtgtcagactcatccaaaagaatggggcaattaaaaggaaataaaaagttataatcaatgtacattgtaaaaataggtgtgtagcaggaactggacaggtatccagatgacacaggatgataatattcgttaacagttaatccttctacagaaggctcttatctgtttttagattatgtagggatttgcattttttttttatttcatgaattttggtatacacagttacgtatatttaattttgaaacagtaaacaagtgactgtaagtaatcaaaactctcccgtggctgggctgtttcctgtacttctgaagctgtccgtgagttcctggctcaagcttattccttcccaggccaagagtcagttactgtccctgaagatttttggagtcaaactccttatcagccatccagcttgttttgaatttaactggaagatcttcagtaatggaaaactcacacactcattatataggttaattgtaatttattttgtgttgcacaatatagactcacagaccaacaggcattattttctatgtattaatgaattattttggcctggcaagatgtctgggtggggaaaggtgctcatcgcaaaagcctggcaacctaagtttgatctgattcctagactctgtgtaaaggtgaatgaagagaagcaattgcatgaagctgtcttccagtcttcttacacagcctcatacaacaacaacaataatacaataacaacaacaacaacaaggagaagaacaacaacaatatcaatggcaacagaaataccattttaccttttccataaaggccttcagaagataataagtatttggaatttttaatagtaaagtgtttttcccctatagttttcaagacattttattaatatgatgtacacaccctgaaaagttaagaataatttagataaagggggctttttaaaaactagggctggaaggatgtgtcaacaggtaagagcacttggtgctcttgcagaggactggaattcggggctcagtgctcacactgggtggctcccctgcctgtttcaggggatttgagagtctgttctacattcatggcacctgcatgcacacgcatacacacaacacacacacacacacacacacacacacacacacaccacacacacacagaagttaaacttcaatttttttttaagaattaatatagcaagagaaagttgatcaaacatgtcattctgtgcatggctgagttatgacctgttatgctatttttgtaaagttgaaggttgaagctttaatggaggaaatagacggtttctggtatttggagggctgtgcctaggaagtatgtcacccactactgctctcttccccaggtggtgtccgcatctctggaacattccaagcacttgtgcttgtccttttcttacctcaggtccacgtagtctctgtcactttggtgtttgtaacgattcattccaataggagtccagtttccatcttgctctacagcccttttcaatagcttccccagcagacttgctggctgacagttgttacattgttaacacataaacacacactctattcaatcactcctgagaccctatggcagtgacttgttctgagtaacttgactacttcctgccctcgcagtagacagtttctatcctccagtacagcggcctccctaaggctgagaccctctaacccaattcctcatgtggtggtgaccccccccctgcccctacccccctaaccataaaattatttttattgctacttcttaattgacattttgctactaattgctaatcataatgttaatatttatattttccgatggttttgcgtgaccctgtgaaaagggacaggacccagaggttgacaaactctgatctagtatttccagctctactggggtggaagccgacctagagaatacagaattgtgagagggctgttaagagataaggcctttgaggaagtgctttaagatcaggaagagatagctgtactggcatcggggctactgtgctgagagaaagggcgaagtccggtaccacccaaggatggaatgggaagtctgagcattccaaatagtgtagaacgaactcttcctcctttaagacccagctcaggtggtacctctcctatgatgtcacctctctctacccagaagggcctcccccctccttcagtcttttgtcatttgaatggcttgctgcacattttccatttccctttctactacaattatatatgtggcagttttgaggttccctgtggagatccttaatttatcttaaaatctgccggctgcggtgattatagcatcacaagctcttgtcactgttgaatgagtggggaaacgaacctatgacaggctgtgtcttagagaggcgggggcgagtgacagtggggctggtggggctttatgtcagactgcacccagtcacgtcgcaagttaactgctgattcacgaattatttcctcagttctctcggtacacatccggccttgttggatggagttttatctaatcctgtcctttttctgagcaaacttgttgaaatttctcattggtagtctccccttgttctgttacacaacggttgttaatggggtgtggtagcactttcgtgcctcttagccccggttcaatactgccaaactcacatcatcatcatcatgctcactttaaaatgtatttatacactttcaatttataaactacaaattatgaaatgtaattataaactttgacagtacttcagggagagatttttaatttttatagatgcatgtaaaatgaattatagcatacaatacttatactaatctagactttagaaaagtacagaaaaactaaaaagggacatatttatgtctttccaagcaagcactgataaccttttttttcatttctttatttcttttcaaagttcgtaattttttattataaaattttattttcatttatttattttgtgttatgtgtgggcaaatgactttgcctgtatatggaggttagaggacagctggcagcaattctggataaaggtcaggtcgccaggcttgtgtgaaagttccctaatctgctgagccctcccagctggcccctccctttccccctaacctacctacttccttggctgcccactccctctttctctctttcaaactggacattttggtctccagttttacttaaaattacaacacatccctgtgttgtggaaattcctttgaactctgaagaactgcaccctgcttcgccgaggaagtgaacaccagctgattattttatagggttgcatgcatctttctgttaacttgtgccctttactgcggaagataatagatagaactgaaagctcacctttgtaaagtgtctcagacttctgggtcttaggtaggattcacctaggaggagaagtcctgagacacagagttaagtgttttcagaattctttgtcacgttgcttcctggaggctttgtccatttccactgaggacatttaattacagtatgatacctaaattgaattttgaagaactacattctaactttcaatttcatcttaatgaaaaaagaaaaactgtccttgccaagccccctccctctgacagataactaaagagggagaggcaaagtctttcctctcaaggtgaacggacccagaggaaacggaattagcactggggctgctggtactgagctctgggttctgagctctatggagaggtcagggagacgtctccaaggagccggtgtttgcactgggttttgaaaataagcaaagttgaatagacagataggacaccaacagataggacattacgaggaactactcgtgaggaacaatcaaatcagaaagtgtcagtgaatggtttggtggtcatgaaagcctgcagagcccgatgaagggagttggaattcttttcaccctctgagggtgaatcatgaagtggcaggctctgtgggaacgaaggaaggaaggaaggaaggtggatcctgagatttatagccctgagtcattaggggtaaacagctgataagagagccacagctaactgcttatcaacccctcattctgttttatgtagccttggggcaaaatacaaaccccataagagccactaagtaaaaaacaaaggacttgaaaatagagtatttctttttaaagtcaagtgttatggagtgttaaaaataattaaagtattttttttaaagtcaagtgttatggagtgttactggagattgcagtgtatgttgtgactgttgtgaaaattattggaggggtctacttaaagccaaaagtgactaggacatctaaccaataggattccactcaacaccagattcttgtgtctaaaagactagcactggtctgtacagttacgtagaggaataaatgttttgcagagtctgttttcctgtagttttgctaatacatgtttagggacccagagcctttaatgtcacatctgtgcatactgctgccttcttctctctctctttttaagaaactgagagttacacagtttattccacagtgttgaatcacttaaataatgaaaaaaaatcattcattcccttaggtaactttagtttaaacatttaatctctgtaggttggcttagccatgtaaattttcctctgtttttaaaaatcgtaaaaaaaaataaatatgtaagagctttgacttttattcatattaaggttttcatggttgcacttaaaggagaaagaaagatcactgttttattcaatgcaaatatgtaattcatagtaatttgacttttttttcctttcgtttttggttttcaataaatacatctgtccgaagtttttcttcacccaaccccaacttctcccagcctcctcctcttcctcttcctcttcctcctccttttctctcccagctccacttctctcttttccttcagaataaaaagcaggcctcccttgttagccaaataaggcataagaaggtaagactaggcttaaacccttgtatcaagtcagggtgaggcaatgcagtgtgaggaaagagctttgggaacagagcagaaggccatctgtcaacttaaaggacagtgagtcaaaattgacacagctcctggaaagattagagaaattctatttccgcaagtagcatttgattgcccatgcccaaccctgtcctccaaacataagtagaatcaagacccacttgcatctaattttggaaataagttttggaaataattttcttagtgttaactttgcctattgctctctatgtatatcttatatgctcaggaaaaaggagagggaaatttgacttaatcttacttaattttgtttgaaggaaaaacatttgtaatgcttcacactggcagacaactagtgtctgctgtctgcatagttcccccactgtgataatcctaaatgcctgtaattcttcaatggcaaatagagatggcatcagcatcatagcaggatcagggatggccacgggacactgagaccattatgttttacatcataatgactctaaaaatggaaactaacatttgttgactttttgtaatctttaaaaaacgctattatagatagaatgttttaaagtatgtttttaaataattgaaatcaacccgaaatttagaaacagtggcattagaaaaacagtgaccacacacagggtcagctttaaaaataacacgtagctttgaaagtacaatttcttttctccctagcatgtaaatgatttattcagattgtctataataagcctagcggggaagaaaggaggaagtgagaaacgagtctttgagaaatccttaaagctcatactagtgcttgtgtagcagcttccattcaaggatcgaaaggtccacggcgcttctggaacagaggttagggacagcctacaggattcttgttcccagtgctgttttgtctgcctcccttcagtgcctcttcagagccgtttcctcacacacctcacattccttccagagtctagggacagatgacacagttacctgctgcaacagcagctcgattatgggagcaaatgtgattacgtgggttagaatctctgtggtcctctgatcagtaacccggtacaaatgttctgtcctggagatatttgatgccttatcccacccacctcacctgttttaattgtctggatgacacatgaaggggacatccaggacattgcttagcaggagtgggtcagtagggttgactgacacagaggatgagagacaccgagattcagcatactcagactgagggtccctgagtgaggaacaacggtgagcagtgagctcagaatcttgaggaaggtttcaaggctaagacccctggggagggtgacattttcctacaacaagccgagaggtgtcagttgatcttggtgaggaaagatgaattgtgttggagatacaaaagctagattggggatgaagtacctaaaagagcattggacactgggtgtggtccttcagaaaagacctatggaggcagtgcagtgtgctgcataggctaacagcattgtttctgaaatcgcactgccaggattcaacacggctttcatccttgggaaaacttcataatctccccaaaccttggtcttctactctctggaactcgagccactgtcatttatgatcagtgcatgcctgcatgctgctgtggcacaatgctgtggatagtgggtgaaatggagaagccaacccggtttagaggagagaaaatgatgtgtcagaaaggtagaaaaaaaatggagaatgtgaatttcaaattcttagggcgggaggttttgcaaaggctagtggagagtgctggttagtttctgtcaacttgatacaaactagagacatgatggaggaggaagcctcaatcgaggacttgcctccattaaattgtcaagtctgtgaggggttttcttgcctgatagttggtaggaaagggactagcccacacagaaggaagaccaagaaaagacttcccattcccatgtagcagaatcagaagcaggtctttggcgaagtttatgtggattgcatcattagcttaatgccatctgagaaaggagggacagtcttagggtggcttccaggtactgtcggaggaagaagtctatcaagagagcacaggggtgacagcagcccgaagggtagctgtgacgctaggaggatgacatttacgtcagtttcccaggagactcttggtacttaggacctggcaaggcagccaccgggaatctggcttttcttttctttttctttttcttcttctttttttttactttgaaaaaaaatttttttcagtgtgacattactttccttaatttgggagagctagtgagaataaaacagctggaaatgaaatggaaaccaggtactagaaaagccccgccgcccacacacagatgctttctcctgttatttccaggaaggaggtgatcaaaagcagaacactggataagaaaataaattatattatccaggagtaacggctagaatggttccatttggattcaaaactagaacaggaacaaacacagtggctgcttcaacctgaaaatgaagcccggggagtcggtgattcatgatctaagttgtacagtccccgttgtacagtctgtttcctctccataggcaaagaccccacaggcagcttcagataggtcaggattatgcagagttttataagtaggaaggcactgtttaaggaagaaaatgactttacatcaggaataatatttaagtactggaaagacggaagctgggttcatcctggttctattctgtactggtactacagttacgtaaggctcactgctattctatgtctatgctgttcattcacattagctggttcctggacgcccctcccccctcttcctaaatgaactcccaggtttcatagttatgatgataccagctttgggttcagaccgtctcaccatctagcacattcagtgacttcgcaaaggctgttctcacgttcagtttgtttttccaagtccacttttaacaaataaaagatttttatttgttaaaaataaaagattctttttgacataggtatgattagaatgtttgatttttttttcttcttacataaagtatttaaaaatattattgttctgacccccattctttaccccatcactgtttatattgatgtttaacatctaatcacgtctgtattcgttctgcttaacagttcatttttcattaaccaaaccgcaccatgattttagcaagaaatgaagacttcatctttatcctttaccctcagctcatctacctagaatttgattatttcttatggtatttaggacctggatctgttttctcattttccaggagacattgcgctttatcttattgtcactcattataatttagtagctgtcgactgagcacacaccagatgcaggtacaggtcttgattatagggatacagtcatgaatagtgtgggagacatgcggtgtgtcatttgggcagacatgtgctattggatgctatcaagaaaaaaaatcaactatattaagttctatggtaactcatatgaaaataatttagtttggcctttcagaggcatttaagctgaagctctaatgatgagaggaataaatggtcttagtagtttttgctgtgaagggacaccatgaccaagacaacttttataaatgacaacatttaattaggcttggcttacagtttccgaggttcagtctgttatcatgcagggacacatggcagcatccaggcaggcatggtgctggagaaggaactgagagttctacatcttgatctgaaggaggcagaaggaaactcttttctgcaagcacccagaaggaagttctctaagtgagaacgctgggcagaacttgagcactggggagcttcaaagcccacctacatacacagtgacacacttcctccaacaaggccacacctcctaatagtgccacttcccatgggccaagcatattcaaaccaccacataaaccatacgaaaataggagggaagataaaaggatgacggtgacaccaactttacatagatttagaaagaaagtgaacataaggagcaagtagggatagcatgatcttgttgggtagtgggcaagggactgattgggcagagccttcactctgtaatctgggagatgtgagaggagagtgcacgtggaaacagagcatgagttttggaggaagaaagtagggcttgctgatgtaaagggaacacaagggtaggaagcctaggattcacagttaaaacaaccaccacaatctttaactgacatggagagaatagaatgggttgaggtgggccacagggcagttacattcttacctctccactctcaaatctgggaacagctcctctgccttctgacttcatagagtagaattaggtatcgcttagagttttgtgggtggctttcttctttctcttagcataacttcttcaaggcttgccaaggtcgtgtgctttattggtaacccatgttttaatctttaccatgtgtttattcattcatgtatttatccattggtttattggtagtcaaatagatcccctccccatttgtataatgctgacatgagcattttgtgtgcacatgtagacacaggtttttatttttcttgtatatacaactaaaaatgtggggtggggtgggttggggagctactttacatacttacattcaaaagccaggcttgatgacacactcctgtaatcccaggtcttaggagtcagcatcaggagggtctctgcaaattagagatcagtctaatcaatatagtgagtttcgggccacctgaggctaagctcttaactcagttaaccaagaagcaacacaaatcagtcatatttatcccttacataccttctaaccagacactgtaggaattggtggccacacctttgattcggtatgcatattcagctagaaccttgcagtttagatagtttgctgtgcaagagagaaatgggtttccaagtaagaagatggcctgccattatgtccctgtgaggaggagggagcacaatctttaggaatggctttatttaaccattattttaaattaactctgcccagaagtcaaagaacaaccatttcctgtcaaggatatctccgtctaagcgattactgtagcaacttttcctttcctgacagctctcactagaaagaatttggcccagcacctttgtgccttgggtttttgttgtactgttcatacagatgcctcgttttctttaaacagaatgggaagtttcatagagtctcattccagattaagtctgctccttttcccaatgagttggagaagtttgtgtctctgtacattgcctgctggctgtaacaagaggctcacactatgttgacagtggcataaaatttgccaggcttttgcctttgcctcaagaagctatttggggtcgtgatgtgacagcaactgacaagtttgttgaagtttcattttcaaaaactttgggtttgtatgaaattggttgtaaaaagtttccattttaatcttttaaattgaggggtgaatctagggtttcttgaagacctaataacgcagcatgctgctcttttattcttgacgaatttcagctacttcccagcattgatttttcatggccagcctgacagagtgagattaacacatctgaaaaacatttctctgtaatgtggttaggattgccgccagcagtttaaagacagaaaagctcaaagttagttaggaggagatattttaattcagagctaatgttacaagattaaaaacttggtactattggtaggatatttttgtaatggattgtatacatttacaattagatgcatgcttccaatgaaaaacaataagtattgttgcccttgttatatctttcaggccatcttagagagtagaaaggtttaatagaccttccagagttgatttttttcaataatttattggtggcacggagacattcacatggaaaagtttgccattatgaaatagggaggactatggcacagcatttgcctggcatgtgtgaggagctctgtcagaacacacacacacacacacacacacacacacacacacacacacacacacacacgtttgtgtgttgtcccagttacttttctgttgttgtgataaaacacaatgacgaagagaatttatagaataaagaggttattggggcttaagagtccatcattggagagaatcatagaagcaggctgtaggcatggtgtcaggaacaactgaaaggtcaactgaaattgcaagcaggaagcagagacaatgaacagagaatgccctatgtctctgaaatcatagcctgaaccagtgactgtttctcctgcaaggccacacctcccaagccttcccaaacagcaccaccagctggtgaacaggcattcaaacatccgaccctgtagcaaacattcccatccacaacaccgtgttatatgtgcaaatgtgaaataggagattttctttactattacatttttgccactctgtgtgtgtgtgtgtgtgtgtgttcgtgcatgtgcatgcatgcacacacatgcaatgtttagtataatgataaacatacctgtttttcttgggcaaggtgtctgtaactttaacaaaatagcttgaccagaagtgacttgtacaggagaggatttatttcatcttccagaatctccatcattcacggaagtcacagcaggatcctggaatcaggaagtgacgcagaggccatagaggagtctggtactggcttgttctccacagctcgctcagcctgccctcctttatcattcaagaccaccagcccaagggtggtagcactcgaaatgagctaggccaccttagaacaatcactgaataagaaattgcaccacaggccaatctggagtgttcagttttccaattgaggatctttcttctaaaatgactagtttatgacatagaactagccagcataattgacccctatgaacttaacacacaaacaaattattcttcaactgtaacctttcctttcctattcatcccaaagatctcatattaatattagagaataaaactttaaaagtcccatgcttcttaaaaatccaaacattcaaaaagttcattctccttaaaataaccgaaaggctttctaaattgcaatgtttctctaaaactctaaagtctctttaaaattacaaaatttttctgaaatattcaaggtctcatgactctggcacatgtttaagaaaaaaagtttaaaaatgttcttataccaaaatggaaaaataaaagcacaggtgcaatcaaatcaaagcaaaactaagttaagtatgtaaaactcagggtcagactctgaaactcgccatcttctaagctccagagagcttgccccagcacacacagtctggcaagactcacttggctccactccacagcggcagttgtctttgtttgcaatccagtggtactggcatctccaaaatgttggggtctccattgcaactgggatgcaccttcaccagtagcctctcctgactgctcttcagagactctggccccgccacaaggtgccatgcctcaacttctcttcagttctgtagtactgaaacgtatactgcaattgcagttgaacatttaccagtggtcttttccagcccctaacagtgccaagtcttaggaattctccatgataccttaatgtcttagaaaccaataccatccgggaagggctcgcttcttaccaacgttggctgccagtgtaaggtaaagccttgacgtcctctggaccacagtttctgtgtgctgacccataggaaacacttcacagaagatttcacctcaatgatacccgactctttttaatcacagcagattttttcagccccagtggattgtcaattgtctgagcccagcaaaagtttcgctttagcacttcttcgctaaaaatatcacacgaattgccctgagagattctttgagagattttctaaactttcctcggatacttcacaaggcaggtcttcattgtctgtgttgcttccagcattctcttctaagttcctacagaacaggcccacaagctctgcgctctcatagcttttccatagaaaagttcaaatgtttccacagccctcccagctatgtcacagcagtatctcatgacctggtgccaatttctgtcttggagtttctattgctgtgataaaacaccatgaccaaagttacttgggggaagaaagggtttatttcatcttacatcctgtagtccaccatgtagggaaagtggggcaggaactcaaggttggaactgccttgccacacagaggccatgtctgcttactggcttgcactccatggcttgccgagtttacttttatataccatccaggaccactagtccagggctggcactgcccatcgtgaggtggaacatcccacatccatcatcagttaccacaggcttgcctacaggcctctggggacattttttttaaattgaggttccccctttctaaaatgaccttagcatttgtcagactgatgtgaagacagcagtccacatgcgcacgtccaagattcctaagaaggaaacagttcataacttgaaccagctactgcatgtcaggatccatgaagaagcatgacaacagttaaacatatgttgtgtgtgtttgctcattgtgtaagatcccgctttcatttttaaaaaatcaggttgttagagcaactagaaatctgaggctgacttacttcccaggttcttttccccctgtagcgttttctgtggagatctttaaagagccacacgaaactattatttgcagcagtggactgggagggaacattcataggacatcttgcataattgtctggtcttcttaaagggaaacaatagacaatgagctatagtgattttatagatagtccctcaactgactctcttctgtagcttgattttcctcctcccaggagtgatttccaaaggaaatgctttgatacctggctcattcttgcaatgaataaaagctgaaatttgttatttcttgcctacaaaattggaaactttgatttcgaacatcagcaaaattatcctaggtaatctgcttaatttactgcaatgtgaaggagggtagtttaatggcatacacatgagatgaaaacagaaattagtactacctgggaggaaggaaagaaaccaatcagagctgtggagggtcatagaagagggctgtatatgtgcgtgtgtgggggggggggcatcactgtataatggagtattggggtagggggtgtgaatacagtagaatggcacacatgtgtggaagctttgtaatgaaatctgttgctttgtatgctaatgtaaaaagtaataataaaaggactgaatttatggttgtgaaaataatttggagactggaacagcatattgtcttcagtgtatatactttatgactggcttcccaaatggggagggtttactggaaatgtattgttagggtccatgaatggctgaagaatgataacccagactcaaatagtacacaaaagcaaagagtatttgttgaacaaattcctgcatgcaggggcccaattccattgggatggaagggccccaatggaattcacagatccagttttagagctaaaaagaggaacattagggaggggtaggtgatctatatcttgattggtgggttctttctctgggagtttgggtggcttcatgccaaggaggggtagctcttgacctataagcttgggtaactgtcctttgacaagctggggaggggtgccttttacataagcctgtggttgttccagtaactgacttgcccagttctgggaagtagaaactcaggcctggtctcctgagctgctagtttgcagcgggtcatggaggcagcctggctcgggccaggacactcctttcagtacattagactttacccacattcacagtcctgtatggaattgtccctgcagagtctcctaatgcatattctcatttattagagggcttgatgttttgttttagatctcttttcaagtttattaaaataaatattacccttttaaaacacaattctgtgttgtgaaatatttactaacgccatggggaaatgccaatatcagtaactaaaatgtaaaggagagtggaggatagttgtgattgataaaggtgtgtgtgtgtgtgtgtgtgtgggtgtgggtgtgtgcgcgcgcataaatacgttattataaaatctaccacttgagccgggcgtggtggcgcacgcctttaatcccagcacttgggaggcagaggcagggggatttctgagtttgaggccagcctggtctacaaagtgacttccaggacagccaggactatacagagaaaccctgtctcaaaaaaccaaaatcaatcaatcaatcaatcaatcaatcaatcaatcaatctaccacttggccatttgtaaatgtgaggttcagtagaattaagtacactcaccttatcgggcaactgttattactctacattcatttttctctcccatggctctccccataatcccccatggttcgactcataatccctcatggctcctcctacaatcctccgtggtttcccataatcctccatggctccgcccacaaccaccaatggtcccgcccacaatccccaatggctccgcccataaccctttactgcttaacactaatacagtaaaactgtatttacggtaaagaagcattgaagaacagcatttaaaggctgggttgtgatcagttgtctgtcaagagccctgttggtgtcagggcttcagagtcccattgtaatttgagtggggaagcagaagtgacaagcccttagattgaacttcgtgtttgtgttttagtttgtgtttgtttgtttttaagttctcatgtgctcatgatggctcctctgcctccatgccttagggctgccattcaaagatggcaaaatgcatatacgatgccctttctctgatgccaccagactagggtcttcccagtcttgtctctttctttatcttttctttcatcttagctttatttagaaaatataaatatgtcttggctgtttcttatgaaactggtgctctttagtctttaaactgtatagatttgcacattacacaagttcttgtaaaggcagagtttgcaggttacgttcctctttttatcatcttcagcagattgtgggtgattgcagttttctctaatagcccgatggtgtttcattttataagtgtggtttagttcttatatattctaggtcagttttgaaatccaatttatcaatgtggtgtttagagattataatttagaaccttgccatgtatgacgaggaacatgtcccttttacatttttctaagtctgttagaggagcaaaactggggaaacccattctttagagacattgggagatgttagctgggctggttatcttagctcttcccctttccttatttttctttttactcaatgagcccatgcatttcaagaaatgtggccctagtagagtatgttctctgtcggttttctggtgtcaatcatgaaggtgccagttttaatgcccaaccttctgggctgcagctggtcctgcacaggaagccactttggcattaatatttcaggtttcctctctcctgccatcaacccggagtcctgaacaattggcactgttcaatcgacatgctcatgaatatccgtgtatgctacatattcagaaaagttactacggaatgataaaatctgtgaaatctctgcacccaagtagaagggcagcctagcatattctcggatattctctaactagagaatgatgcagggttctgcaagttttaaaggcattctgcactaaacacttctgtaacttttcctctggagtccactctgaagtaagaatcagcagagggttttccatgctcatttaaaattttatttacaaaaagcaaagaggaaaaacaattagaaacaagtgaattaaattaataatcacttgttaccaatatcccaaataagatgtttaagatatacttggttgtctgtattgtttcctaggagtttgtgcatacagactttattttatatcctagcctagtgctgaaataaatattcaatgtctatttaaaaagttaacagcgagtgttaagaaatcttatgctctctgtgtattacagaacttaggtgagattcctcctatttaaaacttaaggttgttgtttccttaaaaatagcatcctttcatgtaaaggcaagttgaacacgtgctctcctttgcacatgtttggcctggcccttggcttcccattgttgagtcatgaacaaagtgaatctgtcaaatagtcactttatgaagaggactttatagaatcccatactggagaagccacaggtttgagcagggcttttatgcgtctatgttcataaaaagatgactcggccttttctctttctgtgagaacacaccaagcaatgactcccatccccacagttctgcttttagacttgtaactaagatttcaatagatgaagtagcaatttccaatagttttagcattggtgttataattcacgcatgtgtctagcacgttgacttttcttttcatttgaaaaactggagtatatagaaaacaaactcagctgaagaaggcaggaaaggggctcagtttagccattgaaagggatttgtatttgctgagaatgggcttttaggttgaaccagcctctagttcctcttcgatgcttcctttgtggtctttgtgaccagacatttaatgtgtcagaggcatcaggggctcaggagtccttccctaaacaccatgcagctgtcacaggtcagggagaaatactgagactcatttgaaatcgctcagaagccccattccatggaatggttctggctgtggatcgcccatcacaccatctgccattagggcccagctttgtactttctgcccatgcagggttcctgctctgcttcggagcatctcacagtgacttgtcacaacatacacggactctttcgcttcgttcgtttaggctgtatgtttgtgtgaatgtttactgttggtctgaactcacttgtaaacggtaaccagtcctgtcttttattaatatccatgtatatatgctaggtagatgtgtgtattttacgtgatgcacagcacagaagagatacctatagttccaaatacatggaatgaacttaagctccaagggcagaaaaaattcaaagttcagcttcttttgtttgaatgtgtgaaaagttacaagtagttcagcagtggattgctttgaccgtaaggaggaagatgttgttactcctaggtgcctatactatagactagaaagtagaatgacccacttcttgtcatccagaggggtcagagggaaggagtggggcacaagtctcatgtcagtcattaagtattttcccaggaatctgtggacttaaaacaaggggtagaacttgtaggatggagcagaaatccttactcagataattttcatgatttgaagcactgcttgcttctatccttagaaaatagcaagctagggataacttgattaatgaacataatattacatagcacttaggaaaagagcattatgtattggtgttattttttttttagtctccacaaacattaataacagcaacagcaatgacatttagattgcattccaaagccttttgcaactagaaacaattttaattttatatcctcacgatgactgataaattactagagacgatttattgaatccccatttagacccaggaatgctgatacgtagagaatttgaccaagtagcctgtggtctcagaccttcccaaggttctgtaccctctcagttctattttatgtcacattttcctgttctagctctgtgacatggctgtgttcctttagtgagagccgattcaaagatgtgggacctgctggtcatttatttggctttttgactatacttcttgaaaagaatcaagtcaattggtgaatgtattgaaattgatgacctaaaaaagtctgagggacagatgcatgggttttaacactcaagtattttaagtatatggtaccacaatgactgttaataaatgattttctattgtggttataagtctttatcaatcaagtgttaacaggaatcaggaaagataggaaaggaatgtataaacacagtaaggtagacagggctgtaccagtgatatgaagataaagaagttgaaaatttttgtcaagtgttctctgcgtagagcaagggtcaggtaggtgagatggaccaaagaacaaggagagggttttcttgtgtggaacacgatgtaagcaacatcacctctcacagtggctcgtgatgatatcataagaaagcgtccacatttcctgactattagaaagtattgggaaggtcccaagtcacaagcctggctctatgacaatacagttgtgggtattgatgaacttatagaagaaacatgttcccccttgcgataggtgtttgcattttggcagaaggtactttacccagaaaagttgaaatatgagatagatagctaatactatttgcgagtttctcagcgaaatatttttaaaatgtagaaaagacttgctgtcattcatgcaaggtgttttcatcttagaaaactactcatagcttttagaagcagcccgtccctaccaaatcaaatgaccacgaacaggagagacagctcctccttaccaactcctccctaccatgaacaaaaaataaacagagcaattacacaagtattctagaaaaagagttgccaaatcacattctaaaaagttagcgttccttccttcctttcttttacagtatatgcgcttattacacaacatttatatgaatgtttgctgtcctcaaggaatgttgaatgctatagatgaacaaaagttgtgacccatgaagctgtaactttctggagaaagaaaccaaacatgtgtagagttgttaaaaacatgtacctttgggccactggaactgaataccacacataagatgtctaataaacaataagctttctctctcatagccttggagattaggaaattcaaggtcaagatgtcagtagatttggtgtttcatgagtcgactttctagtttacagatagctttctgtctcatattcttccttggtagaaagtgcacaggagctttctgtggtcccttttctaaaagcagtgacctcattcttgaaggtcacgtgcttatgacctcatcaacatgctctccccatctctctgggcactaggatctaaacgtttgaactttgaggaaacataaaacattcagtctagaaaagacatcaaagcatctattatcagataatgtcataggaaagttactgttagatagaatcatcagaaaagactctctgaggatgacatttgagttgtctatgagaatgaggaagaagaagcaaaatcacatgaaacatgagaagtgtgtagttcaagggaaataggacagaatttacagtctgaaagaaaagaaagggccagtgtagctcaggcacgaccagtctgcttggaagagaccgactgaagttgcctatatgtatgtgtgtgtgtgcgtgtgccacagtagcagggcctaggggatcatggtaagaagtctggagctaaagaacagtattcagagccaggcatcatggcacatgcctttaattccagcacaaaggaggaagaggcaggcagatcttcctgtgagttcaaggccagcttcatctacagtgagcgttcaagaacagcctggtcctggaacatagtgagaccctgtgtcagcggaaaaaagccaaaaaagagcatcctgcattgaagtcatttaagcagggcacaatatgcttaactcatgtttatacaacaatcactggctctccagggcagtagatcaggaaaaagccctagagccagctcagttgagtgttaaaaattccaagaatctgaagtgcttgctacaagatgagacaatgctgacttagctgagagttctgctttttaaaaataacctaaagttattgtggcttcaaaatgaaattctttattgttccattgtccattgaaaagcaattttacaataattactgttttaatgatcacaagtatagtgtcagaagaggctttttgttgtaacttactgtggcaggaaattagttttagatgaagaatcctatgtgttcttagctgtgattgtgttaggcaagttatttagaaagctttgattagtaatgaattaataataatagagaaaatatcttagcagtctattccgtgcattgtcgtgttttctgttcttagccaccacaatgctgtcacttgaatccagtagcagagaagttgggggaactttccaaggtcacaaaaagaaattatgtaaccagaagaagttgtacttagttctttctgctatcacagaatgctaaaaaagaaccacatagcgtatctttattgagatataatttaaatataaaaatgcacagatgttaaatctataatctgatgaattctggcatttgtatatccttgttagctacctccccaaactaagtatagaccatctctgcttcaagagaatattcctgggagtcatttcctataagttctcccacaaatccttctaccctatagacaacagcttttaatttctgtcactatttgttggttcgtctctcatggatttcctgtgacgggcatagaaacaaaagaaaattggaaactagtctgttactttagtctgttactttattttactttttgttgctcacacatagttctgttaacaaagacgttcatatgttgagacatttagctatgtcctgacccaagatagtttctgaatggaggtgttaggtgcatttcagttcacggctatgtttcttttctattggggcaatacttgggaggagaactgccagagcacggggccagctgcgtgtttccccttttctggaagctgtccagtgactctccggagagccgtaccatccagctttcctatcagtggcctgtgtgctccacagctgctcgcacctacacacacactgggtattggcactttattttagccattctcgttgatgactttaatactgttttccacaaagacacatgatgttggatagctttcgatgtgtttgttggtccttagtatatctcgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagcttgtcagctctgccttcacagctacggctatgaggagggttttggggccctgggtctgcctcagagtctcagagactttcctttgggttttccttgaagactcacttgagctccatatttccccctttgattcatttggaattcatttctgcctgtgagtggaggtgaaagtcaaggctagttttcttctgtgtttatccacttgttttgtccacacttatgtgacctcctccctgtcctgtcactgtgccttagtcaggcaatcgtttgtttaattttacatccacacacccttttttagagctaataagatctatcttggcttctttcattttcactgaagttttaacaacagtttatacatttctttagaatgcaacctgttacttttttggttacaataacaaaggttaatttttttgtggtctttactgaacctactgatctacagatgtagctatatctgtattgtccaatagtctggactgtattagcagttacctccctcacgagagggaatgggtcccttttcaaagctattgaaacagtgattctctgaaaacattacttgatgctcgagaggctgttgccagtgagaagtgggcgaagtttgcctccagacatcaataggaccagttagactttcagcattgccttcgggtctacggaaattcagctttcaaaaactgtacagttctttgactaatattatatatatcttttataatagcatctgacttctcatagtatagtttggctacctggtaaatcatgctgcaattattagtattataagtcaccacgtataaaacaatcctatgcagatgaaagcactcagaaaggccctggggttaaatggtgagcaaggctacattctttgaatatcaggaaagggcccagcagagctaatgagaaggaccacttccagggtgagcttttcggtggcgataatcatccagagcacttgtctttgagtggtgtgacacttgtcttttggagatgtgacaggtgtgccctgcagggtgccatcaggagccctgtcaggtgctgagcacagggtttggcttgaggtgcgtgctcaataagcggtctctgtctacccagagccagggtgagttctgcggcaaacgctcctcccagtccatctgtgctcttgcttccttcccacctccctgttcagtggctctccaaaggtgccccgttcctcaaatactagtctgactttgatgactaccttcttcccaaataaaaagtaccccatgcgtgcgtgcggactcctgtgtgtatctcatgaaatcaatgtctatttcccataaatggttcacttttcctcctgctaggattgaaactaccattaacttagcagaatggagctccgcaattatttttttaaagatctgtagcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatgttttatgttttatgtagcttgagctggactagaagttgttatgtagccaaggatagctttgaatttctgaccctcttgcttcaattcccaggattatagacctgtcacatcataccacattctaggcttcatgaggttctgatgaccgaacccagggcttggtgtatgcttgacaagggctctaccaactgagctactttcacagctccttaaatgtgtacttctcagtgggcatttgtcttcatccaaacagcccacatacatcttaatgtttgctttgcactagcttgccatgggctgaaaatattcatttatatttaatacgctgcaataaattttattcgataggatgtagacctgtaataaaatcaggcaccatatctgattggaagaaatagagccaggtaaatgtgaacatttctcttttatggaagtatatattgaaagtatggctcattttgaagtcagcataattaatgaaattacttgtaagtgcttgaaaagagagtggaatgttattgataaatattttttctattgccaaattattattctttgcttttgtatgcaactgttattccatgggaagctaaatgaatctttttcagacagtggttaaactgatagtagtttctaagacctgctatctagaattctttctctcatcttaccccaaggggctcttaaatgtgcagttaatgtgttaaactctgtgagccatggatttaactagtcagtcaccagttaagttgcttcctgccctacttcaaagcactgccttcaggaatgtcaaaagataatacatttacatccagatctaaacttttattagccatcagtaagtgcatctagataatataactgttctgaagttagtgggatgaccgtcctttccatgtttatatgttggtatataaagtaacgagtttcattatgacagttctatacctgcatataatgtactttgatcatattcacccctctgtttccctttcttataactttcacttctttttccccttccatactcacctccctttacttctgggtccttcttctacatgtctagttcaggtgggagaaaatgcataagacttacctctgagtaagggaaatgcaaatcaaaacaaccctgaaattccatctcacaccagtcagaatggctaagatcaaaaattcaggtgacagcagatgctggtgaggatgtggagaaggaggaacactcctccattgttggtgggattgcaagcttgtacaaccactctggaaatcagtctggcggttcctcagaaaactggacatagtactactggaggatcccgaaatacctctcctgggcatatatacagaagatgttccaacggtaagaaggacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcacagaggaatggatacagaaaatgtggtacatttacacaatggagtactactcagctattaaaaagaatgaattgatgaaattcctaggcaaatggatggacctggagggcatcatcctgagtgaggtaacccaatcacaaaagaacttgcacaatatgtactcactgataagtggatattagcccagaaatttagaataaatttagataaaagatacaatttgctaaatgcatgaaactcaaggagaacaaagaccaaagtgtggacactttgccccttcttagaattgggaacaaaacacccatggaaggagttacaaagacaatgtttggagctgtgacgaaaagatggaccatctagaaactgccatatccgggaatccatcccataatcagcttccaaacactgacaccattgcatacactagcaagattttgctaaaaggacccagatatggctgtctcttgtgagactatgctggggcctggcaaacacaaaagtggatgctcacagtcagctattggatggatcacagggcccccaatggaggagctagagaaagtactcaaggagctgaagggatctgcaatcctataggtggaacaacaatatgaactaaccaataccccccctggagctcgtgtctctagctgcatatgaatcagaagatggcctagtcggccatcagtggaaagagaggcccattagtcgtgcaaactttatttgtctcagtacaggggaacgccagggccaagaagtgggagtgggtgggtaggggagtgaatgtgggagcgtgtggggggacttttgggatagcattggaaatgtaattgaaataaatacccaattaaaaaatatgggaaaagaaaagtgatttctatacttaaaatatttcctgtgaattcgttgacatgtaaaatttcaagtaggttctagatcttaaaactaccataacaaacctttgtaattctgtaagatttgaattttagagcgtgagctagaagcacttaccatgtacagcacattccagaaccagtgcaaagatgtcacgttctagacagatgatccaactcttactgcaggagtggagcacttgatcgattgaggaattttacaaattttcagtatgagcctgctattatctgaagtcagcagcctgattctgtagttcctctgaacacagcacactcttaccttctacctctgattgcttttgcctcactgctgaaagtgtagtggctgtaacaccgagacagcagcagcctatcagtagacacagctcctagaatggaacagttcaaggtttaatatagacaagctactgaatccacttggctgtacttccttattgcttagcactttactctttcttgactaagtggggataaggaataattctcattggtactgactctctctctctctgggtgtgtgnnnnnnnnnnnnnnnnnnnnttgcatgactaaaaaaagcaaagtttgttgtttgtaagggacactgactgatacagagcattgattaaccttaggatcatagactttgtatttataacttcagttccttggttttcattccttcagccttaaagaacacttcccatacctcagcttctgccagatgtgacgtgggtgcatgccttgagctgcacacctgtcccagtcaatgaagacttactggctttcatgttgctttccagtaactaaatgtcacccactttaatcacatcatggtcatcttttttgcttgtttttaatgacacaatttaataaaaaacatgaataagtctttccaaagtattctaatttataaatgtaccgaaatacgggcgttatcaacccttctctctaagacttggtgggttacaaggactggctcttggaatggtttcctcccagatatgctaatttctttccatagcttagttcttccattagaatcaatccattcaaacagacgaattacggatacacattcatcttatccactccctgtctgctagaatagtgctgtagctctctaaggttgtcaggggggcagaggaaagctcagtaactaggcaacaaatagaagaaaagtctggaaccggaccaaagtttgccagcactttcatcttttcctttgagtagagacactccagaaattcagtccatggccggggagctatttatagtattacatgattctggaggaattcattcccacagtttgcttgctgaccgctagagtactttggaagccttcaggttattatatagcattatgtggaccgcctaaaatgtgagctgctaccctcaggaaaggaaaatgcagaggcccctggcctctacctatactgtactacactctgtctagtatagtaaccttgtgataatcaaagtaaggctgttgttaaagctgttgtctgtgaagatcagacaggaactaggggagggaaaggggagagggaaggaatggaagtgaaatcaaactggagagaggtctttttggaggggttgagatgtgtacaccttggtatttttctgttgtgtgaatgctgttagcaaagaggcagggaaggagtttggtgcaaatctattgcttagggaacattccgtccttctgtattagatccatcaaggaatgcaagggaacttctgttttgttttaaatagaactcagaggttgaagtgctctcccagtatgaccgtctcacttgctttgctctaaggtgattctcttctcagttctgttcagtgacacccaatgcctcttggtgcattttaatgctcatcttgattaaaaaaaacagagagagatattagaatttaagaggaccctgtgattgtcattgccacttttataccttaaccaatataggtgcattaaatgtctccccaaatttaagtaacttttgaaaagattctcccagtttcccttaacacctaaatttgacattactttggttgaagccattactttctggtttgtcctcagtagacatgagggtagccgttagcattcccagaacaataagtagtacaaaattctggaacatgaaaaggccccctctcagctcttccctcacatcccgaacacacctagcgctttcacctacctttcttttccaaccctgtcattctccacgtgagcttctgttttcagttctctgcactgccctcagatgtcaagacttaaccaggcctggctctctagcacacacctaggagcgaagaataaaataagcagcttagctccgagtttctaagtgaattttctattcagcatcccaataatgtgccctcctttgcctgtcctgcccatcgcctgtttgccctctggtgcgcacaagcaacatccttattttgactatcacaagccaactgtgtcacaggctgagtgtgttagcacaagggactctgcgctttccattccaagaacaggggcttgctatcatatttcacccacatttgttttggtccgagatagttttcctactgtgttacactcattacccagagccagctctcacctgtgcttgctctgtgttggatggtgaaacaattttgagtgaacagcaaacacctgaataagtatagcgatgaataaaacccattgtcatattttaatccgctaaagtagtcatgttacaaatgctttattgtctgtgtacactggaacttcaaagacttcgtttctgcctagacgcttggtagtgcagccgtcttctgtcttgttacttccatgaaggcttactaacaggctaacctcaggttggaaatgattgtaatccagacagtcatgcctttccattctcttatatgctaatgagaaagcaagcagctttgcatctgttgcattatgtgtcttcccgaggaaatgtcacatggtactaagcatggggacaaggttcagccacacatcatccacaccctaaaactcaccccttactgggtggcctcctcttcccacttcaaaacctttgtagagtgaaaatcacattgagccttagagccttcttccatgttacttttctctgtttcttgctaactatttaccattttggatattcagtcataggtaggtagggattatttaaatcttctaaatgttttttttaaataaattaactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccttcatgtagtaaagtgcctgataagacacagcttgagggaggagatgtttattttggctcctggtttgaggaaatccagtccactgtggcaggcaaggcttggtggaggtgagagccggaggcagttggttgatcacatctgggtggatcaggaagcagaaagtgggccatgatgggatatctggtcccgccccaccttcctctttcatttggtctctgctccagctaacggtgagatcccatccacacaggcacacttggaagatcgatcaccaccttgtgcattgtaaaagtgcattggccctgacaatgagcagtacagtggccctaaagaccttttaccccgacctgggccagttcaccccttcttaggcaacctggtggtcccctgctcctgggaggtcactatattgatgccgaacttagtgcggatacccagttggcatagcacactacagcttagaactcctggactcaagttatccttctgtctcagcttcccaagtagctgggactacacgtgaattatggtaaatatttatgggattgctgcaatcttaatagaaatactatcaaaatacttatttccacaactgaacatcagcatttataggatgtgatataaatctgagtgagagtgtgagggggggggattttaaaatgttaatggcgatcctgtaggaggatcagcagtctcaattaacttggaccccgaagatctttcagacactggatcaccaaccaggcagcatacatcagctgatactaggcccccaacacatacagagcagaggactgccgggtctgtattcagtcagagaagatgcacctaaccctcaagagactggaggccccagggagtttagaggcctggtgaggtggataatggggtggggacatcctcgtggagacaggggttggggaggaggtatgggatgtggaacagttggagggtagatcagaaggggagtaaaatctggagtgtaaaaaaaatggtaatgacatgtgaacaaaaaaaagacctcttacccctttaacattgtgtaacactttctctgagtcactaatacctagtgttattacatgcctacctctaaccactactaaatatggctggctacagaaaggagattggatcctatagatctatatgctcttatttggcttaggtctgcgtgattccttggaagctagtataggtagaaaataccatttgtgtccttcctgtccagcctggcaaccactggaccatgtagccccgtagccaagtattatttaaaatgtatctattttgaactgagatttgatttaaatataaaatacatgctccggttttgaagatttagggtgtactgtagtgcttttatatttttatacggagtccatgttgaaataaaagattttacaatatatctattaaatatgtcattaaattgattccttgtatttcttttcttttcttttcttttcttttctttttttttcaatatggccaacaagcactttaaaattaaatctctggtttgcctctgtggtttgtactaaacttcctttgggcagtgctgtccttaacaagccttgacaaatgatgatgcataggctgtatctggcaggtttttaagggtgagaagtgtgagcaaaagtgacctcttgtgccatgcagggtttccatggttgctagctggtccttagtatgtgacctttgctctctcctgttctgaagaagttctgagggcagaagtcacagtccttacctcccagcagcttacaattgaaggaaaggaacatctaagactaatgtaattaagtgataatagtcttttgagtctgttcagacatggtatgaaactacacggacagaaatgtccggtttatgcagaagagtgatcgcgttctgacccttgcatctgctttctcaagagtggcttttcacatccaggctgctacctggggactgcaacctgcagcctgtgaatggtgaatagtatctcactcctggagagttaagcaaacaagggcgggcaggcataaagaacagctctgttggggattagtgagattaattacctggatgggacacagtgttttcatttgaacccataggcgataagactgccaaaaagctctgtcctgggaagagaggagaggctcctgggcagaacactgtagtatgggtttagaaaacaaatcattaaggaatatgccagtttctctgccattttcttaaacctgcatcattaaatctgcgccatcagctggcagcggttgagtagagtgcttatctagaagctgcgagcagggattttagagtcggggagtatctgagaatctgagaatggacttgggaatcttccctcaaggctggcttaggggcaacatgtttatattttggaacatggtctctctctgtctctctccctccctccctccgtctgtctgtctgtctttcttttaaattttttttgaaggtttgatcggaaggaaatggttgtttaaaattgctgtttagagctaagaagaatctctaggataagtggtttaagctggggatttagaagcaaacagaatttacacaacctcctcccttaccggggtatcaggccccagaacctaggagacaaagaagtacgacttttttttttttttggtctgtgtgtgcttatgccaatgttctcaactagaaggactttttctcctttgacatttattacaaattgatagaatatagtttatataaatttcattgacaaaagtaaagataggcattgtgcaactttaaacttattaaaaatcaaccttatatggcaatggaatgatttcttgtttgtaacaggcagaactttggaaattctccttgccttgtctggctttggccaataaccctggagtgaatggtctctgttgaccattagatggtacatgttccatctccacatcaaaataaaaaataaaaattaatattcagaaagatggtgatattagaggcaagcaggaatgcagaaggtttgagtgtatacttagttaaaatgaaatactgatcaactgatttcataatatgaatcataattcctgaggaatatttacattgtaaatgtgctcaatcagtttctaaatacaatggctgttgcttgtttagaaatctgtttctagacagccaggactacacagagaaaccctgtctcaaaaaaacaaaacaaacaaacaaaaaaaagaaatctgtttctaaaagctggtgcttttgtctaatcagatataaactttatatatgtcacatatatgtgatatgaaatatatgatgagtgaaatttcatatatgtgaactatatatgatgagtgaggatatataggagtgagtttttttaacttttaaaattgacttttcatgatagaaattttatacaataaaattccattttaagcatattctgggttttggtgggttttggaatatatacagctgtgtaaccctcgccatggctctaaataacctccacatttctaatagcctccatttttcctttgctcctgtttataatccactcctttcctctccttccttgtctgcagcaagctaacgatgtcacaactgctttgctgtgcctgagatttcatataaatgctgtcctatggcgtgtatctttttatggtttctcttggctaatatgcattgtaaaaatttcacgtcgctgcatgtgtcaggaatttgtccctttttatcccttgcatggctgtgcctccgtttgtctgttcactagacagcagacatttgatttctctgcagtttttttttaatcattgtaaataaactatagtggacattcaaatacatttcttttggtgagggaatgtcttaataaatgaaatatagtaatatgtttcaataagaagtttgtcatgcagtctctttgtttgagactggatctcactgtgtagctctggctatcctggaacaccctgtgttgaccaggctgtcctggaactcaaagaaattttgcttcctctccctcccaagtactagagttaaatgctgcattcaaagagaagagggcttgagataagcagaactaaaagcagtatgtgcatggttgtgttttagtagaattcctgaatgggaggtggggctactgatacgtctttcggctacttgctgaaatatacctgcccctttgagctgtaagccttcttccttaatgaattctctgaaggtatttctgctagtagataaagccaaagttcacatcatatgtatctttaattagtgagatctgtatatttatgctcttattattttctgatttagacaaacattattattattattattttttagtcagcacttctaaccacaggaccatctctcaaggctctcccttttaatagtgtcatttgtttgtttgtttgttctgatgtgtatgtgtttttaatcaagtgattgactgactgatatctttataaattaaattaaaatttttcaattaaatatgataatatttatttgaattcatcacttttttgtttacatctggatagcctttttcttttaaaaaaaaaccttttatttatttacttttacactgcagattttctgcatcctctgactgttgcacatcccatacctcttccctgccccctgtctccatgcggatgtccccctcctacaccaccagacctctaaactccctggggcctccagtctctcgagggttaggtgcatcttctcagattgaacccagacctggcagtcctctgctgtatatgtgttgggggtctcatatcagctagtgtatgatgcctggttggtggtccagtgtttgagagatctcgaggttccaggttaattgagaccgatggtcctcctacagggtcaccctcctcctcctcagcttctttcagcttttccctaagtcaaccactggggtcagcagcttctctccattggttgggtataaatatctgcatctgattctttcagctgcttgttgggtctttcggagggcagtcatgataggtccctttttgtgagcactccatagcctcagtaatagtatcaggccttgggacctacccttgagctggatcccactttgggcctgtcgctgggccttcttttcctcaggctcctctccatctccatccctgtaattctttcaaacaggaacaattatgggtcagaattttgattgtaggatggcaaccccatccctcacttgatggcctgtctttctgctggaggtgggttctacaagttccctctccccattgtagggcattttagatgaacatttttttaagactaaaaatataccatcaagacatggcactttttgtaggaaattccacaatattattctaacttaaatataaatgtagctgtggatgaagtaggactttattatcaggatacaattcaaaagtatgtgtgttactataattgtttcattgttatttagtagtagtaaacactgatgactatcagagactacacctgaaagaaagtatttattctaagcatattaaatggagaaaaggacactagaggctagtttatatagcatgcttcaatgtacatagaaactagatctggaattatatttattacacgacacacaaaaatatacctaaagagcatgcatgggaatgcctttggagatcaagaatagggacaaaaggagctttttacatctgacgtttatcttatgtattgtttgaattgtttcaacatgaatgtgcttgtgaaacaccctaagctaatgccaaacactacggaaaatatgaaagcaaatgatactatccaggtttcattcagtgcttatagttatagtggacaaggcactatacatgtgtcataagctcattagattacaacaggaagactataagatgtatgtatctaccgagaactctgcacatgacgagcctgaagcataaggggatttttggttagatgtgtacgccaatgtttgagataagaattcaaataaaaatgcggactctgggcattactagggacgattagtgatttgtagatgatatctttggcatgaccaggaggactacagagattgtggctagctagttgtataaagcaggggaaagtgaagatgtgctccttacctgctgatgtttccaggggttcttaggattttaattcaaagagaatgtgggtatttgatgtattccaaggactcttgtttaatgaatggaattttagatgataaaggatctgcactttgagggctccttatttgttgttgttttttggtttttattttttttggatgtgtctcgaaacaaaaatatctgagcaatttctcataagaactgacttgggataacaagaaagaattttcatatcttccaggattattgtttgattgcaaaaaaagctaataaatgattttgtctgttaaaatggttacctaactgcagaaagaagaaaaatagatttctatgccagggctttgaatgcattttagattacttttcattccaacaatacgtgtcattaattataatattagttaatatgttcttttaaatatattcaatttcataacacttaaagtcctgcatactctcttcccttttatgtgctaacctctttgtgtgctcttttccaacaaactctctatgtattaggtgatctacatgctctgacatcttaatctttgccatgcacagaccggtgtctgcacatgaattccttaactctcctctatttcttattctattccccagtacttaattatacttagatgggttgctgaggagctctatgaaggaagacatttccatttgtagcttcaccttcaattcctcaacttttccacatttaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtaagcgctccatcaccgagtaattccagcctgtacacttcaagtccctcctgcttcttagtgggtccatgaattgattaaactgttaattattgtttgatatatgttccatgacatttctaggacatagtgatagttcagaggctgaaaaagatgatgtgtttcttcattgtgtttagatttaagtcataggaaactgaagtagtgagtttatgtagctgtaagtttagttacacggctttggctcctgggtcgcacatttgcactcacccgggagctatctggattcatcaatggaagacacacacacacacacacacacacacacacacacacacacacacacacagagccagttaattttaaactgccatgcctacctcaaaggctgggcactcctaaaccttcccttgctaccccagacccaattaggaaagtgtccggtggctacccacctgaattctcacatagctggatggctttactgcccacagctcctatgttccattcctctacctagagtcatagtgattctctgtctccttcttgcagttcctagcccacacaaatctacaggtccttctctgtctccctttgattagccattggctgaaaccaattaaggacatgaaccttcagcatttggaaacacagattcctgattaaatcaaagcaatagaaccagtttccaacaggaaacatgtaatcatgtgaaataggtaggcatctgaagaattgaagaatgaagcaaggaaatgggactcaggtgtgtgtgtatatgtgtgtgtgtgtgtgtgtgtgtgtgtgtgtgtgtgtgtgtgtatctaatggattgtagattacagtcttaaacacagagatggctaggaagcacttcacttaatgtgcgttacctgaaaagtcctgcaagaggtaaaggagaagccccaggtttgtctgggagaagagctttccataccagggttcagaagatgcaaggttctcaagtcgagagaatcctggaatataggagttagtaaaggctagaggtaaaatttatgtttgcaaacattttatatacagcatctcaaactcccaagattacaaagagtagtttggaagctctcagtcttctgacactatgctcttcttggttcctgtattttcttctttagtttcttatccaccttcacattcccgtgattcctaatgtcaagttgcaatggcattaccctctagcctggggatgtagaagaacagtctactttccccaccttgagatgtaattagctgatttctcaccccgagctgcttcttttcatgaagaatctttttggcacatgaaaggttgtgatcagatcatgttctgaattggaaggtacaaacttccttctctgttcctactgtgggcatggtttctttttgcatcaattacatcactccatcaatttgtctataaacctgtacagaaagaatagtgctgtacagcgctgcattaattccgagcctagccgtgtacatctaaaccaaccagagcacaatgttagatgctgtagaagtgtgcatcaggtctccccagtgcataggggaaaccttatggtgttcttgagaatccctgtgatgaactttccagtctgtagattagaggtagagcacacagcggaaggagacctgcccttcctgtttgtccctacccacaggtctgtgtgataccacagggaagccttggagtcaaacctgcttcctctttctctctaaagttaatgagtgagtgacctacattcttggagttcaagcctctgggatccctgatgatggctgtttcattcataaaaaatggccaccttttcttgaagttaaatctatttgagtgatctgaagcgctcttttcttaactattgactgtcaaatcaagcatgccagtggcagttggaggacaccgtcattgtgagggctgaaagcattaatggaactcagtattaatgcttcatgaataacccagcacgggctggaaattagatctttctttgtgaagctgtttactgtgtctccactctcattggttgagaagtcaggaaactcccagtttgaggtcagatggtatcatcatatagcactttcattctctggataccggggctgattcttgtactcttgatgtatccaccgtctctcacagacactagtcagcaggggtcgatcaggaaggaacattttactttcgtacaaggtttttaaaggccaacaagtagcagagatgaacacatagaagaaagacttttggctcttacttgataatgctcctccagtttcagtaagtgaggaacccagaaaagcaagcgagagtacttgcaaactcgtttgtgtttaccttgtgtgtgtgtgtgtgtgtgtatgggggggtgtacacttgtgctgtggcatagtgtgcatgtcaaaggacagcctcagaatctgccttcatagggtttcttagttgttcaaagacgcaaaagccaggctcagtagacttgagagctttgagcatctgcgctgtccccacctcctgtcactttgtgggagcactgtgattatggacgcatgctacgcttgcggatttgaactcaggtcctcgtggttgcacaacaagcatacaaacccacagagtcatctccttgggctcctcatttgtttttgccaaggtcctgcaccgatactgggcagccacagtgcttctgatgctcggccttgtatatggctgacttggttagtccaagccctcagaactccctcctcatggttctgctccacggatggggcgcctctgcaagtgcaaggatcccgcctaaggaaggaagtaaagctgctgagaaccaaggggctctgtgaaagcactggcgagaagctctgcaaatgatagcaaaggaactggaaaagatttaattttggggaaaaaaaatccaatcctagcattcaccgctgaggcaagaagagctcacaaaagaagaaacctgaacataagattctgtctcacaaagcagaaaatattaaaaatatcaacataaactttatagacttgtattcagtatgtttatatacagttccgaatttgtgtgtctatgtttctgctgaatatctagtgtaacagaagttaactctctataaatataagtcattagaatgctgtatttttcaaatgttcataaacattgaagattatagacatttttgggtagtgagtgttatcatcttaatgttacatatttgaagtgtatttttaaagatttttttttctccttcatggatgaagttgaattggtattttaatgtctggatgggataagtgtgatcaagcgaagtttctaaactgggacatctggatgaaaggcccccaagtgtgagacaatcatttcttagagaacaagagattgaagattgaaaccctgtgtgaaaacccttactttgggtctccttagggacattttaattctcgcctatatggttgtttcacggttgactttatttatctcattcattgctgtttttctttgtctttcctcaagaatatgaagagcattttattaaggcacagcacagagctaagttattggctctgctttgtggaagatggatcgagtaatttggcatctgccttgtcacccacttaaacagtgtggctactatagttgggaattcccccagccactctggaagatttactcaacttttgtaatgtcgacacagcttgtaaaactctgcttagcctgaaagcactgcctatctctttcattgggctgtgtgtggctttctacacagtttttcatctttagcctcttttgctgttgttatgatttttgtttgcttttgtttttttgagacaggattgctcttcatagccttggttatcttggaactttctctgtagaatagactggcctggaactcagagacacctctgcctccaaagtactgggattaatgtcatgagctcccaccgcatggccttctacccattccctccctcttcttttttgttcacacatacatatttatttctctctctctctttccgtgtgtgtgtgtgtgtgtgtgtgtgtgtgaatttccttaaaaacatctgggttattaatgaatatcgactactctggctggtaatcttcccgattgaaaatatcacgctgttgtgattcttactatctgatgtaatgatttctttagtgcattaaattaatctaatcttggccttgggtctcttggcacttgcagacattcctttcatgtttcctgtgccttctattatcattaccagtagagaaatgttcagaaaatggagacaacagttgtaagactacaagggaattaatatccatatatagaatggcagtacttaaattttagtttccaagcaactcgtatgtcactgtggaataagtgaagtcacactgggtaaatcatgtaaattaaaggctgtctaggactaaaatagtaattgttcattgttagtaaggaaatatttactgttttaaatagagggaggaaattgcatgatcatacatggaaaaaaaatagcttttctgatgggaagttcctaacaatatgaaggtgatggaataaattctttgaacaatacatctttgggtataaaagaatagcattttcaattcaatgcagtttttctgaggcgacagttagttaagatgacaatgcagcagatctgtccaggatgccctctgttgctacagtcagggacacctttacttcatgtcacaggttgcccacctaggcactcaggacatttccccacagactccttgctataagtcatagggcagcaggtgagctgtatcactgaccagacagcagggttatagacgtcagtcttttgctctcctgccatagtcttctcaacactgtctccagcatgaacctaggagtctggggagagctgcatagaaaatgaatcctatatatcatgcaagctgcataataatctggtacttcctttggtcatcataatttgaagcttgcaaagtccagtttttctctatttttaaagttattcaggttatgattctaggtttggcctcactttgtcatatgtcagtgttcctccatgtgacctcctcctccaatgtgatactgatgtcagtgagatttaaagttaatgcctatataatacgtttttcactctcagaagagtgcttattgggcatccattatgtgcctagcattgttttagccttggagacagactggcaaacaagacacacatgacgttccctatcatggagtagttaatactctagtgggaggctgagaatgctggaggtggcagcaggttccctttacccaactagccaaatcagtgtgatcgtttcagaccgtgagaagtgcactgaaggaaatatccaagatgatgccatccaaattaacaggatgagcgtggagctacctgagaacaagcattgatggacagttgctagcacttcagttagttgtccatgtttagccagcacatgggaaaagccaaggagacacatgtaagccagagagaaagaaagatatgtggagaccagagaagagaacaaggagagtaggatggggtgaaagaaagggtattgccccatctagcttaaatagtcatgtaataaagagaagaccatattaggtcagaaattaaaaagggcccacgtatgtagagatccatcttaggtatggttccccaagcgacagggccagaggtagaagtgtgagaagaaatgttattggggagattttctctagatcaacagcaggtctttctggggcaggtctttctggctcagctgagagccagctggtcccttacctgcagcagctgggggatgagtttcatggccctgaagatggttggaagaagtcaaccatgaggactcggcttgtttatctgaatcttatctgtaaatacttggtaaataattgaaatgacaaatagatcatgttatgtacacacacagtattacatacgtgcataaagttttctcgtgttatacctgtatgtctttgaaggaagaatgttggtgtgcagtgtgaactgttacctccctttgttgggaaaggctgaaggcttaggacagaagttagaagatgaagggtcaggaggatggtagttcagtgatgtgaatgaaggaagcagagggttaaaggggtggggagaaagcttattggtctcagaaatcagaagaggttaatcttgtccattgaaggatattcctgaagcctgctatttaaaggtgggaccatgggaaatggaatttactaaaattagagcagaagtcggggtatgggcagaatttagaaatatgtaacaataataattgtgtaactgcttgaaatttacaatgttgcgtgtgatgtcaagttcctctaacagaaatcgctttaattggaaagcagtagagagctatgttactcgagtgtcagcgtagttagaaggaagaaggcttcctcctaaccctgtagccttgcgtttataaaagagcttgtttcccaattgaaattctgcagactttcagacctgttggtgagggacacacaagttgttatagggagagtcattcattttgcctcatgctgcttttctgacacaagaggttttgacagctttgtaacatgaacagtttgggtcaccttaaaatggaaaatcttgactgagcgctgggaccccaatggaggagtaaggggaaggagagctgaagaggtttgcgaccccataggaagaataacaatatcaaccaaccagacccaccctcccacccagagctcccagggactaaaccaccaaccaaagagtacacaaggggggctcatggctccagttgcttatgtagcagaggattgccttatctggcatcatagggaggggagccccttggtcctggggaggctctatgacccaggataggagaatgctagggcagtgaggcaggagtgggtgggtgggtggtagagcaccctcatagaggtagggagagggaggagaggatagggtgtttgtggaggggaaactgagaagggggataacatttaaaatgtaaataaataaaatagccaataaaaatgaaaaaaatgtgaaatcttctagaagacttgagattaaaaccctgttaagtcattatnnnnnnnnnnnnnnnnnnnnttgacaaggaggctgacatcaatatccaaatataccttggatatcccttcaacaacatccaaagcaacagcacctaccaaaggggagattcctacaaaagttatttcaacaaatctatcgagacacaggtctgcaactctcatgcttccagcgagtccatcaaagtttcatcaatctacagacacaggtaagtgtgtaaatgtggtgcaaactgacccgtgaggtgcctgccatcacctccaaggcttagctccttcttatttccaagccaatcacccaggaaacttccaagctgccagggacacagagccttctgttcaccacctgaacagacaacagtcacacagtcccgtttacatgctactgggtcaagctacactctaccagcagcctgcattctattaactccataaagcaatgcaacagggttaacactccccccccccgcctcccagtgcaggttttcattttataaaggtcagcattatttagtcaaatctgtcagacatgatcctgtaacagaagcctttgataataatggcttgtcagtctccgtggtgagtgacatgggaacagataaaggaaacagaacctggtgatctaccattccatcttgggggagtggaagaatggacgcttcctgttgtcctttggctgttctgatgggagcaggcagaggctgcccctgccctctggcaacagggcagccaaagaattcttgagctttcgattctcataaagcaaatgccagttaaaaggtttctgaggctgaaaggtttccttgttcagctctaatagaaactcagcacttactgaagcctactgtttgtcactgcctccatttggattccgtgttaattccaaaagtgtggacatgacccttggtccagtccagtcattattgctctataaagggctatttccctttgcaccccaataggttagaccttgaattggatttgattgatgacctgacttgcttttaagatgttttgtgattataggacacacagaatacagtgtcctgccagtcagtatttgtcaggtagaaaacttccagccaaccatgttacatggacattgtactacttagataactgctcctgattgtaacttaggagtgatttgtaacagaatgtcgtggggcttaaaacatggtgattcaatgcttctatgtatatcttcttccacttcagtgatacacggctgagaaacctaacgtgagggctggtgaaattatttccctcccgttggattcagggagacaggaaggatgagttccatgggctttcatttggaatgagcaaaactggtacaaatgaagaaaatgagtgtgctcttggctaactttctaatgaacattgtgtgtgtgtgtgtgtgtgtgtgtgtgtatgcacatatgcatatgcatgtacacgtacagtgtttgcgtttctgggaaatttgtatcctttcttgcagttatatattttgagactatcctatttttctgtttttacaaaatccttttaagtaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatgaggtggaattcttgcatgtggtggtagtttgagatttatgcagatggtgggtattaggagagaagttgggctgattttgtaagaatctcccttaaagagatcctggcggaatactgaggaattttagccactatccagaggcctgtgtggcgatcggcagccggcccttggcagatggtgtctgaagtgggggaaagcagacttgtcctagggagtcctctgcccacagtgggacacagtggggcccctgctcctgtggctgcatggcacgttgtcactcgaagctgacctcaagaatgactggttgaggttatttttagacgtaatgacagcgtagcactttgggcctcgggcgttatttctagactggagagtaatgttattttatttttaagaagtagaatttcaggcttttaagtgggcttttgggtaaagatttctgaagtttttccagtaattgagactttgtgagcagaaaggagagggagaaaagcagaagccccctgtccctcctgaccgcctctgtggctcgcagtgtccctaggtgggcacattgtccccgtcctgtcccttattccgagagtctcctgatagacaaagaagaaaaaaaatcattattttaaaccatttccttataacttccgacattccaaatcatacacacatgtgtggcacttcctcggtcgtgtctagaaagtaggtttctgtttgacttgtaagctgacctggctgcttgcacataggacttcacaaatgctcaaaggtggaatgcagcaatagtaacatgtatgcgtgctttagattctgtgtagcttgtttgacacacagtatgatgtgtgctcattgtatgagatggatagctttacagcaaaatgtcctcaagtcccacttaattttctcatctgtaatttttattagcatcgtagttggagtctttccctgtagtcttttttttttcctctgctggtactccacaatcaactgctttttctaaaataaaataagagcagggcttttcctttgcatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgtgtgtgtgtgtgtgtgagggggtaggaatttgtgcagtacacagggtctaagcccaacctcattttggttctctccacttgcatggctttaactcaagtctatggagttgtgtggtaggcctctaggactcacgtgggagacctttgctgtctttgatcttctaggcttttaacatagaaatcatttaccaatcctgtaagtagatgctaatcatattctcactgagccgagaagttagtcttcccctagccacctctctcctaagtgctagaggtgacccaggaacacaagcaacttagcactgacatcagagcgaggagctgctgggtcagttccacagtttacactgtgtgtaaaatctagctgcctcagccctccatccaatctcatgtccactggcagtttcatgtgtcccctttctgcaatagaacgtcctggctgtttatcacagagttacctcaactctttttggctcaccttcgaggttgtggtccacagacaaacatttcgtactctttactgttctccaagccctctgagtaggcttcttcctgattatgagtcatgctgtgcttgctctttgtcagaatctcacttcgtccccttcaaagtggaaaaacctctacacactcacaaggccacgtcctccctcacctcgtccttgcttttattttttctgtcttgtccccacagtggtaagcatatccctgtgtcggatgttccttccgtcatgtgctgttgcttgctcttggtgacttccactctttgcctactgggcttttctgggataggtgtctactcggtatcattgttgcctcagcatggcctatccagtgcatgtaacacagtcagcagtgagttaggctgggtcttagatggccagggtcctgcccaccatgtcctgtgccctccaggactagcctgtcccacttgttgatttcagtctgataactagatgtaaccctggcctcacctgccacatcctagctgctcagcaggaacctgtctggttttcagtcagagtttcctgtgcaggtggcggaggattttgaaatgcttgaaacgaagccatcacacccacttgaaatagtttctctcatctgtgtgataagaggtgggtggcaaaaataagttcacagagcctattacttggagctgagatcaccgattaaatgtcttgaatggggaaaaaatgtattggttgcacttagaatattttctctgacttttcttaccttgaattcagaaagaagacagttttcttatgttggaggaacgctgactaattccctgtacctccttcactgtcgagcatctgactcatgtgtatttaagggaactagctgatgactggactcatgcagctacgaggaaaacatgggacccagacctgtttgttaccctgtgttcttagggcctctttgatgcaatgcggcagctctggtgactcacttcagctcggtttgcagaacacttgaatgaaaacttcatgcacagtgatagttaagagtgctatgtagactgaactgaggcgggatggtcaaattcctactttcaaatgaaatttaaaaaggccaaagtaaaggtctctgcctggtttctccaaagcagagcctgagagaaagaggttgtctgagagagctggacattgggttggaccagagaaacaggaaaactgacgagcttggcctgttctgcacggcaccgaggttttcctgactgcaagggtatgtctgcagggcacagaaaggcagcagggaacccaactgaaaggcttacagattgggaatatgtgcaggaacggtaaatggtaactaacattttgcagctaaaaaaaaaaaaaagaagccgaagtgactttctacatcaattcaaaaagttttgaatacctgttttgctcgtataccattgctagtatttgaaaattcgtttaaaaagtcaatacactgatataaaatattgtttgtcctaataaccccaaacatctgaaacctttggcttgtttctctgtggtacaaagttctagcttgccctccgtgtgtgtgtgtgtgtgtgtgtgtgtgcatgtgtgaaacatataacttaattcttcttcttaccccatgtattctgttttatgttgtcagttttctgttagtgaaacaccaaagccttgcaccctgtaaagaggtctacttagttcctgttccatatctgttttgatctctaggggcctgagaacatggtaccgcttaccgtcaatgggtagagtcatttacacaggaggaagcaagaagaccaatagagatagcccatcatgcttttggtcttgtggtaacccatttattcctctgaggtttcaatcactctcatgagatgtggtgtctctggtgactgaacacctcccactgggtctcatcttttaagagattctaatactgttcagtgttctgttgtagtccaagcataggaacctttggggatatgaatcatgtccaacccatagcatcctgtaaaacatcttcttttatagtgtaaacaaggaaaagaaagggctgacctaattcatgtggtcctgtaacccatgctttgctttgctttgttttgttttgtcttttgagagacagggtcttagtatatagccctgactgacctgagacttaatatgtagatatagatattattaggctcatcttgacctcacagagatcctcctgcctctgcctcagagtgctgggattaaatgtgtgtgtcacaatactcagagctgaagttttaagtatgactatttcttaaattaggaaaacatatatactgacattataaaactaaccaattatgaagtagaactcaagaagtctgtttttgtgtttgttttatttttaaattaagtaaaatattaattaatgtcaattatttacatttcagcagaccacttagttaaatggtagtttaaccaggtttttagccctggtgtgtgtggctctgtttgtttatttgtttttatttgtttggttgttttgctactcaatttattatcatctattaaatggagtaaactctagaaacaatttgagatgagaggtgcaccttgtcaagagcctgaattttcctgtgcttagcgggacttaggatgcccatgccatttattgtatttggattgaaaatgaagaatataaagattttcagttttttttaaaatcttgtatactgcagtatcatatatgataagacgattgcaaaagaaagagaaatagcttaagccgatgtgtcactatcagtaaaacgagcacttagttaacaggaacctgaaaactcctgagtcttccagtattctttaatcgaagaatggctgtaggaggtaatgctgtttgtgacctacctctctcatgaagaaaaaaaaaagaagattaattagtgagtaattaatagaccaatgcacagccccaagaaaggtgttctgcaggtcagagctttcattaaaagttgactctccagacctcatgagatggagccttcagtcagtgctcataagggagccactcatcttcaggcagtgacaccagggatatttgttctagttccattcgacaaggctcattttcccactgtgttccttagtgtcctcatctgtcaaatcaacagtctatgactgggtagtcactaagaggaacttactccaaacgtgccatcatcaatgtcctttcaactcccatttcccacccattaaactactgctaagatatatttcacatgccccactcaagtgctgtggcagatctttggctccctttctgatgaagaccgcatcatagccagcacagactctaggtcagggtcagcttcaggaacaatcagctggtcctaaagtgatcataaccctcctgtggcttctcgcatctcatgaccacaatgggaactgaggtcccagctgtggaccacactgatttactctgaagctcctggccagacagaaactttaacggttttgctttcagtttgcttcttatatggcttggcttatactctctctttctcgagatctagcaatacaatcttggaggtcgtaacctgaaaataatttgcaccacacatgacatttcagcatctgtttctgaagaatctgacctggtgaaaagaactcaagcagaatgtataaaaaaagacaaaacacacaagctgaagggagatctgaagcataaaggatttttttctcagtctatgccttattcattggaaaactgcatttcgagccaaaagcaagagaggcttaaccaggaagagtccggttaccatggggtgtgtgataggcaggagaggacacctctggcagtccaggttgtttgtcctgttagtgttggttatagctaagcctctactcgcctgcttaatctctaaatccatccctttttgtttcagagaattttggagagaaacatcataccagatatgtttggtttctattagagactgtgtctttttcagatcagaagtgtaggcagtgctttctgtctccttctcctctgtccatgtcttttgatttaaatggctccgacttggttttcttctaaaaaagaagttgctgtttgacagacgctgtaaagtcgaacttataacaaaaattgtatgagtgcaagacattcagttttatactggaagggaagtttggtagttccttgctggtgcttttcccatattaaggattttccagtttggtttcgttttgaaatgagatttattgcactttattgcacaaagttatataacttgaagatttttgattcccctctatccgttgcttgagtgatacgacggaactgtttttctatttcccttttacgtgatttgatttgtgcatttatctattcttgacgagtcatgctagaagaaactgagttctgactggtgtgtgtagtaaacttcagcttcttttgacctcaccctccattcatctactccatgatcagagagtaaatcatgtttctgataccatgttttagaaagcttaattatctctttagcatcagtgttcatccatccatggagtctgtagttctttccactaatggacagacgtccagagtagtatcatgtcagtgaaatgccttccagataaaaggagaaaatgcacacctctaaggttcaatgcagagtgtgttggtatttttgcataaattctaaaaataagctgaatttctgctattattagtcaaaatactgggcattgtggggtagaagacagggctgggagcttggggggctcatagtgtttcttgatctgggtactggttgaatgaatgtttgttttgtaaaagatcattgtgcactatacttagggcatattttctgtttcttctctcctcccccctttctctctctccacacacacacaaatgcataccacacaaccgttttctctctttctctctctctctctctctctctctctctctctctctctctctctctctctgtgtgtgtgtgtgtgtgtgagtgtgtgtgtgtttgtgtgtgtgtgtgtgtgtgtgtgtgtgtgtgtgtgtgtgaaatgtctctcaagcccttagccttgagcttccacccttgtatttttggagactgacttgctatgcagctcagtccagccataaactcatgattctcttgcctcagctttcttcatgctggaattagatgcatgtgctaaataaacaatttaaaagtacacctggcttaggaaatgcccttggagtaaatgtactttaagaatcacaaaaccgagtgttggatcccacaatcggaaagggtcttgagttctctggtgtctttaagaggaacagatatagcctttggagttcagttggtatcctatagttctgtgatttcatgttgtgcacccgagggagcagatgattacagagcttttagtagatggaccatgcttccatgacggctgaagaacacccggatccccctacctccatctcatgcagtcctgctgtgtggctcggctagcctcctgatctgctcctgcatagaacctctcctcactgaaggctttgcttgagcatagttcctggggatttataatggcaactcagatacatgggatagcctgatttttcagttggccagaactagaaaactgtagatggttcttatttggcttgtgactgtagcctttaaagccaatcttgtcatgacagttatccttgagagtagctattatggtacagctaaatttcaaagaaaaaaaaatggcttttgctgttgtttgagataagatcttagtatgcaactcaggctggcctcaaactcaccatcttcctgcctccacctcccaagtgccaggtgacactgctgtgacatgtcctctgggttacacatgctctgctgccacggggagccattttcccatgtatgtgaggctatttttattttgactgatttgtctttttaatccaaaggatataattgagattgttgtatttttaaattgttttttaaaagaatttcatatttgtctgttgtacccaccagttcttctctttctgatctgtctctttctcttccccattccctctcaaattcatgacctctttattctttaattaccattgttacatgtatatgtgatatactggtattgaataaccagctataagctaggtccctggagagcactaagcttcctccgagcctcctttatgtagaggtgggacattggaagatttcctccatttacattggcatgtcagctgatagttattgttcagatcttggttagaagggggtgtgtctaagaatgtgtattttatctttgtcagtgagcactgaattttctagaaaccatttagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacataattacgtttattaaataatttaaacttgaaattaagcacggcgtaaggaagtagggaaggggacagtggaggagtagacttcttttgtcaggttctctaacctttttacattgcaacacagtgttgccatctatctgcaaagctcataccccaggaccctgaaattgcacatgcacattcgcacatgcatgtgcacacacatacacacacacacaaacacatgcacacacaccatgtatacacacatacacaccacaccatgtatatactacaaaaaacacacaccacccacaccatacccacagcagacacatgggcaccacatgcacacacaccatatgcagataacactcactcgagcccgcacgtacacacacacacacacacacacacacacacacacacacacacgcacacagagcaaaacaaccacaatgttttatgtaattggtttaatggtttaatcgtttatggtttaacattgagctgaatttacaaatttgcccctacccttggggtacatggggttggccagcaatttggaaagtgagcagttggtggtcagagcctggggatttttaacttcctggttctggaggggaaacaggagtgatgactgagattagagtaggaatgtagatcactggagacagggaggttaagaggctgagagtctgagagagcgtgggccagttctgtgttcttgtggaagtagcacggtgttggaaggctctcagggagtgcaatgctggttgcatgccaggcctgtaacaaataaagtagactgagcagtgagcagcgggggatggagacactccgtgtgccaaataagcagcccgcaagccccagatggcctgcacagcacaacccctggattcttggtgattcctccatttctcagcatccttcgaccattatcttgatcgatcaaactctgaaaggcaggggccgcccaatcttagttggatattccaagatgacaggaatcgtatctttttcatcttctttactagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtccagggcggtgccctctgaggagttcattccccacgcttatataactggaagtgagcagtgggtccctgattgcaaaataatacaaacacccgttggttggttgcctccgaatgcatgattttgctgccctgtaccagataagcacttaatttttacccgccagggttttttgctaaaacggaggtggttgcacttgaatatctcgtctcagtaggaattttgatgtttaagtgattgcattagcctttctttattgtacaagtaggaaatagaagcactcatagagtgctaagaatatataataaagatagacacattttttttttggaagtatggtcttaagtagccataggaagtaatgggtcactatgccatttgcataagcgtatgtcttctttctctgctttgatttatcctcgtgcctcatctccttccccattccccctgcctctccatctattacatgagcctgtatctttccttaaaatctatttttttcatgcatgcatgaaaaaggattttaccttacaatttccaaacaactcatagggtgtgatctagagaatgccaaatgtcattttgtgttctgctgtggctttctttcattttctgggattatgaccaagcctggaccttacagggtttcacctcagttcccttctctcatcatcgaatttttagggatttggtcacaattttgacccatttatgagttgattagatatgtatctaatgaaatagtagagacttcaatttccttgcattaacatgggaaataagtgcagtctgagaaaatggtgatttcattttcctttaaagggcattctctctctctctctctctctctctctctctctctgtgtgtgtgtgtgtgtgtgtgtgtgtgtgtgagacagagaaacaaagagagagacagagagacagagaggtggacagagaagggggaatggatgaggtggcaaggacaaagtgtcactactagcatagcccaagctctcctaccacttggccatctttctcattcagttcagctccctgttgtgatctcaggacttatacatcctccttatttaagccattgctttctgattttattactgattggtaaatatgtagacatttcccaaaacaactgtcagactctatcagttacttgtctcattattgtgacaaaatactcacatttggggacaatgtcttcctgccctattcatcgtactctagagagtccctcacaaacaggtccagaactttgtttccatggcaattctcaagttcttcacgttgtcaatcaagattaaccactgaagtatccttggtctgtttggcagttggttactaaaaacgctggttgtggatatgtttaaataccatgcatggcataggaattatttttttgttgatgatgcagttaggctatctcaaatttgtagtatcttagtgagatggaggggaatataaacaaggttttagtctcagttttttaagttcataagctttctttttttctccattatttctgggagagccttgtgaggattaatttttcctccaagtttcagttggtgtcctttctgtgtgggcgagcactcgtggctgctttactgtaggaacaggtttctggtgagttgctcgagcaaaataaataactattctcttaaaaggaaagcaaatgtcatagcttttgtgagccaccttattatgcaaatatcattttttttacatttagtatttgaacagtaagtcattttctactttccataaacatagcaaatcctgagcacagaaatgtagacacctttttgcttataaaagtaaatgcaaaaatatattataaaaaaagcaatgctattttatcgtttttattttgtcatttttacacttttgttgtttgagacaaggtctctgtagcctaggcaggcctcaaactcactgtgtatccaagtatgacccggagctcctggtccttatgcaacactgtgcctcctgctgagttttaatgaaccaacaaatattaaggactatataaaatctagaaaaaacagtgaaatcatgtctttagctctgtctccacatgtgtggagcaacctgtaatacgggtcaatgatcatgacgccatggatggcgcgtcccatcctcctgctgaagtctagatgccggatgttgctggaaacgtcttacacagggatgattagcagtaacacaactctgcacagatatcactgcaagtcaggtacatttattttgaaacttaccttcacaatactagattcagctcagcttttccttgcctggctctcagagacctttacagccaccccagggccaccagacactaatgtgttgggaagggaagaggagtaaggaggaagattgactgctgttagaataccttgtgctgacgctttgatgaaacacgccagtctgtgaactcggtgcacaggctcctagggaacccctgcacaggggagagagaccctgcaactgcagccccctccactcctgcttattcggagagaaattggctgctggaatgattaacttcaggcatttcaagcaccgtaaaaagtcacattacttgtgactcttgtgactcttttcctttattcttctttatcgttcaaagtcattctttcctctctattctaaggtgttaatattaaactacattaaaatcgtccctcagaaagctgtaaaagacagccatgcttttcactctttgaataggttgtgttatttaattgttaataaaagcaaaatacctttattttaaagcaataacaataaaagtcccagcagcaaatgcactcttgtgttattagtcgattgcttataaaaattgccaggactgttgtaaggaatggaaaatgtggattatatttatatttagtaggcattgtgtctattctgagcctctttaatctccaggcagccaaagtgtaaaggattttcatgcaaagtgtgtcaaatgactcagctccattgttcctaacatggaaatggagttgtatattaaaattcctccacccttcccagtaacactacacggtgggtggggggttggggaatctgggagatagcaaatgtggaaacaaggtagactattacacagagtttaatctcataactatttacagaattacattgttgacatagttaaaatatatacacaaatataaaccactttaaactccgtatgtaccccactcatttgctcctgtcctcgttcataagggcctgtttttaaatgatattaacagtcacttgacacgatagttcatactgtatgcaggcttcggggtaaatgttctgagaaataccttgtcctatgaatgcagtcctggtgaattcaccctaccccttaccctccccgaccttgtactggccttgattggaccttcctccactgttttctttaccctgtagggccatgccctgctgggggcctgtctaggacacctttctcttcctgtccaagtctgtggcaacccacacatgtcaagaaccctgtggtggatctgccacaggttcagccatgttagcagagggcagagaagcccactgagggatagtagcaaaattattcaagggaccagaatgagaactgcctaacctcaggcagggctgtgagctgtgagcaggactgaccacccatagagtctcttgattttatagagcaatccagtccagtaccagtgtcctttgtctccatgtgtctgcatttaactgtttatcagtgtttcccctttgctcctagtggatgaaagctccttcagacccagggttcatcacttagaaatagtgacagccttcctcggaggctctcctaaagcttgctaggtcctggcaggaatctccgtctttatatatagatatgctatattctgtgtagtcagacattaagtaaatggccacagaaaaatggtatatacattgatgtatactgtattcagaacattacaaggcctaagacacactgtatcacttggattacaatgacacagatacagatacagatacagatacagatacagatacagatacagatacagatacagatacagatacagatacagatacagatacagatacggacagatacaagatacaagatacaagattacaagatataggttctgctttacgtttgtataatgttgtgcagagcattatttcatgtcatttagcattgtcagagtggatgccatttgtcttagtcagggtttctattccagtacaaacatcatgaccaagaagcaaattggggaagaaagggtttattcagcttacattttcatgctgctgttcatcactaaaggaagtgaggactggaactcaagcaggtcagggagcaggagctgatgcagaagccatggagggatgttttttactggcttgcttcccctggcttgctcagcttgctctctatagaacccaagactaccagcccagagatggtaccacccacaggagcctttccccccttgatcactagttgaggaaatgccttacagctggatctcatggaggcatttccccaactgatgctcctttttctgtgataactccagcctgtgtcaagttgacacaaaacttgaagaaggaaattgttctcttagaagaccatgaaagatagtgctatcagatttatttattcctttactgtcctaagaaacaaagtatgacagtatccagtaattatcaaccttacataacggattatcagaagggtgttcagttggaatctgtgaagtagatgatcaaaatcatattgagtcaggcacaatggcatacacagtgaggaggctgaggcaggatgatcatcgtgagttcaaagccagcttaggcaacgtagtaagattctatttaccttccctcctagctaaataaaactagcaaaattacataaatggcttatatacagcattggtcgatttaatttgtttaaaaagcattacaccaacaatgggaggagtgttgctctttctccacatcctcgccagcatctgctgtcacctgaatttttgatcttagccattctgactggtgtgaggtggaatctcagggttgttttgatttgcatttccctgatgattaaggatgctgaacatttttttcaggtgcttctcagccatttggtattcctcgggtgagaattctttgtttatctctgagccccattttttaatggggttatttgattttctggagtccaccttcttgagttctatatatattggatattagtcccatatctgatttaggataggtaacgatactttcccaatctgttggtggcctttttgtcttattgactgtgtcttttgccttacagaagctttgcaattttatgaggtcccatttgtcgtttttcgatcttacagcacaagccattgctgttctattcaggaattttttccctgtacccatatcttcgaggcttatccccactttctcctctataagtttcaaagtctctggttttatgtggttcattgatccacttagatttgaccttaatacaaggagataggaatggatcaattcgaattcttctacatgataaccatcagttgtgccagcaccatttgttgaaaatgctgtctttttttccactggatggttttagctcccttgtcaaagatcaagtgaccataggtgtgtgggttcatcctctgggtcttcaattctattccattggtctacttcgctataccagtactatgcagtttttatcacaattgctctgtagtacagctttaggtcaggcatggtgattccaccagaggttcttttatccttgagaagagtttttgctatcctaggttttttgttattccagatgaatctgcagattgccctttctaattcgttgaagaattgagttggaattttgatggggattgcattgaatctgtagattgcttttggcaagataaccatttttactatattgatcctgccaatccatgagcatgggagatctttccatcttctgagatcttctttaatttctttcttcagagacttgaagttcttattatacagatctttcactttcttagttagagtcacgccaaggtattttatattatttgtgactattgagaagggtgttgtttccctaatttctctctcagcctatttattctttgtgtacagaaaggccattgacttgtttgagttaattttatatccagctacttcattgaagctgtttatcaggtttaggagttctctggtggaatttttagggtcacatatatactatcatatcatctgcaaaaagtgatattttggcttcttcttttccaatttgtatccccttgatctccttttgttgtcaaattgctctggctaggacttcaagtacaatgttgaataggtagggagagagtgggattgcaagcttgtacaaccactctggaaatcagtctggtgtttcctcagaaaattggacatagtactaccggaggatcctgacctctcctgggcatatatccagaagatattccaaccagtaagaaggacacacgctccactatgttcacagcagccttatttataatagccagaagctggaaagaacccagatgccccttaacagaggaatggatacagaaaatgtggtacatttacacaatggagtattactcagctattaaaaagaatgaattgatgaaattcctaggcaaatggatggacctggagggcatcatcctgagtgaggtaacccaattacaaaagaactcacatgatatgtactcactgataagtggatattagcccagaaacttagaatacccaagatataagatacaatttgcaaaacacatgaaactcaagaagaaggaagaccaaagtgtggacactttgccccatcttagaattgggaacaaaacacccatggaaggagttacagggacaaactttggagctgggacgaaaggatggaccatctcgagactgccatacccagggatctatcccataatcagcctccaaatgctgacaccattgcacacattagcaagattttgctgaaagaaccctgatatagctgtctcttgtgaggctatgccaggacctagcaaacacagaagtagatgctcacagtcagctaatggatggatcacagggcaccaatggaggagctagagagagtacccaaggagctaaaggggtctgcaaccctataggtggaacaacaatatgaactaaccagtaccccccgccccccggagcttgtgtctctagctgcatatgtatcagaagatggcctagtcggccatcagtggaaagagaggcccattggtcttgcaaactatatgcctcagtacaggggaatgccaggtccaagaagtgggagtgggtgggtaggggagttggagggggagggtatgggggactttagggatagcattggaaatgtaaatgaagaaaatacctaattaaaataaaataaaaaataaaaaatttcaaaaaaaaaaagcattacattttgactaaatatttcctgggtttggggttggtttgggaggcaaaatatttagtaaacatgaatacctttttaaaatgttttgatttttctatctcatgttttaatattaaaaaacaggggaaaattcagtgtgactacattggaaagagggacaaagaaatccaggagtacccaagtccctcctccttgccttgacacaaggttacacatatctaagctgccaaagtcagggtggttgtcctgcccatcactgacccattattgctttgactccactctactaaatgatggtctgagatttgatctttgtttgatggataacagtagtcctcctactatttctcaaggcttttttctagatagcataatcttataatttatgtgaaattatattttcataatgtattaggattacctgtaaaatgaatgatcttcattatctctggtgcaatgagtatgattttagtgcaagttctaatagtctatcttgaaatcattcaaccacacccatttctattcatgttgatggtgactctgtagttcatagagaacctactttaacctatgtgcagtacctgatgctacatatgtcacgtagcttttctaggtgaatagtttttaaatatacttttatttttagttaacacatgtttataggcttcagtgtgatgttttgataatatatccaatgtgtaatcatcaagatcaaatttgtgtatttgtcatctcagagatgtataatttctctacatcggaaacattaaaagcttgctttactaaagatattgaatattctctcaactgtagtcaactacagttgtgctgtgccttcaaggattgaaagttaatcctcctatgtaaatgagatattctacaattcctaggtcacactgtgtgtcacgtgactgaagcctatggtggttgaggcaaaagggaaattatctgcagaggcttccaatctcacaagtaaaactacacatagaagaaagggtagtctaagtcaggttctggacactgaacacaagtcatttggacatccagttgttcttcagagcttgaaccagggtagcaactcttgtttaccaagaagccaggaatcttcccagctctctgggttgcttttcacaacgttttcaaggttcttctacagcatcagggaccttataggccttcagttatctagagttaggccactttccttcatgcagaagtaaggtgaaatcaagcagaatgccagtttgttaccctgccctttctttttaaaagaaatgaaagtaatcttatgaactaaatatgggggaggggagacatctccacaagggacacatggcttttatttaatctacatggaattgatgttggatagaccccatttttagtttactataatcttcccgcatggagcaaacattaagatttcacttctaaatcatgagaaacgaatgttcagtgcaagaagaataccatccgtatcgttgtaaggtgccactgacacggtcactggatagtagaaataataaggttttgctgatacctagcagcataaagaatctagatcagatggttaaaagttcaaatttgtgttgtaacacattcacaattgaaggataaaatgaaaaacattaatagattttaaaaaaaacctttacttgggtgaatatgatgtctttaaattcctattcagtggtgtgttttttcatgtgacccatttaaacagacaacatttacattctttccagagtggtgccttaattactgaggtgtacttttttcataaggaaagtatgttcagaatgtaattctggagtttccaggagtaaggccatgtacaatggtcccgtttctaagatagcatctctccagatttccctactaacaggtttatatttttataacccggttgattcacagattccagtagaacatctatcttttttccctttttatttgaaattcaccaactatttatttaatgtatagtttgtgtacctgaaactgccatatatggttaagatagttacagcagttcacgtggacagcaaaactttttcattcttgggttgttttttttttgagatcataattatattatttcccctcttctctttcctccctctaaactgtccaatagaccccacctctctctttttcaaatttatgctcttttctccaatttcttaattagtcaacttccatacctacaaatacacatacacatatacatgcatatagacacatatccccaaatgcaacccgatcagtctgtataatgttcctcgtgtgtatgttttcagggctgaccatttgatgaggcttcatgggctcttccatctcgtgtttgcatgtctgttactgtccttgctcagccaaggtgtcatgttggtgaggctttatggtgcagcttttgacagtagtaagagacacagtttcctagcaaacgtctgatcctctggttcttctttctgatttctcttcctacatagtactccagctttcggtatagaagtgtttagcagatgtatctgttgagactggactgtacgactctattttggttcactctggttgactgtaatggtcgctgtcagacagcaaaacgttaaaagtaggaaggcatgcagtgaccactagcaacagtacaacatttaaagtagtttaaggcctcctgctcttctgggaagggttcacttgccacatttagtccctaggacttagggggtgtcttctctcacttgagcctgtgattgcttggcaactgaacaaatgcgacagaactggaattggagttgggctcattgaaatgcagaagccagaggagcagtgataacctgagctcaaacagacccaagagatggaacacagactagagcacggggtctcagaaggtgaggatgtgggcagcaagagaggggaatgcaggcgctaatgctccccagcctaaagctggtggacagaaagtggtgatggaagcagatattcagacctttgttttcatggaccggattcttgagacatccacagttttatagatttggtataaaattatttaaaagtgagcttctctttgtgtggaggcaaagctgggatcatgaaacccgtttggctgtggcaaaccccagcctctttcaagctatacattcactgaagaatacagtttatgccgtgtatataagtatgtgcatgtgttggtaagacagatggtaattgatcatgacagaaggccaaactcttcctctgcccagctgtccctcaacactctgctaagatgctctgctgtatgggctgtggattgtcccatccaagacccacaggggctgcactggatgataaccaattgatggcattagtaacaatgatgacacaaagtaaagaaaagagtcaatgacaactcttacccacacagttcaatattttggtatttgtgcaaaggggaccaaatacttaattcagaatcctgttattagtgaaagttaatttattgacagagccagataggcaagctgtagtactgtataattttcatgctgcccctgctacagtgacaaagtggttgagggctagcactcacatgtatggtccgatattttgcataatattaaatttttatttttgaacatgtgaaggagctacttcttcaataggtctgaatttcaagttttcatttttgtttatagtatcttacagctgaaaaggtgaatattttttccctcagattctcagaaattgttttacaatccagagttttactcccattgccaagccctgagacaggatttctctgtgtagccttagctgtcctgcaactcactctgtagttcagcctgtccttgaactcacagagatccttctgcctctgtctttcaagtgctgggattaaagatgtgtgccaccacctggcctgtgttcttagtaacactatccctcactgactccatgtcccaattagataaaaatactgttttttttttttacagcaatcattcattgttaacgtcatgcatttcatcaaatctggaaaaagtacagcctcaaatcttgtatttttgttcataaaaatatgagttttagcttcacaggaagaatgaagcctacctgttatagctagaatgcattaataaatattcaatgacaagaaaatatagttttatgttcattttgaggcttgtggctagcagcatcttcagcttgggggacatagctcagttgatacagtacttgcctgttctttgcacagccttgagttccatctctagaactacatgaactgtatacagtgatacatgcttgaaattccagcaattgggaagtggtatgagaatcagaagttcaagatcaacttcagctcatagtgaaataaggtcagcagggctccatgaggcagtatctcaataaacaaatattctcaaatagtatcacgagtctcctgccttttgtaagtacccttgtcttttgttgttgcagtagtgagtgttgggaatagtgaggtagaacgtaggagttttgttgctggccagattaaaagtaaaggaaactaaatggataatgaatttacctcttcagcaggctacacacagacacgtgcttttgaaagaagccctcctcctcattcacatactctgtctaaaagtaaaattgtgaacttgatgttgaatttgaatcacaccaggtgatatgcatatctattattataaaaatctcatttttgtgaaagctagtatttagttatgtcgtcatttttttttttttttttgaaatgtcaaaacatgcacccaggcgagttcagagcgcctgatgattcacgggagatccagagattcatgcctgggtgtgagcaaacatgtcagtgaagccactcacagagtgaaagctgcagaactgcagtgccggaaagtgagctgtgggggacagaccacaggggagccctcaacagtcacctcttgctctctgtgaccttccgaatcagaatagagccagtccagtttctgatttccctccaatcgaagatgacagacatggaccatagcttccatgcttaggctaaataagagaatgaccttcccctttacttctctgactctagcctatggtagctttgacctaatgttacctgatgggaaccgaggcgtggctccagccaagctaaggattgagacccacagttagcagcctttcaacaactgaatggtgccaatcaagatgcaaacttggaagcctatgagttcccagccacgactggtaccttaattccagtgtcaaaaacaagtttatatggtgttctgcttctactcttgtgatgtttgacataacaatagaacgctagtacacggttatagtattttgcttgggccactataataaagtacacagactaaatttactgctttatccagttctgtaagtttgatgtcttcaacaaagttgtcagaggcattgcatgtaataaaacaaaaaacaaacaaacaaaaaaaaaaacatgctcccacttttcctaggacctcggccagtgttcccagcctagctccgagctgccactggctccctctctagacttgcctgttcctcctggcttacctcaggattgattgcaaccaacccccactcagggaaagccaggaactgctgtccgcagcagttctaccaacttctctctttctctgcccaccttaactctgtggaagaaaaacactagacatctttattaactttgaacttgtcagatagcacagttgctgggtgcagaatctcctgctctaaccttatcagctaacctatatcagctagtctatgtcagacagcctctgcagacctccttggttaaccactggtggtggaggctgctggttctaatttccccaagatctaacatgactgctgttttctccttgttccaaagcctggcctgaaaaaaacaaaaaacaaaacaaaacaaaaaaaaaccaaacaacaacaacaacaacaacaaaaaaaccctttctccttcctccagtctcttcttcctcctggtaccctgaattcctatcttcaccctttacccagcaattggctactgccctttttattgacaaaccaagaaccaactagggaaacaacaccccccctagagaggcatgttttgcctgtgacttctctccttggcatgtagatagcaatcctgtccttctctctccacactctttttcttgcatgtgtgccgatgtcctgtgttgtttggttttgtttttctttttgcatagacacaagctatactgggttagagcacacactgctgaccttctaattaccttttaaatcattctttctacaactgtagtcacttttgaaggtctgggaatgaggacttcaggatatggaatttgcaaggcagcagctctgccaattattgttggcataaaaattagtaagataaatgtagaggtacgtgcctctcattctagtgtttaagaggccaaggcaggaggatgactgtaagttcatggttagccagaaattaatggtcaccctgttctacatagcaacttcaggctagccatagaaacaaaaatttaaaaaataagtaaaggtaaatctgtaattatttttatctctatggctaaaactatataaaagttattgtctataaagttcttttgcttacccattttccttcctttataagtatataattacacatattgtatactttatatttctgaatgccacgtggttagcatctctttgcatatccttgtaagcatatgtcttccatatgcttcgcttgaaacactacttgtttaagagaatggtaataagtgcatttccaaaatttggtgtaatctttgtgtttacttgtatattgttaaatagctaagaagtagaacttgttcaaggcttgaagagtttctagatatacggttgtaggtggtgtagactgctctttggaaatccagaggcactgatcgtctctctatgcaatgtgtccacttcgtgaacacacttcttttctcccagtgtgcatgcacacacgaagacacacacatgtgtgtacacaaattattttttccaaaactccaggagagcacaacagaggttgacagttatgagctcacagttctcaaaatatggatctgtggacctcctgtggacatctcagcagatgtgtaaggtcaaatgtatttttcaacaaaactaagatcctatatgccttttggaaaccagctggtaacatgttttgacatgtgttgtatcatgaatgcagaagaaatagacaaggagcgttgatgaagtttgaatgtctcaaggcagtggtgctcaactgtagaacctgtttttgtttttttataccttgtttgatagggatcataaatttgatttgtaagctttcaaatttcactttgcacctaagcttaaaacaacaacaaaacatatgtgaagtttggatgtgctattaaagcccatatttacatttacttgaagagccaatcaagctatgttctttacatacttgtaaggtcagatgtaaaatggattctctctttttaacattattttattttcctaagaaaatgtagtgtacttacatattttatgcatttgaaaaatatggcaagcaggcagagctgagcaggagatgcagatttctggaagttcctactgttggaggaacaacactaacaggaatgtggactagcaactgtatggagaacagctgaccacaccagaatctctttgttcctaggggtaaactatactgatctatgagccctggtaacgtttggatttctgtctccagatgttcatcctgtaaatcacactcacattgagtgattcaggtgtaatgaatatccaaaatctcagcacagagaagctgagtgaggcagggggatcagcctggagtacagagtgagaatctgcctcacaaaattagcagactcaaaacccccaaataaaatcaaatactaaacgaaatgcaatgcttttcacttgatgttgctgctctatgccaaccctaccatgctcaacattccacctgtgaattctgctacgttctgtgaagctcagtcaaacaccaagccaatccaaactacagaaggccacattaggcagttttcacccaaatgcaacttgacatgatcactatttttaaaaggaatgaaagcataagtaagaacagaagcttgatgtcgtatgtattctgcctattacggcttactgattacttttggctttcttgtaatttatttttattattgtcttttcaacagaccatcagaaactggaaagggaagctagaatctgccgtctcttgaagcaccccaatattggtgaggaaatattttcagatatcttaaataatatatcttacgtgttctgtatggaactacagtaaaaatgttcatttcagtaactagtatatttacaattgataacaaatagatcctagtctcttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttcccctttctttctttctttctttctttctttctttctttctttctttctttctttctttctttctttctttctttctttctttctttttctgtttagatatgatatcactgcatgatctggaattcactatgtagaccggctgggctggaatccatctcctcttgcccctcagttgtaggcttaaaggcactaccaccaaagattcaagtcttgagaacttacagcagttaaaagtgtcttgttttattttatttttctctaaagggaaacattttaaatggacccacactgatactttatgaaacaacaaattatttcagtgctttttaaaaatcatgtcttttttttttactgtaaaataatatgtgtacttaagaatgattttggaaaaaatatgatggttaattaagaaaccagtggaaatagtctgtaatttttgttttatgtttcagactttttataaagaatcttaggcatggctaactttgaccattcccctgtgtgcattttttaatcactttatctattttgtgagaattgtcccattcaggacagtgactggaggctagtgagtgagcttgtgctagcagtgacctaggctgtcacaaagatgaagcagtagtcaggagagatgatgcatttgagtgtgtaaacaataatgtcagaacgattgcttctctgcttgtaattgatgtagggtaattgggtatgtggagatcgatcatgtcctgttaaaacaaacaaaacaaaaaaaaagaagttagatgctagttagagaggaagacagattctactcagaactagtgcattatgggaaagaagtgagatgcctagctctcacattctaacacgtagcatgactgacaggctcctgtagccacagactgtcctacgaaggccatgtgcaggggtccagggcagggccttttgtaaaacaactttctagggttagatcaagagaatgtgcttgtgactgtgttaaaatggcctgatttgtataatatgaccttggaagtcatgcttaaattgtcgtgcaaacaaacgtgggctattcatgagcacacccaggaagagagcagtggaggctgtgtcctccatcttcctggtctttgaaaagtacctttcctcaaattctcacaagacaatattaccatttttgttttttctttatctttttgctattgtagcagatcacttcatccaacttgtaaatcccgttttccgttcttctctgccggttctggtctttcagaattctcaggttctgcaggggagcggtgcattgagacacagtaactatcacaccgaagtgttactgtcattactcaaccaacgaataaataaccatcactgtagtatttctaaccttgagctctttgaatgaaagtgacacagagaaggcaggcagggttgagtaaatcctgattggtctgtaagaaaacgaataaaaatgatgaaaccccaaagagccttcttttttccccccagatgataaaagttcaacatcccaaaatgtaaaacttcacagtttttccacatgacttctttctttactattgattattctaattagtcacaacatttcatttacacagaggaaataatttttacttcttagctactttctctagcaccttcattcagggaaaaaagtcacatattatttagtataaaaagcaaagcattcttgttctatgcttaacttttatttgattaaatctcacctttttatcttgattatttggtgtgaaggctaaattgtttcctataatatattactgtctaaataattgatcatcttattccaacaaatgtgaaaaacagaccctttcctcctcacaaagaaatgttttccaaacttgtttgtatgtgctcccttgctttgcccagccccaaccttcccatctccttccctccctccttctcctcctccccttgctccttccttcatttctccctccattagtttcttctatcctcctttcttctctcctccctctgtccctcccttcctttcttccttgtctacacagcattacaccagcgttatgcctttttatagtacttgactgaaagtgaaattcatcattatttttatgcagcccatttagtgacaaaggcaatctgaatttaaatgttatatattcaatagcagtctaagatcttttaaattggtaatctattcatctgaatgggaagttacttgttttttcatagatgaagattttttcttttgtatttttgtaaaaagccaggctcattgagttacatagaagtggttggagttagccaggcatgatagcacgtagccttaaccccagcactcaggaggctgacaaaggatgattgtgcatttgagggcagcctaggctacaaaacaagacatatcaccactaccccccctcctcctacaaaacaaaaacaaaacacataaaacaaaaagcaaaaacagagatggttgacttgtttgtgaagttatagagaaaaaatgtcctacattacacagcagcagtgtggtttagactcaatgggtagcgacttccatcaacactcagcatttactgagctgtttctccttgttctcctcactctgatgtgcttctgccctgccatgtttttattacatggcaagctggaatcccctcacaaattgccagaaacctgtggtagtctctcagcctgatgtgtgccaccgtggccagctgatcctagagtgttgagataatttctgaaaatgtattctagcatatgactataccgtttggttttgtacattttgctagttgtcctttattatggaagaaaagttgctgtactgggaaaagtagctgtatacatttattgctaataagtttaagtgtggggttttattttcttagaaatgctctataggtaaactgttttgcctttgaattttattcatagtgcattgtgtaacaaaatcaaattcaggttgaattaacttaccatgaacttatgactctcaataatttatatagttacatttagcacttagcttaaagactaaaggcctgtactgaaggaaatagaaatattcagaggaatgacttcagttcctcccttgaagtattctttcttgtgtttcacttaagcagtaatttaaattatttctaatgagtagacaaaaaaaaagtgtttggaaagagtttgcttatataaataacatttaagagcttttataattcattttcccactttagatttttagaaatgagtttatccactaaatattttaaaaataataagaactgaatatagctggaaaatccgggaagatggaaggtttgggagcgtattattttgaagtgtttgtctttcatctatgattctgaggaaccaatggtccgtttgttgttttcacagttatctaaaagaatcttacattctataaatattgcttcgtaagcatattcataattattatctttgcagcatcagtgttttgcttatttacatgcacttgtgttggacatttattaaaaaaaccctacaacccaacttttatcttacttatttttatatgcctttaactttgtgaaacaacattgtgttttgattagctctgaagatgttttttaaatacttctaaaaaatacaatttaccctgctcgttattttgtttatagtttatcagataccattagatgagttttatgtacacatttgattttggaattagagaaaattatgtttgtgtgagtcacagtacaaatgcagcaaaagatgaatgaatgaaactgtataaatagctttagaagttgtcaactgtttcggtgaatagggtaggttcggctgagtccattagttagccaagtcactatcttacagctaaagtactaaaagaccatgaagatgaccaaggcatgttccttatccaagcagagagccaatagttaagtatgcaaccacactgcaatatagatacattgtataatgaagctggtaaccaggtgccactgaagcaggaaagacaggctgagagtcttaaacttaggaggtgtgaaagctcctatccttcctggagatagccaactggaatgactgtcttctaggccatggagatggactggaagtaatagtggaaaatttcaacctcccaagggtagggatttgatcttgaatttgtagaaactaacgaatttaataaagttttagagaggatcaatttctcagaaaaatgcattggtattaaaaggtgcaggtgtttgggatcggggaaagtggtgtagagcgagcgtttgaaacgccttgggggcttattgtagatgtggaggcgtgctgggtcctgactcccagcgtggcagctgggatgccaagggcaaaagtactacagatgctgctgtgtcttacaggtggaaccttaggagggcctgggcagtggttacactgtgacaactgggaggggtgatttccctgtggtttccaattgcggaagttagttcatctgtctaatagagctcaaaggagagaaacaacattgtgagacagtagacatttagatgagtgggcaatatgattgaatttttattactaaggactggaaaaatacccttcttagtggaccatagaaacacacacacacacacacacacacacacacatacacatagacacacacacacacacacatacacacacacacacacgcacacacacatacatacacctgtttaaacttctcatctgtgacctcttggcagaatctgtgagctttcaccttttgtactttcctcttcagactggaagtgggtggagaagggtatgattgtccctcctgggccaagactgaaagctagattctcagtagagataaggaacccacaaacagaccccttacagtgtggcttagtagagtcatcctctattccatgcctttgctaattggccatctcaaatcggctcagttgtttaaatttgtgtgcctatttgtgttttacgtctatgacgtaaaagtgcatggaaatatagagggtatgaatctttatgttctgagtccatcatttacagcagacagtgaatgtgggcgagcccactgccattataagataattaggttatagtaaggactgtagacagatgggaggactaattaacaaaagttttataaagaccagtaaccatacgtttcttagattattttcattctggatgagcttaaagtaaactttatatatgaaacagctagtctaaattttttagctaattatatttgtttttcagccttcagggactttggtccctccactctctcctttttttttctggaacattggacaaattgtggaagtaattttttagtgtaacaactgggattactctgctggcatctttggagcatgctgtggggcattcttcactgcactaagcagtgtatcacggccattagttactaggtccaaggctgtgaaacctaaacttcaaaaggcctgcaaccgtaagagcagagcagcacatagccagtcttactcacccttactcgtgcatctgaattagtggcatgttgctgtgatagaaccaagcaaagcagctaccacaggaaaagaagaaaaccaagaagatgatgccagcctcctctactgtcatatacatttacatatatatgtatatatagtatatatgtatatataatataattttaatattatattatattttaatgttatattgtaatatataaaattatataaataattttatactatatatattttatatatacctatatctatatattatatatatcaaaaatatcacttttctgagaaagcaaatgcagttatttgcttttcctttggggagattttcttaagagtgatgtgacaatgtccagtttaattttaaaagatgaccatgactgttgaaagtgtaactgctgtccccgtttgctcagaaatgtacctgtggctttcaacagcactcaacagtcagagtcctcagagaccagtgaggccaacccagtgaattgctgccctttctccttaccactcatgccctcccatcttctgatcctcctcttgtattcttctccacgctctggagagcttgggtttcgttagctggaactgagtgccacagcagggcagtacccacactcgtcctgagcatattgctcactccccgcccctcatatcactgccttgccctgcaggcctgtgcgtaaacccaccctgatggggaagaatgaaggctgtacctcctagctcatcatgaaggggtagcttgcctcctagcctagccgagcatccctaactaaatcccttgcttccattctttttctgtgttatatgtaccatgttattatatagttatttctctgttgcttttctcccagtggcatataaaccccaggaggaaggaatttgcctctgtactgatctctgaaatagcccctgttgtagagtcaccacacaggcctgtttatttttataagctcaaatttagatactcagaaaggtcacaaaaagtcctactaatacaattgagagagccacataaactttgatttgtgacatgcttgttttgtgcaatcacaagaaagccttctggttctcttctgcctatacggaatgtcacgggggcctaaggcggagccacacctaacggaagattgcagcccgtgagcaatgctttggactctctctgctttggctcatgaagaggagcgaggagcccggaacagggttagcatacctccttgtacccacccttcataagcggtccctcaacctttactggtattttccaaggtgctggctttctgggctgggcccattttgtgcttcttgctgcttcccacaatccatagagggcttgagtcctcctgtcaggagagtgaaaagtctcttttacctgatggacagctaaagctgctagctgcttcctcatcctccaggggagtgattaaatgatatctcagaaaacataaccataaattaaagttatagtttgttttttttcccctccccagactgcccttgaacttaggtctccagattgttaggattatagaccatgccgctctgctcggatgaacatttcttaaacacttagcacttaatagactgtcgtgttattcaaagcaaaaacctgctctccagatgaaatcacaaaaccagtcactgacgaaagagagttggctgcctctcactgctgttatgactggcttgccctgctgcatgtgattcctttaaaggactttgggagtctgctgggaagtgagggttgttcggttttcccaggaagcacacttaacaatagtcaaaagctttggtggctgggctttctttctagtttcactttcttaatgatcattgctcaaaagcaggcataccatttcctggaggaaggcgagagcgatggcattctagcagaattattgatagacactgaaagccaaatttaattttttatatgtcataaaacatcatccttcaggggatggagagatggctcagccgtgaagagcccttactgttcttgcagagaactgggcacacaatgacctgtaactccatttccaggagatctaacaccttcttctggctccttgggcacttacatgcatgtggaacatataaacttttgaaaccatatacacatatttataaaaagaaataaatctttagaaatattattttttattaatttcatgcaatttaaaaaaaagagagagagaaaccattgccaggctatggctctacaaacatagatggtagagtgagtttggttaatctgagcttcattgtctagaagactttcctgcgtgggttactgggttctgggctatggattgaattcttgagtctctcttgactcaggaaaacagctttgtatctcctggccacctcatgtattctgagaagctaagctgttgactccatgggtaatttgaaattctccctatgctgcaagacgagtccagtttgtacattagttctgctcccgtttctactaggtctattgtggcctgaaaggcttttcctcagttgctcaggtttatttgtcttctagtggctttgctctcagctgtgctcccagttgcccaggcactagattttctgtcccaggtttactgtagatgtctgtttccagtctctttatgtctcagttaccacctcctggtcacctgtggctttggaattttgtgtgtaaccttagctaaaccactccaggctttcctctattcttgttttcgttgtagtttgtaagacagggtctcacttctcactctgtggccctaactggcctgaaactcgctctgtggttcaggctgatttggaacttaaagggatcggttacgtctccatgtgtggggattaaatgtttatgccaccatgcccagcataattctttttttgtataagttggctatttgtttcagaggattgtggaatttatatatatatacaatatcactaaaataattttgactctacctttttctcatattttaagtttctggcctgtgcatcactaaggccaacttcgtcatcctttgaaagactcacttccatctcggcctagaaaccaagaagacgcatttacttatttatgtatcttcctgtttcttttgattgtgttgttgatgtcttgttttctttttggctctctcctttcccacctttccccaaatccctggagttccccagttgtccctctaatggaactgatttagaatagccctcattgagtgattgcctctttatataacagaaacccattatgacagcagtggacatgagccagagtgaaataccctggcataataaaagcttttgcttgtagagtagagaagaaaatatatccatcttcatctgcaaatttcttataaggcaattcctattatcctttgaacctttttttttttaaattatgaagctgactttaatcagtttaaaaactcattgcagtttaccaggatgttcagtatagttgcagagagagggagtgagaataaagagatagagaaggagagagagagacagggagagagacacagagagagagacagagagacagagaggcagacagctctgaatatgtccactcttaccaggcataaagattaccctaataaaagaaataagccaatcacatcaaggcccagaaccagatgatggtcagtggaagagaggctgctggggtcactgcagagcatgagagtctctgactcacacgcattcgctggcttaggcatcgatcgcaacagtgagctgccagaaaaggaacagttcttgctttgtgctgcagagttccctggcctaagagcctgtcaccgctccagtccctttcctactgctagtgattgatactgctgtctcagctcaggctggaaatggactgctgaggctctgggcaattcattctgtacgctggcaggctggactcctgggcatccacgcatggcttcacaaacagctctgtggatgacctggatccgtgacagctcctctgaccctgttcttttgtcctctgcccttattggactttaatgccttgtttgccgcgtatgctccaggacacaggaatcccttcctgttgaaatgtcacatattttactactaattgggacgattataaactgaggaaccacggtataactgatctttctgtaatgttttctctttttctggatgttcatagttctttgattgcttcactcctcatccttgagttgtgcagcatagagagacccccccctccatttcttcatgagaaacctgtctaaagtaatttatagttttgttgaggtgttttcatttccttgtccttaattttaaagtgtagcatatcacttttatttcatgggtatattgtagcccaagtctagtatttattttgcaaaccaaaaaatttaacaatcactgtgaaagcctcatggtttatcacagggcagatggtgtaataattttaataagtggcaataactttattgtatttattttatagcagtattctaattattagatattttgatagtattttatttttataaatatctgtttcataattacacagagtaccaaacttccagttctttattctgtttggaagaagaaagctttaagaaaaataggtagattttttttagatagtaataacctgaaacgtattgattctgaacatttcatataattatcttatatttcatataattatcttattactttccagactactctatgtctcaggaaaccaaatctccattttttaaaactcagttcactgtcagtaactgatcctgtgcctatataaatcgggactctgtgagtctcagagatgttaattaaatttggttgagcttgcttagattacagagggtggaaccaagattcaaatacgtttgtttgactccgaagttcacattttgatctgacttcctcatctgcacaaggcccccagggctctgtgtaacagcattacttttcatttgcataaaatagtgaagttgggtgccagctgtgtcaggagcatcagccctgtgagggaagcttggactgttcacaggaacctgtaaaagaagtgcccgcactaggtatgtgcgtcagctgtgaaatattttctagagtcttgactatctccaaggaccagaagaagcaacagtatcgcccctaagtcaaaactatgtcggtagctgctaccaggtgatgatcatggctacagtagacagactgctagctgagtgttggacaggactctctgattccatagggtatcaaggcctttcctgtctcgaatgtctgtcttcagctcaggcccccattgttgttgagtgaaagtactctgagtgactccgtcccctcctgggtagtaccaagtccactggagccttcttggttctagtcttcctcagcccctctagacttgaaaagtgagttacctcctggggcttttgtacaatacttgggttttcaagcttgcacctctgtctcaactttcttgtttctagtctccttcctctgtgtccaagggcatcttatgaacattctggcttttccttgctccactcttctctttgacatttacctctagacgtattccttgttgcctactagaatattcatatggaattgtatcaataccttcttcattatactatactgaaaactgtatggatttgaacccctacccaaacctgctcctggggttgtgttagcctgtgaggcttctgccttgccttagagatgtacctagactgaagactcctcagtgttctcctgttcaccttttctttttcttttttttctttttctttctttttttttgtttgttttttgtttgtttgtttgtttgtttgtttgtttgttttgagacagggtttctctatatagccctggctgtcctggaactcactctgtagaccaggctggcctcgaactcagaaatcctcctgcctctgcttcccaagtgctgggattaaaggtgtgccccaccactgtccagactgttcacctctttttccttgaggatttatataatcaaattcctctccctctaacttcctcaatagcttataaattggtctcttctccttggtacacactccatagtcctgctctgctaagcctttttttagaacttcccttggctactgagtgaagaatcttctactgcaaactcagcatcatttcccttggtaataccttttcttagagaggcccttagttcctcaagctaaattctaaaatcctaacattggaaatgataacattctaaaatggttctatatatgttctcaaaacacatacatgcaaattcagatcatgcaatttcatattttcacaacctttctcagtgttttccccacctttacttttagggtagttattactctcttttctctttccctctcaatctaggcatttgacactggttttagagcctttgaggcatgctatacccctgggataccctgggatacccagcctatggccccctttctctttcagcctcatctctgggtgtcacccccagcctttcttggcattcctaatttggtgggtggttcagagatgtgagggagcctccttttcttgtttgtccagaggtcttgcataggttggggatggctaaggtaccatgttatcttctgttcacacgtgggattgtccttgacctgaaggactttattcaaactttctctttagacacagactatcacacaagctgttcttaaaactgtggcacaagctatgttataccaatcatttgaatccctacgcatagcttcaatattcactaatcatgttatgcttgcatttttttttctcagtgtcattaagatgtctggggacagggagaaagtagattaaagtgtctccttttttaagtcactccggaagatctgccctccccaccgtctcacccataacacggctttgcatccttggaatgtctctgtatttatctaagttatttttttttccagtgaatgaagttagtacaggacaaattgggaggatattcgggtagtactctctttagagtttcctgtaggaatcaagaatcagaacaaagccttaccgggtgcttgctgagggccacagcttcttgccaagctggaggaattttttgactttttcctaaacctcactttgcaaatcctcactttgtcatgaactagccatggcgtcttacctctgattcaaagctgttttgttctttcttcttcttattattttttcgaaagtgcagctggcagaaacaagagcacattccgtatcttataagtacccaaccttccctcttggacattaccctctgtgggagtcacacctcagaaaagacaacacagagcctcctgcctggttctcattagtcacttgttcccattgtctgaacccctaactcattcctctctcacacactgtcattctctcatgacccttccacccagggcaggctgtgactattgttgatctaggcagaactttctctgtttcccatcaagatccataattctcaacatggtatgctaatcaggcatctcttttctcatctgaacttgttttttcatattgcgcttagataaatgtatataaccactgcacatagcttatggtccaagaacttggaacttgggctttatctattggggagacactggagctgcacattagaggtttggcagaagtgaatgcacagaacagttctttttcttcggacttaaacggggtgggggggggggaaggggacaggaggggacgggagggaaggggaagagaaagatctgtgctagataggggtagtacggagaggctctgtttgtggacaaggacagtgctattaatccttttgtttttgttacactaaccagtgtagacctaggtaaccagttctgagggcttgagtccttgtgtcaagatttgcgtatgtattactgcttcagaggcatcagactctggtttgcccaggaatagcaattgtgtaaaggactaggaaccaacttagagactaaaaccaagctctctactttacgattttataatttttttcttgtgaaacgggattcagatggtttcttccttggtgagggttttgttggcatcccagttcatgccacagtaaacctcaaggtgatggatttcagtctcctgaagagctgagctgtgtgctgcctgctgaagctgttgatcctgtgcccgaactgaaatgaaagaatgcatttagcttcccttagtgaggacctgtgaaaccaaacacaaatgaaaccaagggaagagagataagggtctgtgagcttatcaaactagctaatggtactttaaataactcccctgtggtcagccggtctctttctgtctctctgtctctgtctctctctgtttctctctgtctgtctgtctctctctcgagtggtcttgatatatatttattttttaaagacagggtagggccgggcgtggtggcgcatgcctttaatcccagcacttggaaggcagagacaggcggatttctgagttcaaggccagcctggtctacaaagtgagttccaggacagccaagactatacagagaaaccctgtctcgaaaaaaaaaaaaaaaaaggcagggtctctctatgtagaccaggccaacctcttaatcacaaagatccatctgcttctgcctcctaagtgctgagattaaaggtgcacacactgtcacttgatatattatcttgttgttggtgctttgtaaaataaaatattggggcatgctctattttgcatatagagctatctacagaaatgtagacagagcattgtggatttaaagctatagtcaaaagtaacctcattctttcattcacccatttcagtcttccagactctgtcttccggacaccccattacaatattgaacaagctgacaaattagcacatgacaaagccagtccttggttctattgctagaatgagctatcttctgaagaaaggggtaggagaggctttgtaagcactgaaggacaggtgacaaggagtctgacacacctggatgagggtagacacaccccagccagacaccactgtgtggaataaggtgatcagaagtcttagtaatgttaccagaaaggggacaagagctctgcactgtgtgagaggatctcaccttctttaggagatagtgtacagagtaaatatttgtttgaccctgctcatatgttgaagtgcttctcccggtatgaagatatttagagctgagacctatgggtctttggaaggtgattgaatgatgtgttggtagggtgaactattctgaaatgattaaagaacctagtaagaagagactagggtgcctttccttccatccgaggttacaagaaccaccaggagcctgctaagaaggatgcctttccttaagacttggacatccgagcttcaggcactgtgaggactaagtgcgtcctgtttcagccaccctggttcttcttctccagcagccgaaactgatttgtacagcctgaaaagctttgcatagagggaggagagaaggaagctgctctggtttcttggttgagctccccctaactgagaagggccagaatagaggctggaaaaggcctgggcaggcagctgctgtgcttagtgactagggctggagtggcagcagtggagatggctctgtcctcagatacagggtgtgttcggaaggtagagctggatatacagggatcctggacaggactttttgatggggaagtcagggagaaggtgtgggaaactggaagaatggacctgccacggattagattgtgaagggcagagaagaggcttagttcctcctcctttaatctctaaacattgtcaggtctccaggctgagatgccaaagaaactggatacaaggctgaggttcagtggagggcagagctggaaatgtgaaggcagaagttgacaacgtgcaaatagcaatgccatttaaaatatcggacaaatggtgtgttgtgagtgtgactcagtcagggcaaatggcagaggcatggcaggccgactccctgtagtcacggcgctgctccagcacacactggcagtggctgaggattctgctcttaccttggccactctcagtgtttacagatagaatacaaacttagagtctaaaccaaaaatgtgcgttcctcactaaatctgaaggtgctgacatttctccactttctgatgatacactttctgtttttaggaagagttcaaatagaatgtattatcataattttgaggccaagccccattttgacattgttggctttcaagtacatcataactttgagtcttgggccttccattttctacttggttttacggaaatgagttttgttttgttttgtttcttgcctgtctctgaaaaccaggtctgtgcaaatagtagcaactctacctcactttgttaggaggattcgaagcaccatataggcaggatttaccaaagggccttctaactgtggatagagtttcaattgttattcagcttgcattttaacaataactacgcaggttatcttaacagtgctgatgtttgatgccagagctgagagtatgttttagcagatcttgcctagtgtacatgaggtcctgagttcatgctagcagtataaaaactaaaacaaataaacaaacaaacaaacaaacaagcaagcaagcaaaaaagcaaagcctgtttcacagtatccaacatcatctatgttagatccagattccagtcgatgttgtgtccaaacagaaatgtttcggcttaaacttacacacacggtggatacttttatttactgagagaaagtcgttataaaggaaaagcatggtttgggttactctttcatcaaagtcctattgagaaatccagcacaaagtgttttctcctgccatgtgacatacctacaggtatgtgcttttatcctttgttcgtgacactttctccaagtggctgccactgcttccttctttgacatgctcctacagaacaaagattccatcttttccttctgactttctagaacacagcctatgtgctgttatgtgaggatacttacaagtaaaaattttaagtaattactaagtaaaaattataatcaagtgtgtattgtggggcaaggagaaccttggcctcccagatttctgaagatctggtaatctaaggaattcatgcttttttgttctggacagaatggagaaggcctcaggggcttgcttcccagatgagtgggactataaattctaggagattttttttccaggctgtcctttttcctctttatttccctcttaactagaaagtttcccagcccacaataagtagtcaggaccttcattgaattgatacatggaaacattgtggttctaattatacaacagtgcctatagctttttacaggaaatagattccacaccagcatctaatttctggcaaatgtgctcatgattgatttacaaatgacatcctttgaagctgtgaccgacaatattcggtttgggatcctgttacatccaacatagctcttcttgtttcctccttgttaaaattatggattttacttacaaacgtcgcagcatatcaaagggatatagaaagaactgtgtggtctccagtgttcagttcagtgagtcaatactaattgtgcatctctcacgtttctttgaaagagttctttcctaggagatgtccccgtcagtgtttatgaacactgaccttaatctgctagacgagcttgaatgaaattgtcaggaggtagaagtgaatagagctctgtgccaaacgttgttctaaaaggcatacaataaaatgcgggcaaccacaaagatcaaagacgtgaaaaaaaatttgaaaaatcaaaacctttcttttaatgaaactgtagagagctaaagaatggctatggtcaattttattttcgaactttattagtagagttgggactattctttctatttgtgcattcatcttatctttaaaagtgaatgaaaggggactggagaaatggctcttccagaagggaggggttccatcactgagccactatgatggttcacaacctttaatgcctccacttccaagggatccaatgccctcttgcatctgagggaactagagaagcttgctgtacacagacatacatgcaggcaaagcacccgtacacataaaataaaaattttacaagtgaatggagatttttctcctaaaatattttttttaattctaaaaattacatttgtatctgtgcgcttgtgggcaggcacgtgtgcatgcatgcatgcatgcacttgcacctgtgtatgcatgtatctgagcataaaggtcagaggacagctgcaggggtttgttctctcctatcatggaatctagttcaggtagtcaggtttggagataagcacctttacccaacgtcctgggtatgtatgtattatgtgtatagtatgtatgtatgtatgtatgtatgtatgtatgtatgtatgtatgttagcttgacagaagctagagtcatttgggaagagaatccccaattgacaaaaaagcttccttcaaatttcctataggcaagtcggtagggcgctcccttgattaatgaccaccgggctaggtgggccaaacccactctgagtagtactacctactcctctgggcaggtggtcctgggctttgtaagaaagtaggtgagcaagccattggagctagtctgcaagcagcatcccactgtggttcctgcctcggttcctgcctttagttccttctgtgacctcctgtgcagaaagtgtactctgaaataagccttttcctctcaagtttgttttagctggtgttttgctacagtgatggaaaacaaactaaaatagccactgagtcatctctccagcctctcaaatattttaaatttaatattcccagtcattctttcaaacttttgttatactgaatcttgaacctaataacaagtgattacacacacacacacacacacacaccatggccagcacatgttgagtgttttatggtagtcttgagcctttcttacctcaaaaactgcctgatcaggtaatttctattacgttcatctgtccaagtacaacaaagagggcagaagtactaagtactttgcctaccaggactctgcacacactcaagctagggtcacaggccaggcattttgctgacagagacacactcacttccacactcttgctttcagtgactgctgaggacatctgggattgttttgtttgtcatattagaatgacaattacagtaatggccaaatatactgtgacgttaattccccttgtaagtctaatttgatagtatttggctaactgaatgaatgtgtggtatctctggatgctggttttaactgatttacaaatgacattacttggagccatggctgctgtattggacttggtgctcaatgctgtattctgtgttgctgattttggcctctgagcatcaacagtgttttttttctttttttctttttgtttgtttgttttttattctattgcactgtttgaatcatatacttttaaaagtaagccctctaaagagagccaagtaattgtagtacccaagctgatgaggcctttaactgtaactagccaaaaacattatttagactctgattggagacaataaaaagatgatcactatgattctgcaaatgtcctccttctgtgacacaaagctccagccagaaggccagaaacaggcctaccaactacacccttaactctagatagtactgtctcaattatctaagtagacctgcatttgtaaacccatttcttttatatttttcttcaaaataccccaataaaactgaactctaaagagccttgctgtcagcgttgttgtagagtagcctgctgtcatcctggatgtgtctctcctcactcagtggtgagtatctggcttgccaactctgtttcaggattctcttgataaatgccagcaagtccatgagccacactttcacacaaccctctgtgctcagctcagctctcagatgctgtagctccaaggaaaatcaaagcagcaggtactcagaggattctcgattctggcctgggcatacttttaggacattaagcttattctcgtgtattcaggttgctagaaatgagtagacacatttcagaaggttgttatgttatagacggcctacaaaatcacaagttagcacattctcagaggtgagagaatattagccactgatggatatattggctgcactggatctggagactgtttaaaatcatcaaatggccagcactgtagcagaggtagagagtgtgtgtgtgtgtgtgtgtgtgtgtgtgtgtgtgtgtgtgtgtgtgctgggttataattatttagtaaggttcatgtcaacttttatttgtttttttgtttttgtttttgtttttttgagacagggtttctctgtggagtcctggctgttctggaactcactctgtagtccaggctggcctcgaactcagaaatccacctgcctctgcctcccaagtgctaggattaaaggcgtgcgccaccactgcctggcttaacttttatttgataagacgtgatttataaaagggaaatgtgttgtgtttatgatatgtgtacaaagtacaaatgtggtagcaattaccacgtctattatattctgagaaagctttctaaatttatcaaagtaaagcatttcacctccccatctattatcttagatagcagaaatcagtttctctgtattgggcgcatcttcaggctgaagtcctgtctaatcggactaacagttgccctccacaatctgaggcttagttcctgctggaaaaaggttttgcatagattgtccttcctttcaatgagtgacggtgcagagatggtttgagacatcagagctctaagctctccatctatatttactgatggcttttgttttgttgaagctgataaaggggtcatcaccagtttgaatggtggctgccccatgacagctctcttctcaagggttttcctggacctgtaatgctgagctggccctataatgcaaaaagatattttatgctaatttaggaaatttattagacttgttaagagttatatcaaaactttacctttaatacagtcacatggagacccagttaagctaatgtctaagctattttctctatcactatatattgttaattctaaatagaataaattaatgacaaattagaaattcacaatggataatgaatgtgtggagcttcttattgatagaatcataaaatttttgtttctcaagattgtttacaaaccttatactttgtcttcagtcttctcccagacaaaaaatagatagaactttccatggaaaataactaaacattcatgttttgctgactacaaaatgagtactttgtgtagtgattaaatcatgcgataaggaaggaagatgattaacctaggtagtgtggatgatatgtcttcattgcctggctttcggataatttagaattgactcatcatgatggtaaatcaagtctccgccattagtcaacagtgcgatgttaactgaggtgctttatagatgttgcgaggtgttcatcatttcctgcatgaaagtcttcccgagcaaagccaaatttgaacactatcaaaataaaatagcctagagaatttggttctctctctctctctctctctctctctctctctctctctctctctctctctctctctcccctctccccttgaatctgttttattttcccaaagaannnnnnnnnnnnnnnnnnnnatgttcgatgtgattatcatctaatacacttaagggttgtcatatgttttgcatattgattcagttcagcaatgctagtaccgagggccctaactttgagtaattatgtataatacaggttgtgctgaaaatcatttttaaaatgtatatgtctgtgtttattgggaaataatatgctccaaatttaaaaaaaaaacctagtctctaacgactataaatattcttccagtgtttacatgttttatttagttgtggaaatgaagacacttaggttagtggaaagccattccaactgtcaccaagagtaactgggactcagactgccagatacaagttcagaagctttgctgctcaggagacagttctaatggaatatttttccaaaatgactctggactaacatttcattttctaagattgcattatcctttaaaaagaaaaaggaaagagaaaaaagagattcacctttgccagaaagggcgtggccttcattctccttctgagatttatctttttcttcagcccagtctccatacatcatctttggagaggtgctttttccagggagccccaaatctgtcacaacttgatgaatgattaaaacatgtagactctttgtagcagggaagataagtcctctgagagaatcagagggggtgacagataccaaacttatgtcggaccccactgacgtggggcaacaatccaaaaggaaggtcgcctggaccttagagtttttctgttcatttttaatcataattttcatgttaatgttaaagttagttcatattaatattcaatatgtccttctaatattatcaaggatatatctgattctatttttatatgccctttcctgaatagaaactaatcttacagtaggttttaacttatagctcaatttgctaataaattagaatcttttcatcgtatttataattaggcatgaaatagtaactatttagacatttgaacctaaaaataaaagtttacaaagcacataggttatgtagtaattggtttgtaaaaatttaatgagtagttaatgacctatgtttaatttccttgtccacaactaagtatgtttattaattagcagtatgttgatcattgtgttcaaaagcaaataaatataaagagttaaaaacaatgatcacttttggttgaacggaaaatacagttagtccttgttgttagggaatcccaatatctgcagcggctcccacctgggacttacggatgctgtgctggtgcgtgagaggactgtgttgggcactcatggacagtcgcaggcaggagccattcaagtgcttaagcattcatgttcgtgttaacttataaatacatattctcttcactagctgtgggatgctgtgcttttgctgatatccttctgtttgaggggtctccatgcatgctgtttcaaagttcaagaaggccgttatgtgccttatggagaaaatagatatggcagctatgcttcattcatggatgatttatggtgctcttggccaggcacaatgtcagtatgtcaataatttgtatgaaatgagctgtctttatatacacagataaagcaagtctatatattgatcagtttaaaaaattatgattctaggcatgtaggatactaaccgtgtgtgtgtgtgtgtgtgtgtgtgtgtgtgtgtgtgtgtgtgttgtgtgtgtgtttaagaaaacagtagtttagtgatgctaattcagtgtccacactgactatgttgttgaagttagatactagtgggttatttctgcttagaactgagccccagtctgactttgacctcctagttcttatgtgaagaatggagagatccatctatattgtcccgaggttagagaccaagtcaggaccttcaaatgaatgctttctgattctgtatctacggcttcaccactttccgtgtaacacgggctaaaactcctaaagccctgttacttcattccctacctctagtctgtcagaaggtcccatcagctgatcttacctgcacccttacttgtagggagaggacagcgagagacctgaatgtgtactgttgacataggcacagccatgttgaagacttggagcctcagacccaaggaagaatggcaaagccatttccctagggtgcctcagagacatagtaaagccttcctcagggaccaagtgctagtattgctggtatgtgcataacatgtcctccacagccttctttccctatggatgtttacagcctgaggatttctgattctacaaagtgtggtgtatactccctgagccagctctgggccccaagccatgcctccatatttttcggctgctttgttagctttgtatagtaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaatagctgaacttcttctattgtgacaaaatggttttttgaatccagacacataagaaacaacttataaaggatcagttgtgtgagtccagacatctcaaggacacctttctccatcttgctttcagggtcaaactaagtaagtctgtgttcccaagcccaagagccttctcctaaccttcttggtgaaaactcccttgcttaactccttacgtcaaaatatgattggaaattgttacacctcgctccctctcgctttgtggtttcatcctttaactatgctgtgcagcatttcttctgggtcgtagttcagctcccaagtctgttctgcagccctgatcaatcaatgccatctgcattgacctggtgtttgagttatgttgggtttatgttggatttaagcagaccccacaacaatcaccaacagctctttactgagtttctgccccctgtcttcattatttagtctactgatttcatattaaagaagataagttcaaagaattggaagataaggctgactttgctgcagtctcctgtgtctgctccactgatcaccagacatctggcagtccaggcagctggccccttccttgttattccacctgcttggccaggagagaggactttgcttctgtcaaggacacacacaagattcctagataaggcaaggtttgatggaatgtttttgtagatagtaggatgttaataatgtttataagaacttagaagttttctcggggattcttagcttgccaatgtgataattgtaggtcagcccatggttgagtttctatttattttcatttactttacaactatagaagtttgaacttattgtataccaatataaaattaggaaatggatactaactcagaacaaacccaccaattagctgggatttgatataatttctatttttcttctttccttcccatccttttcctttctctctttctttctttctttctttctttctttctttctttctttctttctttctttctttctttctttctttcttagataagctttcattctatagccttgactgaccaagaactctttctaaatcaggctggtctcaaactcacagagatttaccagattctgcctcctgagttctgagattaacggcttgtgccaccacaaggaaccatattttgaattttaaaaactgattatgtattaggccagcaggatttttttccctacaaaatagtttacttgctaaagataaatgattttagttcatttaataagtttatctactctccttccttcattttgcctgaattgaggccacatgggcagtagacctaggaacaagggactaagacttcttccctgtggattcttgaatgactagctattgagtttcaagaaggtagctgagtagtttgtacagtcatctgagaagaaagaccctcaactgagaaaatgcctccaccagattccctatagacaagtctggggcattttcaatgattgttgttggtaggccaaattcactgtgcatggggccagccctgggcaggagttcctaaggcaaaccatggagaacaagacagggagtagtgctcttcccaggcctcagcttcaaattctgtctccaggatcctgccttcagtgtctactctgatttctttcatgatggactgtgatcaagatatataagcaaaataaactcaacagaaagcaaattggaacagtaggtttctagagttggtgaccttctggagctaaatcagtgagggtgtagcccatagatagtatgtgcaattagcatgtgccattaacatgagcactatgtttaattcttagcattaaacaattcttatctctgtccatgggagactggctaagtggaccatagtacatccctataatgtaagacagtttccaattagaacaattgaacctgcaggtctagttagagatgtatgagaggtacagttatactacctatatataacataagacttacttaactactattttaggaaagcagcaggatttaattatatttttaaaagtatagtagtatcagaaatccttgtagtctctaccagaaagaagggtagagcagaactgctaaaattacactgaccatggcatgtgcaccatagagctataatcctgaggaattgtttgctttatcactgatatttctattgtaaaataccataatacaggcttttaaaacgtggtagatattttaggcttttaggccatgggacatcttctacatcctttacattttgctttttttcccctgatttttacaattccctaaatatgaaaaaaatatcatcctcatgagttgtacaaaagtagactgctaaggctataggtcttagatatagactcctgattaaagcttaattaatgataagttatgaaactatagctaaaaccaaattcttattctagagcataattgacaaaggtcacatatcagatatcctgcatatcataaattaacattatggtctataacagtaaaaatattaaagttatgaatataattttaaaataattatgaataatgaaaataattttatggttgggagtcacctcaacataaggaatggtattaaagggtcacagcattaggaaggttgagaagcactgctccagagaatgaaatagttcttgaatgagctagccattcttcattcttctatgacagtctaagatcatgtttcttctgctccagatttttgaaaatatattatcttatatttatattttattttttattaacaaaactgcctgacaatattcactggggtggtatgagtcttgtcaaggcattcggttaagagaggaagacaatattagttaaatgaccacagaatcaaaagtatttcaaggtatccagttctataaaagacagatgtcatggcagacttcctgaagcagcagtttgtggaaaataatttctaaaggacagataggttaacctgaggtagaaggcagaaggccaggccagagacctagcagtagagtgtggcttcaggccaaaaggatacagagaacctgtctggagagggctcctgatattggagggaacttgaatgggtgagttaagacaaaagggaaaaaggcaaggctgggtgacactttagccattctcccagggaccgtcctgctttactgatgtaaaattagtcattctctttccctctcacactgtcccagtttgggtgatgaattgtagcataattgggccatgctaaggagttaattccctgccttaagtcaataggaaacaaggaagaactgtgaggcctgcgagtgaagaatacagtttgcacttcgagagaatgacagtgactttacgtgccgtgaatctgaggcagatccctgaggacactaagtggctgcttactgttatccttcagattaaacaatttactaacttttctaaatggcaggttaatttgggagcaactacaacaacattgaaaagctacaaagcacttgattgggtaggtacatgtaaagagacgtttctagttcatttagttatagcctgttacatttttagactattttctaggcaatattggtgctctagaagacaaaacaacaataacaacaacaagaaaatctcacacaattagctgcaaatctaatactctagaacacagaatcaacattatcaagacttttctactagggaccgagggagatcctcacacaaaccacaacataattctcaagtaaattttctgaatgactgagagaatgcgtcactcaagaatttgatttctaatggatgctgtacttcatcttctctttaaaaatctaagctacagccatttgtccagctccttaaacaactgagctcactgccttacggatgctgagtgaagagtcttctcaagactacaaagccaaagtattgacctacaatatttaatattttcactaatgttgtttcgttagcatcattgacaaagtatatccttaaaaataaatctgtaaatgtccttttctttgctgttgtcttgggacagtttctctattgagttcaggtacccccttccctttgagtcctggtagtaaaggcatgtgccgtcatgcccagaagcaaagcaaatctcctttaaaaaaattaaggtcataaggtcatatgagtgttttattgagaacaaatgaagaggtattcttttctggcaaataggaaccagacagaacaacaactgattagaaagagcatgtaggaagtaacaagacatagcatctttatgatgtgaatggaaaagcagagtagatatcattaggtgagtagtttgaatctgtggatactggacatgtgcacaaaggtttaaaattcatattacattcgtgagacttaggattcccccaagggtgttacagtaatcaagtcacagaaaaatcatggtcctctgatttgatgtttaaaagtgaatatactgacttaaaatgtgtatcttctacaaggaggaactaattttttaaaatttaccagccatgaaggaatctttagcaacttttttttagccactgagaaatttgccaagatttagtgactcacctctctcttttttttttcatcatttattttatttatatgagtacactgtagctttcttcagacacaccagaagaaggcatcagaccccattacagatggttgtgaaccaccatgtggttgctgggaattgaactcaggaccgctggaagagcagtcggtgctcttcaccactgagccatcactccagcccccaacctctctttaattttcaaatactgagcctgactttatgaccatagcggttacttgtcttacggcagaaagcttaacaaaagcacctttccggaggaggcttattttggcccacagtttagggcagaggttcttaacctgtgggttgtgacctcttaggggtttgaatgaccttttcacagaggtcacctaagaccatcggaaaacacagatatttatacattttgattcatgacagtagcaacattgtagaaatgaagtagcagcaaaattgattttatggtaagggagtcaccacaatgtgaggagctgtagcattaggaaggttgagaactgctgggttaggggatctcgtcctttgtggaggaagaagtcacagaggctggtgcagacttgttctctattgtgacacctgtcacatcccagtggcgaaggtgaagcagaacgcctggatccagaagaggccggttataacttgcaaggccagcctgtcctgaactggatcaggcagccccctacctgagggttccatggtctccccaaacagtggctccagctgggagccaagtgttcagacacacgagactttagggtgtgcttcacattcaaaatatactaatggtcttagacttagtccatttggggctgctatgataaaatataggagtctgggagatttctacggatcagaaagtttctagttcatatggatagctgttggggagtccacgtatcacatcacagaaaaacaaagggacagtgtaagagaatagggacatttaattccatttttaaagaatgattattaccctgtaataatcgcatggatccactctctccacccttctggccttctcatctctcattaggccccgttcccagtactgttgcattgaggctaagtttcaatccatcaaggcgacacagttatagagttctcagtgcccatgtcttctgattgtggcaacagggtctgcctttgccttaactggtctgctgtatctgcactgcttaaccagtggacgctgtcttgactgtcctctccattctactggagctgagtggacgttgtcttacaggtcactgcttttgtgaaataactgttagcacctcctccctcactccttcattgtcatccttgcaccttttcagctttgaggcacatttgctcctttattatcacactacatttctcactctgacagtttcccaccattctcctggaagcccccttctttgtttcattgcatagtagctagcttgccttctcttatctctcagacagtgttctaaccattgctggatggaacctcactctcttgtctctccatcctcattagccatacagataagcatgccttattgtgacctctcataagttttctttctctttcaataactctcgtcctctcttcagggaccaacacacttaggtaaagggccagataatcagaagattgcttcctggccctaagtccttgttacctatactataaatatttgaaatcctaacttgtaagaagtcatgtataaaatgcatgagaataaacaaaacagggttccagcaaagttttaccagaacacgtctcctcaaaagctgagtgagggctggaaggacatgagacagtaagtcctggggatatgttaggaagaaggatttttaccaaaggaggaagcaggacatttaaagatgaagtaaacgcttgtctggagttctgcagagatacctaggaaagcacacacatatactaatgtaaggagaaccagtagaaggggtagggacagtaataaagagctgtaacattttagttcatgaccatggattggggctcttctgcaaaggcagagcaggctcattaggggattctgagctgctagacaaaaatcagacttacaggttgtcaggatcctgacaaagagaaagagaggacagtatagaaaaacagaaaggatgtcagatgctcctgaaatatgtcaaagagcaggctgctaacagcatgggaggtgcagagggtttggcctagcaaaagtggaggaggaaaaagtgatggtgttgtgttacatgaatgtaaatccttgtgaatgttattatctgtgtattacgaaggattgtctttgatattggatattggtacatagggaggaggcaaaacttatacaggattcactttttttcttgacaaaatggaaaaagaattaccatcagtagaacagattttaattaatagaaagatcacaaattcttgtatgttgtatagttcaagatgtccgtgaggtaagccaacatggaaatgtttggaatgctagacattgattatagtttaatttcttggtaaatgtatgttatgcctggtgtgtgtgtgtgtgtgtgtgtgtgtgtgtgaccttgacataaggtggagtcattggagaggaaggatcctcagttgtcaaaatgcctctgagattcagctgtaaggcattttctcaattagtgatcaatggggaggaatcagtcaatggaggatggtgtcatcccagggctgctggtcctgggttcttgtaagaaagcaggctgagcaagccatgtgaagtaggccagtaagcaacactcttccatggcttctgcatcagttcctgcctccaggatcatgcctgtttgaattcctgttttgacttcagtgatgaacaagcactatggaaatgtaagccacacaagcccctttctccccaatttgctttgggccatgatgtttcattgcagcaatagatatcctaactaagacaatgtacaatgtattttttttaatttaagtagcatggactagacagaataactaaccaccatgtacctggtagatacagacaggtgaacagcatggtcaggtacatttatcaggagggtttatcataccattggcatcgctttcaggaataaatatataaataacattgatttattttttcaattatagatttagtatgtctcattcttgtatattattcagcagaataaagtaatgttttcaatgttttaatgtatgtatgtgtacattggtatgtgtgtgtgtttatatctggtggctagaggacaaccttaggtgtcttttttgtttgtttgtttgtttttcgagacagggtttctctgtatagccctggctgtcctggaactcacttttgtagaccaggctggcctcgaactcagaaattcgcctgcctctgcctcctgagtgctgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgaagaatgaacttcagaaaagaatatttgacagatgagaagatttggtctggtgatttgccaaggaatttcagttgcgaatgtcagttgcagggaaagactgagctaatgagttctccattctccgctcactgggatggttgtcagaaatgtaactcatctgctcagttagtgtggtggaggttcaggcaagatacatgttataagctttatctctagttattcactaaaaacatttcccaaatgaagtgaggtatatttttaaattgttggaatgtccagaagagaaattcttcacacttaaagggttgcattctgctatttattgatagtaactgtttgtgtttctggccatgttactgagggcaatacttagagccttatacatgcaagacaagtgtttcataaccgagatgtctctggagcacagctagctgcctttcttccttccttccttccttccttccttcctttctttctttctttctttcttccttccttcctttctttctttctttctttctttctttctttctttctttctttctttctttctttctttctttctttctttctttctttctttcttcctttctttctttctttctttctttctttcttaatattctttattggggctatcctttatagttatcataatgcaaatttttaccatatatatatgtgtgtgtatgtatgtatgtatgtatgtgtatatatatatatatgtgtgtatatatatgtgtgtgtgtatgtgtatatatgtgtgtgtatgtatgtatgtgtacacacatacatatgatatatgtgccatacatgtggtatatacagcatatatatatgtatatatatgtatgtgtatatatatatgtgtgtgtgtatgtgtatatatgtgtgtgtatgtatgtatgtgtacacacatacatatgatatatgtgccatacatgtggtatatacagcatatatatatatatatatgtatgtatgtatatatatgtatgtgtatatatatatgtgtgtgtatatatatgtgtgtgtgtatgtgtatatatgtgtgtgtatatatgtgtgtgtacacacatacatatgatatatgtgccatacatgtggtatatacagcatatatatatgtatatatgtatatatgtatatgtgtatatatgtatgtgtgtatatatgtatgtgtgtgtgtatatgtgtgtgtcttttgataatcatgtagtaggtagccactgatgacctctctctattctctctacttcctacccttttctggagttgaaattctccctagtgacaaactttttgaccacctagaagtccaagtgtctaactaagctggtttgtatctaagctatgagaagacatcactgtttcttctagttggccctgaaggctattaatgtatccttgcaattgctagtctaacttgactgttgactttgaatcaagaataaggtaagaaattgtaaataaagaaggacatattcagtaaagttgattttagactggggggctccctgcaattgtcacagcaaggaatcaaaccacacaaagagataaaaattcagtgcatataaggtttgcaagaccaaggggcctctcttcccagtgatggccaactaggccattttctgctacatatgcagctagagacatgagctctgggggtactggttagttcatattgttgttccacctgtacaggggtacgccagggccaagaagtggtagtgggtgggtaggggagtagggtgggggaggatataggggcctttggggttagcacttgaaatgtaaatgaagaaatatctaataaaaaatgcttaaaaataattcagtgcagattgactggtccacctggttcagatgtctggagagtaatgcccagggggttcattgtcaacatatttaaaacagactacaatttggggaaaggtttccaggcaacaatcagtctagttccaggtgcacaataaagcttaagatgtgactacatagacactcttttacaaagtatatgtgatcacgagggtgggatctatagccaaagtcctagaatctagtgtggccattgacctatagcatagaggtcagcaggccataaagtacatgtgacatctcccctaaggtctaggaagggaagagactgggatatctattctaggaaatctgcgtgaggtctgcttctatagcaaaaggtgggtgaggtttgcttccacagagagcaaaaagatcacctggtccttaataaaatcctctctcagctttctggatggaatgcagatatttgattttatcattcctccattgaggaaacaccctgtgtcgttagcatttctgctcctcttagtgcttctccctgagtacaaggcccttggtgctcccaacaagggcacctacaggtctcattttaagctctataagctcctccatcctttttatatacttctagaaaagttggtaaattaatgtggattgaatttctcaccaagtgtatatggaataattgaatagattacgtcaaaatgtgctcaattaatttgtagtctttgttctaaagatactgaattgcttttaaatataaatattagttaatatattaagttggaagtgtagattttttcctgtgactaaaagaaaaatatttgaaattttactaaataacttttggatgtagaaataattttaatgcttgagtaatatttattggcattttaatagcatatgatagatattttgccaaaattcagatcccttttgtaactttagaagcgtggatgctctccttctgtctgtaagggtgcgtatccaggatctcgggtgtttggacaatgagatagaaagagcctcatagtgtgttttaggctagcctgatgtacataattaggctttgtcttaaatataaataaaagaataaagaaagaaaaaaatttaggttgaagaaaaaataaatttatatgttcagatactaaatttagcacagacaatggattttatgcataaccttcaccatggcagtcgaactcccaaattataaatgcgatggtaagagaagtcaaagaagtcaatgtacagctgctcatgccttaaaccccagtgcaagaacatagtgacaatctgtgtgtgtgtgtgtgtgtgtgtgcatctgtgtgtctgtgtatctctgtgtgtgtaactacacagtgcaagaaaatagtgacaatctgtatgtgtgtgtgtgtgtgtatgcatctgtgtgtctctgtgtctctgtgtgtgtaacaacacggtgtaagaaaatagtgacaatctgtatatgtgtgtgtgtgtgtgtgtgtgtatgcatgtgtgtatgtgtgtctgtgtgtttgtgtatgtataactacatctagttatattttacaaactggaaataaaataagccatgacctttgacccatatgtcaaagaaatagattcgtatattttcaaatgtattttacttaaaacattttaaaaagtgatcacagtttgctaatttgtattgcctgtattgtagaaagatggagattaaataaaacaagatacatttgcagatataccttcaggttttttggtttttttttttttttgtacaaatgttagactttgaatttgttgttcagtgttcctgttttctgtttgaaaatctcttcaaaatgaacagctttgttagaaggcccggtagtaatgactgagctgccgttttctccagcgtgctgccatttgactgttaaaaatattcttctactagcacaattttaacaattcacaaatgaatccagtgttggcacctctcctgtggggaaggcttggcatgttgcatgacctaagttggctgggactggctctagctgtgaattataattaaccactgagaagaatataaggaggctcggacttacaagctgccatttttacatcccaggatgagaacggaatccaactctctccatccttgcaaccacaacaaagctgaaaacgtaaaatcttcctcatttataatcagaactgtgactcagagctgacaaacattgcttatgagaatgcaatacaatctgttcgctgtgaaatcctttattagtattgtggtaacattggcagcatgtcaccctgccatgcttagcttcagagagtcacactagttcatgccggttttctaggccaagcttaatatttttcactagaaattgcttgcgatgtggaaaaagaacaatttgaggacagttatgccgttcagattaaccctttctgatacatttgtctgttgttgccttgccatctgcatcccagactcagtggtaggaaatcatatccctagttatttgccatggttgtgagccgactgctccatcagatggcttttctgctcagttggaggtgagctcactcaagcggttacatttagctctgagctctgctagggatggagtgtcagggtgacctctctttctctgggttatctctccacttggcctctagtcttttagtagtctcaccacacctttcttttagcacagcgggtggttttccagaggtcagctgccatatatagagcttatgaaggctctgctcccttcgtgtgtgctaatcatttagagctaactaccagctcagaggggtgtactccgaaggacgctgaatactgaggaattcattgcagtctaccagtatgattaactgctcagctccataatgaaatataatgggggaggaggaggaggtcctgaatttgagttgtgtgggagaattataataataatattaagttatatatccattataaatcgcactggagttgtataagcaatttcataaaatcatcatgattaaccacttcgatttcataggacagagagtaagaaatgaaggcataaggaaatcgtacttagacgggaatggggacttcatattctgtcaagggtttactgaggaaaatatgtctccataagtaattctgtaagttactttggtggatttggtggagatgtgttacacatgcgcagtgtgctctatgctgttgagctccatgccatagtactgttcacttttgttgacaaaactactgaacacgggtccttactatgatggatctaccaggtaaccttggcacgccttagagctggagcttcattctccctctttccacttcctttctatcagaaaacatagctgagtcactgaacattgttacgttcctattctgaagtataaaagtaacaccttttaaaggatcatcaaatgatatacaaaaggcaaatatggtttctctctctctccctgtgtgttatgtgctttctaagtcttcaaacgtcctgtaaccgtatttaaaactgaagcgcacagtggctgtctccttttgtggaaattgttcttcactgagcgctacttttctgttcctaggtgttgtcccatttctgttcctttcaagagtatctcacactattaatgtgttgcaagacagtgaggaatttgctgatacacacaaaacgtgcatatctgcaccaacacacactatacacaagatataaatacacacacatacacacatgtatacaagaatgcatgcatacacatgccccacatatatacaaatataagcatacaaactaacacatacaaacatgtatgaaagcaatatgcatagagacagacagacatacacacagacacacaggctcagtcctcccccatacttgtcatttctcattctgttataatatctgtgtgtgtttgagggagtccccacagtatgctctttgggcctagcttggccatgtgctaaccataaatagatatttccttaaggtctctaatactatgcacattcattataaaagtccatgacatttacaatcatgagtcttgtatatagtaaataaaataattcttacaacaattttttgaattgtgcctgatataagaattaaaattatattttctcttttattccttaaacaaaataaatgttaaaataagtagaaaatattaataaaattaaaattttcatttttttcctcacatcatacaagacaatgatctgatatgtcaccttctgttaatcagctgcaattgtattgaaattacacaataacatagggcaggaaaagaaaatagtaaccctgctctgaatataaatcatcaaattcatgcagtagataaaggaagaaaattaggccatgaaaagtattttagcttcagtagcattttcttcaagtctcatatgtaaagttaccgaactttacattttaatcccactaattgtaacattgttctgatttatgaaaagtcatctgtttattcttatacttgttacttttgagtaacaccaagctatattaaaatgtcaaagagcagtgactaccaagatgtattttaacctgttttctcacatgcttttgtcattatctgtaaaagttccctcttaaaaacatgcagttatcataattgtgtgcatccctatgtgagcgtatggcagttgccgagcagctgaggtaagaaaggggcacaatctggtgtggcacacagcagccatcctgctttgtgggcctgccttgcaatcaggctcgggctaacagctgtgtgaacagaatgccatatcgttccttcagtctgaaaaggaattaactgttatttatagggaataattaatgtaacattttataagggtaaacacatttttcagtccccgagaatctgttatggaagacgaggagtactctcagctgtcactcaaagcttgcgaaccaatttatttctgactttaaaaccattctgccaactgtggaggtagatcaattctgacagaagccgaagagtcaaaagctgacccattctcatgagggtgtacatgggaccatgaggatagttccatagttctctttagaaggaaagattgcagtgaacccatgtaattctgtctttctagtttcttatttttaaaacaaaatgggcagccttgtctggcctcagtaggagaggatctgtgtagtcctgcagtgacttgagctgtcagagtggttggtacccagtgatggggaacctcccccatctcagaggtgaaggagaaaggtgatggggtgaggggctctgtgaggggagtactgcaatcaggatataaagtgaatgaataaattaattaattaatggaaaaaagagaaacagaatggaagagattaggcagggcatgaagaaaggaaagagggctgtatgcacaagttagtcccagaaaaagacaatggtgatttgtctgccatgtaagtaaggtcacttatcagctttaagccccaaacagcaaatggctgggtactctggacatgtgtggtgagaagcactgaatctggacaaatggcttgtctttgcccaccaccacatggttgttggctaaatgcattgttatcatagatttcacaatgaggctttgagctacttgtgtgacccaatcactttccagtaaggattatttacaatgtttagatcaccattaaaatagtagtggatcgtactatgaaagtatttttcctaatgtgatcagaaactagaactgttccttgaattgcacctgaaataattttcaactctgtcatccgaacattgaagatctcacctccccttgaagatatttcccaaagcaataggagaaagtagtggtggtctactcatgtacaagttgtgaatcatggaaatgtatttgaattttccaaattaataaagtttttaagtaaccatatattaagctaattaatttaaacaccaactatgcaggtatctctggtacctgatcattgaagaaaacacagttagcagccacattctgtcttctgtcgttgtactaaatagtcatgagcagaagatgtactgtcagattggccccttcattttcttctgcagggggcatataaacaagagagccaagcattcttgatattggcaaattgaataatactccacacagttaaaattgttagacaatcactttcatttctagtattttaaatttgacatataattaaactgaactttggggacagtttttctcccaaatcttgatatgactttgggtgtgcctggcacacagttcctgagtgagatgcggggattgaaagaatatggtttcttctttagaatgttggtgagaaggaggttctatagtcagaaggatggaaagggggttgatttagctgcatctcaggtttcaggtgtgatgacaaactgcagagactggaagacacccccccccacagagtccgttaccttttcatgactacagagtgaatgtatcaaggtctgagactgagttcctgggccacatcctgttgcctcctgtttaggccttgtcatcacactaatgattcaggaaacccacatttttacaaataaccatctgtaatttaagggtgagcaaaagtccctctttctcgacctccaagggatttctagagagtgacttagaaagccgcagtggtggatggagccgtattatggagagtggccattgtagaatgtggagttgcatccataatgtagactggtctctctaaatggttgtagttcgagcccacttaaatattcttctgggcataccttttccatgtggcaaccatcatcaaagaggcctgtgctacgtgtcttagttggagtttctattgctgtgatgtttacagcataaccaaaagcaaccaggagagggaaggatttattaagactttcactctcatgtcatacattccatcactgaggaaaggacaggaacttactgcaggatcctggagacaggccctgaagcagaactgtggaggagtgctgcttactggtttgctcctagtggcttcctcagtatgctttcttagagcatccagggccaactgcctaggggtgccaccccctacaaacttgcctacaggccggtcttatggtgaccttttctcaattacgattctctctccaggtatgtctaggtttgtgtctcaagttgacaaaaatcaaccagcatgctagtagaaccttatcttctcttgtgacttttgtaaaagcagtgtgtccttcaagctggttgttttctgtgaacctcttgcccttgataaaagttaaactggaggaattatcaccagcgagagatgagtggctgagagagagagagaaccttgacaagctaaacagtagattggtaaaagagtagtttacatgtgtggcttggtgtatatagtgtttttcaattcatatgattcatatatgagcttctgctagtgtcacctacaagtccattccattgggaaattggcataggtcaaaggaactggtttattattttaccggcaaattctagaagacacttttagctgcttttggtgacttaagtaaagaaggcaggctgactagacagtgctatgttggaactcaaagacaaatggaagatcagggcagggagacctttttctagactcttgcttagcttgcaagagcttagcttgtccctgttgtggtgatcagcgcactggtttatgaagacgaggactagggaaacatcaagagcagcagttctcaacctgtgggttgtgaccttgttgggagttgcatgatcctttcacaaggggttgcctaaaaccactggaaaacacagctatttacattatgatacataagagtagcaaaattacagttatgaagtagtaacaacaataattttatggttgcagataatcataacataagaagctgtataaaagtgtctcagcattaggaaggttgggaaccactggtcaacaggaatggcagggaagtatgagaattgtgtgagctttgaaactttggatgtatattatcctcaccagtaacatttctatagcatctacctggtaatatatggaaacattttcttctattttccagcattttaatgcacatactaatgtcatcacaacttataatttttttaaggtcagatagttattaattatcagaatcagagcccagaccttggcttgttccctccacccatgcctttctgtaaataatactgaaacatcacaagtttgatagaagaaccagtgtccatcctagaacagattttctacaggtgattgaataaaacaatgcaaacatccttctctcttcttccctccagtgagacttcatgacagtatatcggaggagggcttccattacttggtgtttgacttgtaagtacatgttttatgctcattcatttttgctgcacaattttgctgtattctgatttaaacatgattttactcatttcacagtcccaattaaggatcactataatattgtaaaatgatttccaagtgactttgcactctagttcttttagagagagacagcctcacagcagtgtgttgtccatgtttggaattggtttgagtgggctcctctttgtactgtttatgggaatgttttacacaagtggctgacatgagcaaagttatctattgaattttctagacacttctaaagtttatcttctataaacagaaggatcaagggaagtaaccctggcattcatggttcatttaaactaatcagaacataaattaaggttctaccaacaagactgaaggggcgttattctgtcctagaaggcatatatcagaagaatccacaagcatggctgcctagagattattaaacatacacgtacttgaaatcagtttggtactacttatttaagagattaaaaaatggctgtatcatttcataatgtttactactgagaacaagttcacagaaactttatcctaaatccaggcaaaattttatgtcccgagatattcagtgcatcatacttgtatgtgtgtttggggaaatagggaacaacttaaagagccaacattaagagagaattttataattatagtacacatatttaatgaatgtgttggtgacgatgcatttgaaagtacacatcaaaaaaattcacatgaatctaaaagtagttagcaataagtttaatgaagtcggattttagcagcgttgtgaaaccatccttcggtcttgtttctgtaacatgtgggtttgtcttaatcttaagctcttctgaaattgatggctttattttcagttatcaaactgccttccaatggaagaaaaagggaacaatgacactgttgaaagtcttttatccattgagtaaagttttctcaggaagataactgactccctcaatcttatgacacaggctagcacaaaagcccaatttattagtgttttattattatcatgataaaacagaaaacttgaccatggctaatcagccacgcatgaccatctgtcatcctgtggcccacgtgtatgccggacaacaatagccagagccctgcttgagcacagccctggagcacaggtttgccctctcgggtgcagcgtgtccttgtgcgctagtactgcctgtgcaatactttgtcatgggtgacttctccaagtacctgttcttacccatacagttcttcattccagtttcctgcttcctcctgggcctgaagcctttcttgtattgttttctttcctgaactctctgaagtcattagttgtttgacttttgagaggtgtagatacgtagactttgctgtctgtgccttctgggtattggatgacacgtcagtggggtcaaatcctctgccatgtggcttcctgtactcatccagccactcatatctatatattttatagactttcatgttccctattgaaatacagagatgatgaaactcattttctcataattcataaataaaaaaataactgatgaagaacatataaaaacagttcacagtaaaacaaaatatggcttaccgctaaatgctgtcatggaaacctttttccacttcacctaagttagttcggtagcttggacctattatttgcattgcagtgatgtttgcctgggttgtttctatgacaaatcagagtgaagagacctgaagatgagcatatagatacggagtataagagcttaaaatatgtgtaatcaggcaattcaacctctgagctcaggtgctttgaaatcactacttagtatttaatgcatgtgacttgaattaccactagttccaatcaaaatgttttgtcagtaaatgagatttataaggcagcctatatacagttcaatcaaatacccagttttagagatttgaaaaaggaatagctaaaaagtatagtttttccccacatggctggaaagaaaatgtaaccaaatataaatatgaaattatgcaattactatcaaaatcaacaaagaagaaaagaggagtgactttagaaaagtatgcaatttcagtacagttgaaaaatatggtctgaaaaccatcagtgaaatactcgtgttgggaacatttaaggtcacacagtcatttgcaggataaaataaaatcttgctttcccattgaaggaatatgtcacgtgttccttttcaccttttgatgcctgttttgacagtgcagttcttgtgcatgctttctgttaattgacaaacaccagactcagagaagtagttccaggtttgtaggtctgtttttttaatggaagatttcacattataaaaagcaaaggctggaaggagttctatggggagaaatcttcatggaccccaatcctactcatctctccctccccttgtactcactatctatcttgcaaacaaccccacaacaaggaaaaatatcttcttgtggaggctgaagtgtgtcacagtgtgtcccatagtgtatacgctttgtctacacttctttgattgcaaatattattgactcgttgtctgatatgaggcctctggcttctactctatcaatacaataaccttactaggactgctcttagatatcctgttgttgccctgcgtcatggagatcctgtagttttgaatctgtagaaatggccccttcatgctttccagttcatccatggggtagatgttggggtgggtccattcaaagcgttgttatctgggcctgggatgtatctaagctagtctgtctgttggttttcataccccctgagccagctcacttacaaccactacaaccaggtccagctttaccttgctgccagttgaatgaaatatggggcctaggttcccgagtgcttcaacaggtgaggacagaggcagctctccctcctgccataggtggaaaggtttgaggatgggagagggcactccaccccttgcccacactgctgcatgccagacaagttgtgagaccagctttctcatggtcacaccctcagggccagttcacccctacccctaacatcaaggtcagctctactgtgctacccagatcaggtgcaatgccggctctactgatctcatgaccccagtgccaggtctcctcccacaggtggaaagacaggagggaaaaggagaatattgcttcctcatccacaccactgcataggagatgagcaatagaaccagctatcccatgctaatattctctggccggctcactcataactcctgcagtgttcaggtcttgctctcccaaatactgcagctggcttggtgtgggatcaacactttcactctcatgactccaggcccagctttcccatgatgcccaggtgaggagtagggctagtctgcacagcccttggacatcaacacgcttctgggtgcagaccagaccaggaacatctgcctgatgtttggtggtagcaactccctgctgttgcagggccatgaacccaaaagtggttcccagcacaggccagaaccccaccatggacccaggtggcatgactggctactcacattaggcttaggtagccctccctacccttgagtctccagttctgcctctcttcattatgcatacatccttcagtttctctttctcttccatttctctactacttacttgctcctcattgtggcacccaggggtctccaagtgtctgggctcatctcaggagtggtctcaggaatgttatgccttgcttgggcattgtggcaccaggcaggatcatctccgctcccaggcttgcatggtcatctcaagcgagctctctgtcccagccatggtaccagtctggttgtcatcttggccttgctccctgtctaacccactctactggccccttttgatggtcttctgtctcaagatcactccctcctggggctcctcgcagctccaagtggggttcttctcgtgtccggcttgcttccaatcttgagagcctgcccctaccgctcttgtgcctgactggtgatcatctcaggctagctctctatccagggccctggcaccagacttgaggtagcaaccctaacttgagatttcgtgggtacagcttccctgacgtatctagaagacactatctagcagctggtcctttggttcttacaatctttctacccactttccaccattacacccaagactcagggaaaatggacatgataaagagacgagcaatgtttcaccaggtcacactcctcagtgtaaagctataagcaatcagttgctgctgagagaaggagaatcggttttcttcagggacaagattgctgataggttatctggttccaaatgatcatcctaaaacatctacatatgatcaatatcaaagagatttagtaggttgtatgtatgggtatatatgtatatcagacatacatacatacatatgtatgtgtagttgtaataattaaataagaggtcatgaatgtgaaaaggagtatggggatacaggagaaataggagaggaaaagagaggggtagaaataatgtaaatacaatacacatatatgaaattctcaaaaatttaaaaaccatatgacagagtgacatgtgttgggtgttatattttgctgttcttcgtttgtgacaaatgtgcatcaggagacacatatgttgcatgtacacacagatacactgtgtatgtatatattagaatacacatctgtcatggaactgtaagccatatagatacacagatagaagaacaacacttggattgaatatttgtgatttttcttaggaaagtaagtagagagaattgaatgaatttgtgagaaagtcgataatgaaaatagttttcgctctcagagatgcccacagctagcaattctgcattaccatctctctaagctccttctcttttatataacacgtaccagtgtaactcagtaagaaacgtcagatattttatttattggtgatatcagaaataaaagatctgttagtatcattgttttcagactgcataaacggacttctgaaagcaattggatgggttttaacagcacatagagcagacttaacattgtcaaaagctttcagagtatctgaaaatgggagccaccattcatccagtcagagctgtcaggaagacaacagaaggcactgacatggaggtgaatgcactcaagtgcttggaccatttcttcattcaacaaatatgcatgatctaagcatctcttgcgcaaagtgttgcacatagtggttgaaggaaaggagaacacaatgttttttaaaggtatctttgctttttacctgcaacttcagtctccttacataattctgtatttctggagctatgctgctttgccacatgaccgtcatgctgaccatatttagagcacacagagacactgggttagcagtgtcttagcccatgttgttattcagggcaagggtgggaggttcctgttaacattttttttttttactaaataagaccagataggttcggtttttatctccaatatggcccattatgcatttcatggctgatagcaaatttgctggatattgtgttctgactttctttgtcatttttctctcctcagtctttgtgaactgcagttgacatatacacaaactccacagcacaaagtcctctgtgccctgtctcttgaggagccaatatagggctctcttcccggggagttctcaaggccagtgatccctggcattcccttccaaccttcttggaatttccagctctgtttgaaacacttgttttccttgtgtagtgtcagcatttccactacagttcttttctttctgcctgtcttccttccctccttcctttctccttttttttcctttaatgcctggcctaacaattcccacattcccgacatgcctgtggttcaggttttgtgtttccttataatcatctggaaaggaagatctgtgcccggtgaaaggaactgtggcaagtaggtctgtagaaatttcagagaaagctatgagaggcggcttctgtggccggtgattagatctcattgctgtgtgcggcttttgtccctgtcatcttctccatgctgagaatggagcagggtggtttggaatcttcacctgtcccagttgcttcagctgtggggactcctcagtaattcaggttcttctgaagcagtgtctcctgtgggcagaacgttccaagctcaacagaatgctttgccctgtttcagcacgctctttcctctcctgctcagagaggcaggatgggatttctcctccagtgtcccctgtgatggcctgacacagctcttggaccttgttctggtttgtgtgtccctagtgggttcatgtgttgaaatttcatcgacattttgaagtgtgaagaaaacagaaacttaatccaggcacagagttgagggctttgggtgtcacttcacatttagatgagtttgtcagggtggaaccgtgtgatttaatgataggaggttttttaagaacagagactttccaaaagagtctcatcatgagatactttgtgtcacatctgtgctctctgaaccagagggccatcagcagatagagggctttgaacctattcaattgtgagctaaataaacatctttctaaagttactcagattctattattttgtttatagtaataaaaaataaccaaggagaaggttaaactcatcaaggaatgaggaactctaaggactatgttcccaggaagatcttaatctattaagattgtctgccatgatctttgctaattcattgcactttacagtttcttaacacactggacctgaggaggcatcgccatcaacctctgctctgctaaaccatgatgtgctatagtgccctacttgccatacagagggcacgggtttacactgtaatctcaccgtcatggcatgaatatgaagggtcatcctcagcctgtccagctctttgcctgttactgcaaagcgttggtctttaaaggctagacaacatagtagatttcacagtgttgttctacttagctaaatctatttaataatttcttcaacacttataaaattgttttgatttaaaaattaaagggagacatagttattcattagccagagataagaaatcgagaccaggagtttgaatttttgcagcatatcataggatatagaagcctggcctacgtatttttcattgcgttcttgttcttatttgccatgtaacagaaattactgactgaaatgttggcatccatagtaattacagatgtaattctacatatcttgctgtgactctgaagactgcagtactggtgtcatggaaatatatgttatttccaacgtcatttcattaaagatgaaaacttaaaaaaaaaaattaggtccttttgatttccaagccaatgactgaaactaatcatattttaaaacacatccacactggaattcgatgtcctgtttcattaaagaactttattcatttttgttaaaattttgatagcacactcttctcaaaaacttaattaaatatgagcccatgtctggctactaattcccttgtattaaataacttcagtgccactccttaatctgaagtttcgatttgcaaacaggctggagttgctatcatgggccattgacatttgggggtacagggtacagtgtccgaggaccgtctgtgatatgctgctatgtagagaatttggaaaagttacaatttcaaagatgttggactaagtttagcagacagcttcttcagtgtgggatattttctgctatgtggtcatccatttcatcttccagcctggactctgtggcaggaagcccagctcccacctgatccctgcctacttctcacttcttgagccactcaagcttggcaggttctgctcttggctcatggttagactcccccctccccccccactcctcacccatacttgctgctttagacattctccacagatagaattgctattatgatccattcattcagtggatcctgattgagtgctaattgcacgggaagcattttgctagatactagagataaaacaggtgaataagacacagcccctgcctaagaggcgtttgctgctaaccagaagagactagaggtcgtgtgagcctcatgcaagatgaaggcagaggcagcacctggtggcacggatgctaacataggcagcatgtggaaaggtccgaacaagactggaagattctggaaatggtttgctcatggtggataaaccctgaagtttgaaagtagatagagagggcaccagtaagtgtttgagactaaaagaaaggcaggctgcaaccagttccctatgatcatgccagattaatcacttcttgcgctaaagtttgattctgactttaaaaaaaaatgcaattcagggtaataacgcagtatatgtagaggaagaaattctaccttccagggagggtagtctgatgtaagtttctagattatggggtcaaaatattaaaggaaggcaagcagaacaggttttagtagttaaaaagtaggtgcaatgattcattggagctaaattttctttttttcttttattgaaaatatattttaatacaacattgactagttatgccccccacccaaaacacacaactttactcccatctggatttacccccattctgcctctcattagaaaaaaaaaacagactctaagggataatcataaaataaaatataataagctttaaaaaacaaagaaatcagaataggtcaaaacagacagaagggaaagagaccaagaaaaggcaaaagaaacaaagatagatgcagagacactaattcttttgttgagaactcttgaaaacattctattcttaaagtagttacagaactctgattagagaaaaaaaacattttatctctcacagagcttcgaccaactccttaatgactttgtaaccgagaacagtagcactttattcctacatattcagtgatgcttttggaattgtgtgcatgtgaataaaataacatatcacattgaaggatgaggatgacatcatgtccaggggaaacatacatggcttctcacggtcaaacttctggaaaggctctgtagagagcaccaaagcacacgaagcgttcagcgaggctttcctggacgagtgacctgacgtttcaaataagtcagaagaaatgagaaaaacttacaaagagtgcctcatatgataccgtatgtattagcagatgattggcacacgtcctgacatcacatgcattcttgtggtgtgtcatttctgttaggtgctgatatgcccagcatctgacttacagagttattctttttgagccctctagccaaaccctagacaaataatacccttcttagtttatttcattccaaagatagaaccaaactatttaaaagaagaaaagtggttcctgttggtttataaatatctgggtggtgagtgcttgacgaataatacaattttagtataagatggtattcatgtcttcagttctttcatatgcttgtgtgtccatcttcttgtccacttcctaaattaatcccagtttctgtagccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattggtctaggatgcatgttgcagtggtagaacacttgcttaatctgcacagtgtcctgaattctatccccagcacacatacacacacacacacacacacacacacacacacacacacacacacacacacacacatacacacacacacacatattcacaaacactctccattgtgttatgatcctccgttgatcattgatttttatattatgaaatatgcagtttactatatattgttaaatgagaaggtagagaatcagatcttaacaaattatatttaagaaaaaagctactgtccccaagagaacatcccatttgcatccacttttatattatttaacctggtgttttcttcatgacaaattaaaacatgtatttaaattcagatattgattcttcttgattggtaagatacttaatcatattgtctggtttcttttatatcttgcttatgtgtgtttagtaagcaagctaaatgaaatatttaattaccctgggagcctgacattagtgactacaattatttaagcaacacaagttgccactctggttgtcagacctacaaactaccaggatgtttggaacatacatgtaaatgatgcctgggatgctcttgcattgcctatgtaattgggaatcatgaaaagaagggcatttggggggttgtctctctgtctgtctgtctatttctggcacctgtttattttagaatttggaacctattcaagtcttttcagaaatgctgacccaaattagtcattttcatttcatgatcagtgggatgtattttgcctgctcttgcttgaatgaaaaagccatgactgttactatcaggtataggttcctaccctaacgttggatacttaatggctcatggtacagtcttttgctgagactcattgttagtcaggaaacccatgagaactgtaacctgaagtactgtagtgagttgaaaaagtagagtaccatagccattaaaccttcagacctctaaaagcataccctgtgttgtcctctgagagacttccccccccagctgactcagagagatgcagatgcagacacccacagccaaacagtggatggagcttggggtttcttataaaggaataggaagaaggattgcaagtggataggaacttgacaggaagaccaacagattcaggtaacctggacccttagagctctcagagtatgaccaacaacatacacaggctggacctaccacacccacacacacatatgtaggagatgtgcagctaggtcttcatgtgggtcctgaagaactggagcgggggctattccaaaagctgttgcctatgtgtgggatatgttctagctgggctgccttgtctggcctcagtgggagaggaagcacccagccctgcagagacttgatgtgctagggtatggggatacccagggggccccacccggtcagacttgtatagcagactgggggagggatcagtcagtgagttataagtgaataattaaaaaagaaagaaagaaaaaaaaaagaaaaaaaccatgtcctgtatatcagctagcctatttctgtgacaagatgcccaacggagataactaacatttaagaggaaaagggtttttcactccaagtttcataggtttctaatccttggacggttgatgctactgttgtactttacagagttcatttgtgtaacagatgggtagtaatgtggtgccacacttcagtcagaggccagttgacctcaagttgatcaggaaacacaaaacaagatggagaaaggctgggaggccagctacctctctaaaggctcaggtgcatgacccagcttccttcactaaccctcacctcttaaaacagttccctccttttttctttttctctttttaaagatttatttatttatgtgcagtgttttgcctacaagtatgcctgaacaccagaagagggtgtctgatcccatcacagatgtttgcaagccaccgtgttgttgctgggaattgaactcaggacctctggaagagcagccagtgctcttaacttctgagccatctctccagcttcttcctttttaataatatattgcaaaagagaattttaaaaactataatatacagttggcctctgataaatgcaggcccaagctatgtaaaagaattcaataatgtttgctcacatggaagtataagtgagtgctattgaacagcgcttgttgagataatgtatcatggggaatttatttagtttttgtaatagaattcctggccttaataaaagctagcatttgctgaatagttaataatgactactctttcccaaactattataattgtcgattttgttgtttataataactctataatgttggggtaattctgatctatgttggagagcttgagacagaagaagtggcttatatgcctgaggtcaccttagaagtagttagacttacttgagtttgacagacatgtgctgtgggccaccacagtgctgccatttcttttgcttttctttgtttgttttgttttgttaccaatggacattccacttcaatttcatccttatgtttggttcacatacaaatgttcaaggaagttttctgtaaccacttgatgttgttacagaccttcagtcattagtactggagaaaacttatttattgaattaggtggggaaccctaggttattcaaacaaaatccagaaaacttatttattgaattaggtggggaaccctaggttattcaaacaaaatccaactgactcaccctaatcttggggaaagaagagataaactgagcctcacaacctaggctgttgcgttaaaatatatatattctcttaagtaattgaaatattcataaatatacttgatctcaacacccaatgataggctactgaagtttagctggacccatatgctttctctgtttatcagtatagctgttcatcacatgcctcctgcaatttagcgattagagctctttttgaaaatgctttttttccatacaatatattctgatcatggtttctctttccccagctcttcaaagatccttaccacacagcagtaagtctcactccagagtctatgtgcagtgactaccaacagtcatattaaatgtgacttgtatttttccctctttgaaccaattaatgtgaccagaggaattaattgtcagcccattgatctagaagtgcgctacttaagcagggtaggccacatgggacaagagtagggggaaatggcttgcaatggagaaatggagagcagttagctcagcagaaatgaaattcaaataggtaaaagatccaaatccactacagaagatgagaggatgccagaaaacaagccaagaacaaaactaccttggaagagaagaaaatggaattgccaaaatggagaatcagaacagggaatgatgggtgctggttatcagacttgatcgaaacatcaaaccttcttttctaatatgagaaacaatatttaaaagttacctttaccaataaaaattggtaattgttactatttttcctgggtgatggtctttatgctgaagtgtattataaagccaaagcttagcatttttagttcagtcattatcataggaactcaaataattccatggatttctgctggatggattttcttctccttattgcctttaaaaatattacatttagccgggtgtgatggcgcacgcctttaatcccagcactcaggaggcagaggcatgcggatttctaagttctaggccagcctggtctacagagtgagttccaggacagccagggctacacagagaaaccctgtctcgaaaaaccaaaaaaaaaaaaattacatttatttattcatacattcatgtctgtgtgacagagtggttgggagttcgtgtgtgctggttagcggactacttggaggaactaattctctccttctatcctgtggatcccaagaaccaaacttagtgcatcagccttgaacactactgcctttactcacctaactgtcttgtgagccattcatggctttctgtgctgaagtttgaaaggactgaagatgttgtcatagtcactgttctattgctgcaaagagatgccacgaccatagcaatgcttgtaaaagaaatcattgaattagggctggcttacaattttagaggttttcttcatcatcttcatggcagggagcatggcagcatgtaacagacatagttctggagacattgagagttaaacttttaacctgcaggcagtaggaaaggaagagaaactgtaggccaggcttgagctttggaaacccagaagcccaccctccagtgacacacttcctccaacaaggccacgcctactccaacaaggccacacccctaattcctctcaagtagcaccaacaaacattcaaatgaccaaacattcaaatatatgagcctattgggagggaacattactattcaaaccaccatagatgcatacagcaatattaaaaacattatgaaattatataacatctatgaattctattaataacagggtatgttttatcatatgcaaagtctatatatgatttatatacatgcatcccataatatatatatgtttgtaaatgtaaaggttctttgtgtgtatatacaaatgaatatgcaataaggcttgagtggaacaaagagtgatgtttatggggaaaaagatcactctagaagtgcatcttcaagccttaagtaacatgtttaattataacaaaatataatctttttattattgcctatgtattactcaatttttgagtttttaaattcaaacagtgcttggtgttaatccatagataacgaacaagcaaactatttaatttattttattttgccttggaatggaaaactgtcaggtgattagtaaatgaacacaccagatttaactgggagttgttcaaaataactggtacagtctggagctgtatcattggccaaagtgaggcgatgagcaaggacagcatctgctgagtcctgcttggacaaggagagagagagtgactcacctatgagtccagcctcagcaggctctggaattagcgactgagccatcactgcttcccctaggagagaaagctcccccacccccatcccccatgttgtgtgtttctctgagatggccaaaatcctgtcaaggaacctcttgctttcctccataagccacacatagtccctttggctacaaatccttagttaaaccagaagcaaaagcaagaaagagaaactaggagactagagaggaaacattagagggggaaatcagcccagcatagaataggaaggatatgaggaggtttcccctggtgtggtctggggtaactatcagcttttgtttgattctgtttgtgtatgctaatgtggctttttctgctacagttgttattcatatggaaccagtgctgtgctgtaaagcaggaggcagagccctgaaatcaagtgtgtaggtttgacctgcccttctgccgattacttctactccaattttgagcagtctgctttgcttcttggaaccttaattttgttgattgttttgaccaaaataacaatatcacacattgtccagaagaattaaatagctctgttgatgtaaactttgccaaagaagtatttgagggagaatagcacttgataagtgttactgtagtttaaaaattctgagttctatggaaacaaacacagttttgaattgtatcgacttctttcctatcatactgtttcagagaagaaggggtgggagctgatgcaattgtgtatgatgaagcaactgggggtaagctgaaagagatcagggagtctagaggatgaaaaacaccttcctaactagtacctaataaaccacagtgctcatgactggtcttgaagtatgcatgcatttctatggatggagcaacagtgacagtcaagatttcctatcattagatgagaataagtaagctctttgcttactcaccctttcactgcttcatcagaattaggaggcttgataaaaaagcacatgcctagacagaattttctgccctgatcatcaggacccgggaagaagcccaggaacatctgtcctctgtcctctccagacctccaacttacacagtcgccctgtgtgagtcccctaactcagtctgtcatgcccatctttagtccacgtgtattagcacgtggtaggaataaaggacatgtccaggtaacataaataccaagaaacaagttagatacctgcttttgtcagtgcattttgtctgtgcccttgttttatatgcatttaacggtagtaataaaaacgaaaattgcattctttatccccaagtggtcccatttcaaaccatgagtgctttcaacagcagctaataggttgggttttcctgctggcagtgttcctagagaatgttggatccgggaaaagttatcaggagaatcctactctgtaaaggagatgagtttcctttatagatgtaaatgagtgtgatgtcacctattgtgggttttgtctcatcataatgccactacagggcatttcacagtagcattaaagaagaattcttgcttgttattccaggaaattatttattctgattttaatttctctaagggaattatttttatcaccgagagcagtatcagttatattagaatattttagattaatttcttacatgaaacctaccaaaacttgataatggaggcttttattcggatgatgattccgttctcattgctgtgcatcctgtgcgggctgcatatcagagagtacacagggaagtcacagccctgggaaattctcatcagaaaccagtggttcatccgaacgaagtgggtggagcttcaaggtgacagttcagagaaaatttagcatgcagcaatttaaaattagaagcccttgatgaaagatgagacctgttttaagccacttggtgagccccaccttttaaaggcaagattggactccagagggctgctgaacagtcacgggaggacagtctgtctcctcccattcggtgtgtgtgactgtgttaaataaagctgtgacctctgattatcacccgggcatttccactggcagagtgccatggaatagcacatatttgtcaagcagttggggctggattcagagactgtctgagcttctaacactgcctgctgtgtatactgtaaatacagtaaaagcgacattttacctgggtagcaggtaagcgaaatcgctgtgattcctgggcatcactgctctttcacacattacctgtttcatgaagtccgtgcctgttacttaaatgatcatgtgaccaggcaatggggagaagaaatatcatctagtttcttataatcacccatgtatataagattcatgctactatttaagggaaggtctttctttctttctttctttctttctttctttctttctttctttctttctctctttctctctttctctctttctctctttctttctgtctttctctctttctttctttctgtctgtctttctctctttctctctttctttctgtctttctctctttctttctctctttctttctctttctctttctctctttctttctttctttctttctttctttctttctttctttctttctttctttcttttttctttcttttgttttttgttttgttttgttttttcgagacagggtttctctgtatagccctgactgtcctggaactcactttgtagaccaggctggcctcgaactcagaaatccacctgcctcgggttcttatttctaacaattttatttctttatctagatgcttacatgtgactaaatgtggcctagtgcatatatgtggagggcaaaggacatgtatatgtggcagtcaattctttccttctaccatgttgcccagggttagagatatagaagtcagttcacggtgcttagtggcaagcacctttcctggctgagccatcttgccagcccagattttgttgttgctgttgttctttgtttaaggtaataatatactaaatatattgtactaaagtgttggcttctgtcttaaaagtgcaaggagggatatataaaatatgtgactttgaaaaaatgtttagttacaaattttctgtcttgatcacctgtaatgacagcacaacaacatattattcaaagttcacaggaatcgtcactagtctatgcatattgtgcctcaataaatgaaggtggaaagatggctgagttaaagaaaaatcagtaggagacagaagtatgtgtcttagatttaaatgcttttatttacttaatgactcataagcaaatgcccttcctgccccatgttaactcatggaaaataaatctcattcctaccccagaaggggccactctggacatcatgtgactccaaacgctggacacggattattggagcaaatggggacctgggtagcctgaatgataatcaagacaaggactaagattttatggacttaggaacagaaaaaaaaaatacatatccatgtaataatgctgaaatggaagctacagaaaagtgttatgcaaaagaagcaaaccataaggaagggagaacaaggcggtcttcaggaaagcccagcaaagccctgcattttcatgtaagaagaagggagactgtgctctggtcacttccagaattctcaggacctgagctaaacgtggatctgaattctctgagttgcccttatgaatccactcttgctacttttttatatctggcaggagttctagttttcatgtaaagaacagaaaaaagaatgtcttttacattttttcctaaatgttcatttctaaaagaatgaattaacatttgatatttttaatcaaactttataggctatgctagttacctttctgttattctgataaaatgtcgtagcttagtcagcttacagacagaaacctttatttgggcttaacacctcagaggaacaggagactgtcaaggcagggtagcttgaccacagaaaagcactggctgctagagaaacaaactaggagctcacttcttaagccaaaagcacaagcagagagctatctgaaagggtcagaagtctttaaacttttcaatgcttacctccagtgatgtacttcctctagtagggcttaaatctcccaaacagcaccatcaaccaaggagcccagtatccaaatgcccaggactattggggacatctcattcaaactgccacacaggccagtgtttctgtggttagtgtcatcccctttattcctaaattacaaggctctagcaagggaaagaataaactttcacagaggtctaagctaatttttccagctctttccacatgaagtagactctacttgtaatcatatgttaaagtaaacagttattggtcccttgtatttctgaaatacctgagcctgatagtcaatataaagatgtcaagtaatatggttgggatctatccatcagaattaaataaaaaataaaattaaaaacattagggtgtgtgtaagtaagaaggggaagggaaaagatgtggggaacatcataatgtgccagtcacagggcaccttactgaagtcagttttctctcatatcaccaaatgagttcttgggatggaactcagttcctgagacttggcagcgagcacctttacccaccgaaccatctcactggtgcgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatgtcagctaagagacacagagtgatgctgctaatgtttgtacttggcggaccctggtgacccagtgttggaggacagaactgtgtccacacccaaagagaaggagataagtagttagtaaatcaccaagcaaatccacagaaataaattttgattatataattattaagagacccgtgagattcagaaaatgacaagatagggatggatgacttaaaaggctgagtaccatggggcatcaggagcagaggtgcactacaggtgcaggcttgagagtagtctcagtaaggggcaacaggaaggccactgtaggggtccaagatgtaaaactgtgaagtaggcatgggtttgagaataaaaagcctcaaaggccaggaaagtcaatttaaggttattgcatgtcctgcaggaagccatggcaggctttaaaaaaaacaggaaagggaataatccgatttcattttacaaagctctttcttgtggcagtgtggcaaagggattacaggagcccagaatagaatgtggagaagtatcgcaaaagtcaaaacaaacaaaaatgtaaaaggatagcaatgtagacatgagaagtggagccagaaagatgaaacttaagtttttatcttacacaatataagctactttcaagtgtgtgtgtgtgtgtgtgtgtgtgtgtgtgtgtgtgtgtgtgtggtgtgtgtgtgtnnnnnnnnnnnnnnnnnnnncccaggaagtgacacagacctcaagttgagatgactctctcatctgaaagcatccttgtcttgcttaccttcattctatagtgtaatttctgagtgaaaagcatttctgattttgagacccccctaaaataaaggcagtgcacagcatcctgagtgcgcctttaaaaatctgtaattcgtttatataatggctgcaatttgagctcaatctccagtcccataatcaatgtgcttgcacttgtaaccctgtaccctctcgcatgcgcaaaacctgtttctagtcagctcataaaatgcccatcgtgtccaagtgaggactcggcacattctgaggattagagtaagacgtttgaggactcttgtcttatcattttgattctgttgtatgctcaggacatgtctgtgcccctgtgcatgtctggttcctgtggaggccagaagagagcatcagatctcctggcattttgcaagattgtgagtggccatgtggctactaggaatccagctcaggaactatggaagagcagccaggctcttcacccatgagccagcccaagcctgcctttgaagactctgtcttagctgcttctgtagatgtttcaactgacttttgttctaacagccaaatctttatcttttgacgattgagtaaagacccttttttacaaaatccaatttcaccatgtattatctagtcattttaaaattttttttaattaggtattttcttcatttacatttcaaatgttatcccaaaagtcccccaggcccttcccccccaccaccaccatttccctacccacccactcccacttcttggccctggcgttcccctgtactaaggcatataaagtttgcaagaccaaggggcctctcttcccaatgatggacagaggggtatgtaacacagtcatgttatatgtgttaaaagaataacgttgtgaatatatataaagactaacaaatcccctcttaaaggaaaatattaaaactaaaaagtgcccccatagtttcacttcccattttacctaattttgtattcacatctcacccctacacactatttaattcaaccactgcttcctgaacagctcctgcgtctcaggcagtttgttagccttagaggaaacaaatgatgagcaagacatgtccccagcctgttttggtctccaagctgagttgtggtaagaggtatataaattcatggtctcaaagtctcgaccaacataaatcaaggaagcacaaaaggctgggagcacctgagaagggaagttgccgagcagttccggacaaatccccggctcttccttaaaggacatggaatgaggtcaaggttgcttcagcactgctagcagggaactgcatagcaaagaaatacacaaggctgggcatggaggcaggtggctgagacatacattctgctgcaattccaaggcagactagtccacagaaccacaccctgtccaaagaacaaagcaaatgagccaggtcatgaagatgtagtgtgttgcagtaaccacataaaacgctatatgctcttggcaggacttacctttgagaggggagacactgatgccttgaaattgcacttgaagctcatacaggcaaatacaccttgtactagcactgacataggaatggatattcatgtaaaccttttaagtagggccatgtcacagtaaatttgccttctagcaaagataacatggtaaatggcatagatgtgggaggagaaaggcatttataaattataaaaaattcacacttacttatatgtgcagccacatacctgtactagcttgtattcaagtacatgctcttctactgtaaatatgtctttcatggctctaaatgatgctcataatcctgttagtgtgaatataatgtctcagcatcgtaattactaagtctgtttttaatggtggttgtttaccttagttctgttctttttctggtagagatgatagtttatttgtttgttttgttttgttttattttctattcagtaggatgccactttgctccaaaaataatgttctttacagaagcatcttagcttcatgagattctatttattaatcctgtttcagagattcttgagagaattattacatagtagtttagggcccttcatcctagtgccagaatctttcctgctttttttcctcaagagttactaatgttaaaatttccttatgcaaagcatgactcttgatactgggcacatggtactgtgtgaataaactttgcttgttctcactgtgcatcatgggacaataggtcagtacagacacactccagatccaaacaacgtagctgcacacacagcctagtcagtcaagtggagaattctgctaccttctctccctttgaggatttatcttcccatatctgatactaaaggtctatgggatgtcttcatcatccttgcatctgtcagcccaccatcttagattcagaaggtgatgaaaacttgaaccatcccgagctctggtttacagagcccagtagctctaccacatcctcttcctataaggatggagatggggcaagccaggactggagcacacaacacaggagccctccaacatgcatacctcaatgccatgctcacactgccctttgtcatggagctgtctgatttgaactgtagtaacttaacgtccaccctccagggattagctgctgtcagtaatgatgccaaaaatactacagtcgccatgtgagtctgaatgcatcgcccgcctcttaaaactcttcacggaaggttagatttgcttactgttgagtagtgtcaaaaccatcaattctatgctcagtggattaagaaattatagtattaagttaagaacacagtctggtttgtagaaagtttatttcctaacagggaggcttgtgcataactagcaagcattttgacacacaagaatacaacttataggcaaattcattattaaaatcggggacatttccggttactggtctgttataattataaaaactgagaggagtgtgcagtcatgtagattttagtaaggaacaattgagtataaaatgggttaattcttttgttggtgtataagaacatatgcgtgggggagggggctggcaagacagtcccatagtacagtgagtgtggaaagctgggtacagtaggtgatgtgtatgagcccagcatgggcagacagagaggaggatcatcgccatggtctggatccatccgctctagcggaagagttgaactctggcttcagcaacagacctaactgtctctgaaagaaatgtggagagtggttgaggaagacatgctgtgccaacctctggcctccatgtgcatgtacaaatgtatggcagattcaggtgagaaaatttgataatttgaagagaataagttgtttccaatcccttagagggagcataaaatttttcattgaaaaatattgtatatattttgatcattatttttccttccttcagctcctcccaggtcctgctcacctctctacctctcctgcttgataagttctcctcttcccttcctcccaacaaacaaacaagactaataacttttaaagtgataataattagaataatttaggctttggtaaatctttccattatagactggagaaatagtaactactcgggtgtctgtaaggcttgaagtaaatccttaacagtaattggcatgtggcttgctggtactcagccgattcttgatttatcactggtagccgttttaatttctaaagatgataaagctctctatgacctttaacttaaaagaagtcatgcatcattttcttagaaggagatccataactcagaaatatcgacattcagaccaaccttctcttttccaactaatttgaaatactgaagcattattacaatgcttttgtttgtttgtttgtttgaaattcattgagcctttcatagtcagtaaaagtcataaaataccagagaaaatatgattttttatgcttactaaggaggtgtgtgtggtgtgcttgcacatgcatgtgtcactgaagtgaacaaatacattttctgattgtgtgcactgtaaagggacggcagcagactcaggctgcagcagggaaaacttggagatgtgtaaacgtcaattctagcaacagtaactaaaatcactaatttgttttnnnnnnnnnnnnnnnnnnnncataaaatttttcattgaaaaatattgtatataatatatttcgatcattatttttccttccttcagctcctcccaggtcctgctctcctctctacctctcctgcttgataagttctcctcttcccttcctcccaacaaacaaacaaacaaaactaataacttttttttccattttgtattaagtatttagctcatttacatttccaatgctataccaaaagtcccccttagccacccaaccccactcccctacccacccactccccctttttggccctggcgttcccctgttctggggcatataaagtttgcgtgtccaatgggcctctctttccagtgatggccgactaggccatcttctgatacatatgtagctagagtcaagagctccggggtactggttagttcataatgttgttccacctatagggttgcagatccctttagctccttgggtactttctctagctcctccactgggagccctgtgatccatccattagctgactgtgagcatccacttctgtgtttgctaggccccggcatagtctcacaagagacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccatgggtgtttcaaacaaaactaataacttttaaagtgataataattagaataatttaggctttggtaaatctttccattatagacgggagaaatagtaactactcgggtgtctgtaaggcttgaagtaaatccttaacagtaattggcatgtggcttgctggtactcagctgattcttgatttatcactggtagccgttttaatttctaaagatgataaagctctctatgacctttaacttaaaagaagtcatgcatcattttcttagaaggagatccataactcagaaatatcgacattcagaccaaccttctcttttccaactaatttgaaatactgaagcattattacaatgctttttgtttgtttgtttgtttgaaattcattgagcctttcatagtcagtaaaagtcataaaataccagagaaaatatgattttttatgcttactaaggaggtgtgtgtggtgtgcttgcacatgcatgtgtcactgaagtgaacaaatacattttctgattgtgtgcactgtaaagggacggcagcagactcaggctgcagcagggaaaacttggagatgtgtaaacgtcaattctagcaacagtaactaaatcactaatttgtttttgactgaatcaaaagcttgggaataaaacaagtgctcctcttgattgatactgaaaaatgaaattgccccacaggcaattcttcaggaagcattgtctctgaatttctacaataaaaaaaatctgtcaatgtcttgatcgacttaagccttctttattcacataagtgaggaaccacggtgctgaaaatgaactttctatagaagctcagctacttgtccgcaccagacagattgttggtagaaagtgggaagctgatagcgtttgggagaaagtagcttctagaatactctgtagtagtagactttggagactccaattctactccttttgttcccttttacccctgttcccctagttgtttctgcacagccagctgttcctgtctgtggggccatcctggaacagcgccttctccttgaaggggactctgatcctctgaggagtaattccttgtttctcctgccttcacttagtctgtgtgaatttatcaacatgcccccaggttgttagttttgtttttctttgtttcaggttatcccttgtacagtataagtttggcagtgtactgttctagaaacctttatgcaatattcaaaatggtgggaataacaagaattcttcctaatctatagtaagtgaccaaacaagacaagagttgggggccttgctgactggtgagtgtagcagttgttcatcagctttccaagcagggagagacccaggaggttcccgggtgctcctgagtgctggttgagacacatttacttatactcatgtgcacttcctcataaagaggatgaatgtctcattttggatttccttaaggattctgatatcagaaacagacctatgctttaaattattttcctcaagaaacatttgcatttgttatttttcccaggctccctgtgtttcatatcgaatttgtaattcaattctctaagttcacctattagcatggccaaactcatatacagataccatctaggagctttgaccatatgattagaattactttacaagtaagatttaagtgtgtgtgtgtgtctgtgtgtaagagagtgtgtgtttcataattaccaaaatgctgatattagtaaagagtatattagtgactctaatatataacaatgtattatgaaaatataaagattagcaaactctaaattgtatgtatggtcaacttgggtagataaagtacaaagttgttactataaacatgaaatatataaattatctatgttacagactagtaactcatcatcttattcttcgactcctccttcttatttttgtgataagtgtttggggtgtgtgtgtgtgtgtgtgtgtgtgtgtctgtgtctgtgtgtctgtgtgtgtctgtgtgtgtgtgtgtgtctgtgtctgtgtctgtgtctgtgtgtgtgtgtgtctgtgtctgtgtctgtgtctgtgtgtctgtgtgtgtgtgtgcatctgtgtgtgtgtgtgcatctgtgtgtgtgtgtgtgtgtgtgtgtgtgtatgtgtgttcacccatgctgatatttgaagggcaaaggttgatgttgggatttttcttcaatatcttcaccttgattcttgagacaagccttctcaatggaccgagatctgggagttcactaattttactatcctgaccagcctacaagttccatccatccccctgcctccacccctcagttctggggttacacatgcatacttccagtcttacttttttttttcctgtgagtgctagggattcacactaatgtcctcatgcttgttcagtaagttctttaccaatgagcaaactccccagctccattctctcttgtactgtctctcacttttaatggaaaattattgttgtccaattcagagccgagactgtatcagactcctcagccagatcacttaccaagtcaggagtgcctccctcatttgagtgtgagatcaacttccatttcaggggctaaatatctgagaccaaagggagcttggtgctctaaatggattgtcagtgtttattgatgtgatttttaaattttacttcacaacatacatgtgtttatctatcagctactgggtcttccttcaaaatattctacatttttgtttcattaatccctgttcatgtgcccagcagaatttgtgtaagttgagctaagaggatgataatatatagttataagtcacagggaccctaaaaggtaatcaatttctgaggagatcatcaaaaatggttaacaaaaaaattgtctagaagtgatatactttgagaagagatgggctacctggttttcattgtataacagccctaaattcaattcttaagatttccatgaaggagtctatgaatggatcacaccctacatacatgtcatatacatcacagaaaagcctctcccactcttcctttttggttgtggtctcacatgagtgttggggattcatctcttgtcctcattgcttgtgtaccatgcatattatttgctgactcgactcccctaaactaacaccattgattttaaaattcagtgttcccagagaatgaacactttggatgcttccgtgagcatccttggggacatcaagaaattcttgtgtcagattagttatatcttggtgagttggggacactgggagctaaattattcacggaactctactttttaaattttatttgtaccatgaatgccatgacacatgggtggaagtcagaggacaactggtgaaagacggtcctctcctagcatgtgcgttccagtgactgaactcagagcatcagacttgacagcacgtgcctttatcaactgtgccatctcactggcctattagtggaactctaaaatggatgctgttttgtattagcactgttggtgtttctgtaccttaagaaatgggttttagttcagcctggtttaaaggacgtaatcagttgagatatagcccttcattttagaacataagttgatatccatttcctactggctgtgaatgagtagaattgatatctattctctttttaatttaggagcaagtcaaacatagcatagtaaaattagaacctcacatgaccccacagagtaagccaggatgttcatttcatatcattttctttcttttccccattaattaattaattaagacccctcccccatccctgcttctgattttactctgagaagggaagccccctgccatgggttaccagcatgcccggcatatcaaattgcagcaggactagttgcatcttctccaactgaagacagagaatgcaaccagctaaagagaagggatgatgcaaagggaggtgacagagtcagagtcagagtcggcccctcctccaactcttaggggatccacattcagtttcattttctactggaccataatgcctaagagtaaaaagaaagataaaatgaaaagaaaatctgctttaacagctagttgatgtgtaactaataggtatccttcaatattatcatatggatagttttctaaagacctagggaatccacaaagagaaatgggaatgacaaattctatttactgtcaagttgcattgtgtagttttccactccagtgtccatcctccatgctgtcctcaaacactggttatgtcttcgctcaattttgttttcttagagtaaaatacatgtgacataacatttatcatacactcactacggttcacctggcattctgtgaccttcatcatggtgcatctccaaaactcttttcatcttaacaactgaaactgcatctccattactttctactccaaacaaccaatgactgttatttattttgtctttttgattttattattacgggtacttcatgtaagtacctcatagagtatttggagatttttctttaaccttacagggctgtttcacttatcaaggtctctagggtttatatgtattataacatgtgtcagaattttctaaggttgaacaatattctttgtatgcatttaacacatttttgcttgcctcttcatttgctaatagggacttacatcattctagcattactagtgttgctatggaattaggtttatatatatttccttgagatcctactaccaatccttttgggtgtctataccaggaagtggatttgctagatcatgtggtaaatttccttttaatactctaatcactaccacatctgctttctagattggttgtatgatctttcattctcgataacaaggtacaacaatgtcgatttcttcacatcttcaatagccttgtaactagtttaattaacgaaaggcatcctaactattgtctggtggtatctcactgtggttttgatttgtatcccgtttgttttaaatgttttcactgtagcctatcacttgccttcaggaaacattcctcttttatttgtttgcgtttgtgtttgcttttggtttttacaatgttttggatggaatccaggaccttgggcacagaggccagtgctctacagtgagctatacctcagccatagaagcaagcattgatctatacctttggaaaacattgcctgagcacttaattcgacatcagtcattctgtaacgtgtcttattaaatctttcttatgatatgtagatgatagatagaaagacagacagaaagatggactgactgactgactgactgaatgaatgaatgaatgaaatggcatttaagaaactcagtcatgggagtgtaaaactggctcaatagttatgagcacttgctcctgcagatgactgttgttcaaatcccaatatccacattaaattgctcacacctgcatgtaacttcagctctagggatctgattgcctcttctggactccttggacaccttcatgcacatgcacatgtacacagaaacacacacacataatacatagtaagtaagctaaaaaaaaaaaggtcagttttattaatagaaaaattaacatatttctcttttcttttgctatattccatacatgcttaattgtggtgaagagtcacagttttcatctgtttatttggtagagtcagaaaaactttaagaaagtgaactcttggtagtaattttacacatgtttatgaaagagctggaataagaaaaaaggagttggtataggctttagaacggaaggaggatgcaaaagtgatcagaaataaatcagaatgaaatgaaagagggtggattggacatggatgttctcacctgtctgcatgcctgtgtgcgtgcctgtgctcgtgcctgtgtgcacacctgtgtgcatggctgcaagtatgccagtgtgtacagctgtaggcatgcctgtgtgcatggctgtaattgcagcacttgggaagcagtggcaggagagtccttgagtaacatcaggcaggaaggcagtactaagtatccttcccagttcacatccctgctctactcatcaacctcaagaggaatgatgcccacgagtatagcttcattctaatttcccatagtctagcccctcaccttgtagcctctttcctggactaagctagatgtttgaatacaactctaatagcctgtctcttagatcacatccactgtaattcttagtatgactcagcacactgccccatacaaagatgagttaaaaaaaagtccttaaaccattttgtcaaaagtgtattaattttgcatgtatgtatctgtgtgtggccatgtagcagaatgcaagggccctcaatggctggagacattgatttccctagagatagacttataagtgaccatgagttcactggcatgggctctgggaactgaactcagatcctctgctagagcagcaggtgctcttagctctgtctctctagccttttttatttctatcattctacatggcatctatgatgagcagcttacctggacagcctcccgttatcttttattctgagatataagagaatacttatttagtaactgagttattcagatactaaatagcttatgtacttagatgatcttagttggagaaggtattgctggagaagctagacctatgttcaattccttcccacggggcttgtctgagactcctacacctgctactgcagctggtacagtacaggctgatggacctgattctgcctctgcccagagacattacatgatatatgcggaaattccaattgcagattgagagctttgagacttggtaaatacacaaaataggccaagtttcaaagagtcactgaaaataaaaatattctgtgtttgtttatattaaaaagagatatgtgttccattcattgagaaataaaacataagcaactgattttctttccagcatcataaaacatgttttttctcatttcaatctctcatctgaaaatgtatcctgtattgaatagaatgagtaatttttgcatttatagtcagacatgacttattcactactgaactttgaaagaaaacatgaaatacttgtctggttcttgcctcttttgcttaagatgatctccatttcattcctctccatttttctttaaatcacataattctgttttttttttctttatggctgaataatacttgatcatgtatttatgcatttacgagtatgtgtgtgtttgtgtgtgtgtgtatatacatgcatccttgtgtttctttgttattcatctcttgatggacatttaggctgattccatatcttctctaatgtgagcattgtagcattaaatgcaggtgtgtcttggtgggttttttttcctttgtgtatatatccaagagtgatctagctagattatttggtatttctgtttttcacattcttaagaacttccatactgatttccatagtagctggactgatttttttaaatgacaatcattctgaccaaaatgagtagtgattttaatgtaggtgtgtatgtgtgtgtgtgtgcacacatatacaagtgcaggcctttatgcttatagaagtcaaattcagatggcttagaactcagcaaataggccagtgttgggaattggttctaatgctttgtcttatttcccaaaagccacactttcagacccaagggttcctgctgccagctgccttccactgataataaagaattgccatacagccaatagatgggcaaaaagatggggtgggacttttagattatggggacaagggaccaagggagagggatgagagggagattcgccatgactcagagggaaaaggatcagacttaagggctgcaggaaagaaagcatccaataaagagggaatgcagccctttggggcagctgcccagaatgtaaacgggcaccaaagagaaaatagagatttagaaggccttgagctgggaatacataagggaagtgtgtgctagcctcacggaggtttagatcattgagctagttaaggcatttcaaaattggtctttcattctcaaatccagagaactcttgggctgggtcagcatgcacttgacccactgggagccactttaattcattcactgctacgcatgcccgtccctcacggcctgactgtatctcccaagctctgacgatgcaaatggattcctggggtggaaatcttttccacatgcttgcacaggaaacactgtatgaactgagccactgaaatagctccacagtcctcagtgtaaccttacgtacatttccttcatggctaaaggtatttaaatgtataaaggtatataaatgtatttattggcccttgcacttcttttgagatgtccttgttgaattcatttgttcatttattgactgtgctacttgtgctttgggtgtttaatcttatatattctgcatattggttcctggtcagatgatagttttctcccatgtggtaggctgcctgttcactatggcacttgttgcctttgctgtgtggaagctttgtaatttgataacaatcccatttgtcagttcctgctattattgtgttagcttttagcctctgattctgaaagttgaaagggcttctcctactagattcaaagtttgtttcaggtataacattaggtctttttttttttttttccattttgtttgagttgattttcatgctgcttaagagaagagagctcaactttccaatctagtgaagggttctctgtgctctaatgtatggttccggtcctttcaccagcagttcgaagactgtggatacgtgggcttatatctgagcactctatctcattttgtagtatcattgaacttgggtattgtaatacatcctacatagctttatcactcagatttatagttttgtacttgagctttttttgaggttcctcatgagtggtaggattgttttatctcttgccgtgatgagttttcttgcaatcctgatggggctttcattaatctacaagtaacgttggatatcgtaactgccttcacaatgttaagtccttcaacccacaagcatgagatgtctttccatcttcaattgctttcttaagtgctttgtcgttttcaatacaaacatcttcaatctctctagctgggaagtttagagtggttctttgtagtttttgctctgtgttgattgagtcctcttttcagagagtaaggctcctatgtctgggattgttttcctgatttccttcttgtcagattcattgctggtacatggaaaaggtactgatttctgcccattgatctctatattctggaactttgagtaaatgttttctaagctcccttgaagggctagccaggcattatgtacagtgctgaatattcaaagtctccttcctttccacactctgcctcaaagattcttaggcccatgtagtcattgccttataccttacctttgaaattgagtcccttcccattttgcctcctttgctcagtggttcctcagaggtctctgggggactgttgaggtgactgggaataggtgggattaacactcaggtaactacacggacatagtagctacactggcactcagtgtggagaccagactggcattcttgccatgttggggacagacacatgaaataagctctcatcaactttagtctgagcagtgactggtctccatcccttagtctcacagtccaatggtcagaccctagtcagaagatgaaagctcattgagtggactccttagccataagtgttctctgcccagtctctcagaggatcctgtgtactttcagagacacattctttccaagttctacacaaaggaaaaccaaactaaagaaagcaagtggcctttctttaggagtttctttagaaaaagctttaatcttcattacttgggttttttttttccttttaaaagtataaacaatatcacacaattgacatttgtagagatggagtcaacaccctgtccaggtaggtgagtagcttgaacagcaaacacttacctcagatgtttctgaagacagggagtcttagatcaggggctaacctggactggctctgaccctgactcccatccagcttgcacatggttgactttttttttttaattacagcttcataggcagggaaagggagagagagaactctgtgacatcatttaaaggacctcatgcccttccacaggtccttacctctaaatgcggtcccattggatttctctgtgtgaaagagagaagatattttaatccattgcacacatggaagtagcagtgaatgtctgctttcactgttcaacagcgtggaaggcagtatgctgggtgccatgtgcacagatgaacgtgtcacattcacagctgccgcctcaaacttctgctgtagtcactagatgaaagaacacgagacacatgggacaaaacaaacccagtgaacagaaggtctgtgtgtctcgagaactcccatttgtagctttgagtttcaggtttgttgggctgagctcctgggattcaccttttagctttgcacttgacacatgaagggggcttaacttcttactagcgggaaggattctggtcctgcttaacaagattgcctcttccctgtgggtagctgggccttggtgttgctttctgctttccaacatcagcccaagactcctggctttggctctgcaacatggggagccaattctcaactccaaatctgctctttgactcactatggctgaactttaccttctggaaccccatcttgaaccatacccaccaccgccttaccttgtagtcagggctgtattattcatgaaagtttacaaatatttcactcaagatgaaattacttgtaatgatttctaggtaaactcatatgaactagaaacaaaaggataattaattctgaggaggaatacagcatgaatcaaaatcaccttaaataatacgagcagcaaatatctgtcatttttatgcacagagcatcctattttgagtagtaaattattcttttccctgtaagtcctaacatttctgagatttataaacagtaattaatgattcaaatctataattgatatgcttcagatcatagtagaacgctggcactattttattcataaatgactaattgttcaattaatctaacagtttattcatggaactgatttaatttatggcattatgaaactttgcatagcacactaaaattttttaaaaatgcaataggttaattttgtgctctattaaacaataatgcgaatatgagaacagattccctttaaggcagcaaattttgctctaacttccggtctttctttttgtagacatttgtcatgtatgttgctgttccatttagagggggaaaatattttaagtagaagaaggaatgagtgtggaaagattaattaatttctctagagtacattgtaatttcattattataggatctgaaagaaaaataggtattttcacttattgataacaaataaaaatagtgaattaaattacatgtactatggtttttagtggggaaaaacataaattcagatgattgttgtcagtataatgtttcggtgaaactagtgattagaagtagtggcacccttattgaaagcactcacaatgcagtggagagaagagggagctatttacccaagtgtttcaatgaccatgcagattccactctccaatccctagagtgtgagtgctgctattggggggaatgcagtgctatcatgatgttccagaacatgggaagctaggcaggcaacggagagaacaaaaggaagtgtataatcatggtctaagatcgcccacaagactctatgtcatcagttgatgcctttctgaagattgaaggcttgtgattggcagtgtctttagggaaaggctgtgctggcagtggctgctagctgggccgggcagagtgtaatccgttctgcaatagatgctttgtagctattggcctccactttgtcgagaataaacctgtctacctgaattgtgaagctgtgtgatataccatgtgaacagatactagttacaaaaggcaccccagaattgaaaccttctcttaaaacccaaacacagtgtaatagaggaaggagttatacataaatactaagagaaggcccatctcaccgagagtaaaagcattcatccttatatgagataccatttttcttcactagatagatattttcactcactgataacaaatgctagcagcttgccttcactgctacccacagttttaatgggtgctctttaacctacaagaattcttctagaattaacctaaaacatgcagatgtgtgtgcacacatacaaaaatataataactattagttgtattaaatggagataaatatttccaatatcaagaaattactttgatttaacataatatgaaaagcagagtttatttatcaatgttatattatcccaaattttttagaaaatatctttgaatacctttgaaaaagaaaaaaaattacatgttaataatacacacataaaactaaagagatacacagagacataacagacttcagagctacttttaacctacttagcatctatgtgcatatctctgtttataaaatgttgctaatcaatggcatatattttgtcagaccttaacatctataaaactaaaatgatgactttcttagaaaccattttatgtaggagattttgctatatatatttattaaatatggaaaatttatgatttctggatctattgatgatataaatctgagtgctaagaaactatatgtcatgtttcaaaatagttgtgttgtgtttaatttatcattgaacaccagcatgaaaaaaagaagtctgtatgaacactacaggcttactcatgcctaactcctttctctcattcttaaatgtgttcctcttgtgttgacagagtgactggtggcgaactgtttgaagacatagtggcaagagaatattacagtgaagctgatgccaggtaagtggcttgccctgagcaagatgaagactcctcatccttctcattggtgacacttattctataggcagttgtatcagtttaagtatattatgacccagtctttgagagtctcacactaccaccttggacttctctttatgataagtcatcagggaagtttctcttttttaaagatctccaggaagaattttagaaaaaaaaggaaaactatacatctgtttgaagtcgtacttttagtagatttccacttgtgctagccatgttgtgaaggcttagtagccaccatggctgttgtaccagtggggcagagcattcatctcatgacaggaagttctactgcaataccacatgtattgtcagcaaggaggtccagacatcagagggcctcagtgtccccgttccagtgttacttctagcatgcaacactttgaacatatcattataaccattgggaggcagatatgaaaagcatttactttgctatttctgagaattcacaagtaacttcccaattctgttagttagcaaaaggctcaaggaaattttacagggggctactatcttatctaattttaaatttcctagcctactcaaatatccttttggagtaaaatggtattaatctacttaccatgacctagttagacttgttggtgttaattcttctgtattctatagttttcacttacggtgaaaaatttaatgaggaacaattgactcaatgtaacataattgatgtttgaaaagtaaatcactggccatctgcccccatctctgctgctctccaggctgctcaaacctgtagccatataggatgcccagtaacactcagctgatattgaagttcctctagagtaagacatgatatgtaaaagctcaccttccgcctaagtatcgccactgcttatacacccgaccctttagagatggaggccagaaggtcaagaattccaggctatgctatagagttgaaacactgccttaaattaaaaataggaataaagaaattactttttcaaaaagtcagttctcaacttctatttttttcttggttttatggcactacattttcttggcgtaatactagtgtttatggtattctgtgcatgtgactgtacctgactacactgtaatctgtaatggacattttgttgttagaagcaaattctatttagcctgtcctccgatgaataaatccttagttttaaaatcctcacatttgtgaaaagtgtgaaaagtgacctagagcaggtttgaaacagctaattgcccatttgttatggatgggcaatagttttaatgacgatatcaatgaagatggtaagtttggggctggagagacagttgaacagttaagagcacttattgttcttgtgtaagtcccaggtttatttcccacgacccacagagtggctcacagctcatagtggctaacctgtgactccagttgccgggaattggatgccttcttctgacttctctgagcaccaagtactcatgtgtgcatacctacatgccaaaaacactcacccacataaaataaagtaaatacatctaaaaagaaaaagacatgtagaggaaatttaactattttaccttttcaagttatgataaacatattgtttgaacacttgtggttgaaatgaaccaaagatgatttttaaatggtggccggaagtttaaataacaagacaaagcccacaagttttcctaattctagaaaaattttaggatcaacatcccacatgaaatcaataataattctgttgccagatatgaccatgaagaagctgtctcctcgcaaccttttacaacttcattggctttagccctcaagaacttaggactaaaatccatcctcactaataaagaggataatagttaatttaatattaattttaaaaaatttttttgtcatagaccaagtatgttatttttagtgttagacaaaacagaaatattacaaaacagtgtggcattcacattgagataagagaaccacacagttaaaaataatgagtagtgactaaataaactatgcagtcgatgcattccagtgaggcagctttaggtggccatatcaaccaatttggagccaaaaaaatcacagttgtcatgggcatttttgatatttgtattgttaagaatgggacagtgattgcttctatgcagttcagtaatttgctgtagaatgtcatccaagtggctgataatgttatcaggtttccacttttccttgattcagaggacaccctttagtttgtacttgggtttgaactgcacagtcaatgtgtacaaagacgtgtcagtgtggtgtgttctgcgttattgtgtgtcaggtgacagcttattggggacttggggctgccaggcaaaagatttactctaatctgattagcagctgacaaaattagtaagcgtctagtaagagtagcatccttggtgccttttaacatcgcaataagtaaagggtccttctctagagtgggtgggtggaaatagagttcacagttaccagttccccagaggatcttaaacttcttcgtaagctcctctgcccctccccagagtcttcttacagtaagcagtttattttatgtcatgggtcaactttggtcccccgtctcctcttggagcttgcattcattttcttatccctgtgtcgtacaggaagcaccccttctaaatcactggtacgtgttccttcctctttttttgaaatccctgtttcacttaccacttcgtctgtgtctaccctctcgtttcaacccgtttgcttgtgacctcagatctcaaacagtttggattgtgtatgacaagcacatggaaattgggcatctctagataatctttccagaccattttgggaactaaagcatccaatttcctttcagaatatgaacctcaatttctctcacctctgcttttatctgtagaccaacaagaggaagcacagcttaaattgttttgtctgactatgtcacaaattctatgttggatgtcattttagtaaaaatcagatttagctttattcaacgttatttaaatgctggtgtaaagctaagaaaagtgtgaataaatataattttgtttgtttgttttgttttgttggaaccttcattttatttattttttaatccaatgtgattatgtgcctttaaaatgttctccctcccattctgcccttgtatctttgcagtcattgtatacaacagattctagagagtgtaaatcattgtcacctaaatggcatagttcacagggacctgaaggtcagtatatggagtccataaatctgaatcaaagaagtttctttggttttattcttctggggaaagggcagaggtcggggggggctgtatttcaaatggtgttcaaaatgcctttcccaactctatcttgaaatgaataatgaacgacaatgcatgctgccttttcagtttgctcatctacaggctacatatacatcatagcaggaagggaagaacaacatcaatacggcactccgtttccaagcagtaaattaccagaggcgattagagggcaggctttcctgaattgtccagcattggcctggaatgaacttggtctgtgatgtatgtccgcctgtagatttaaacaccacttctgttctgaggccatgggttgctgaagcaggacgactggctacacattgctcacctgagcctgacaaaccccaggcaaagggtaatgattgccagctagactgcatgcagctcaagaagtccatgattgtcaaaaattcatgacgcgtcctcacttaaatccaatggtgccttgtgtgctattgggacttttagaaccatacttgaaaaatgggaaagaattggcaaagattttatgtggataaagtgatagcataccacaactacagagataacatttgtgttcctgttcgttttctggaagaatttataaccaggaaatgagctctagaacaaaatgatattgtccacatagattctcatcatggctcttggctggtcatatcctcactgttccgaggtagtagtcactctccttgagcaatgtgtttctatgactgaaggaggtcaaccacaacacaagttgtctgctagctttgctctctaacccggtctctctgagggtatacagacagtgagtgtaagcttgggaactaacacacgccccctggtgtttgcatgcagtcattgcattcagcagatcctggaggctgtgctacactgccatcagatgggcgtagtccatcgggacctaaaggtgagtaaagctgttggagaagatgaagaaagagccacacagtttctaatgactgttcagctgcagttatgcccggaaaggcaaacactcaagcaatatgtggactcgttccatacatgaatccaagtgcttcctctaccacagcctccgttcagctcctaacatatccttgagactgataaattcctgtctttcagaaaggaatagtttgctaacgttaacaataagtaacgtgctttatttccataccccagggaatgggcatggaatttaacttcactttaagatttatgattttctgtacactttgatcatacatgatattttacatttatactatatatctaacattatataaataatcttaaaaagtattaacacagcttaggttcagtgattaagtgccattttgagccctgaactcttttccctcctattaattcttagaattctaggactgtaggcttattgattcttttatttgaatttctacaaataaaaatactgaggtctcttaaaaataaggaaggaaagagattgtatcagagcaagcatatcaatcacaggtctatattttttcagagggaccccactagcttgtaagagtttatgtgattcccattaccactgagaacaagaaaactttaggtcatttggaatgagacgggctagggaagtcttccactaattttctattccagtctgctcataactttaggcttacctttgatatttttgagaaacagtgaaatttacaatggtaaatgaaataaaaccatcaggtgcggtgagagaagctgatgtactacacagtatattgtagtttcggtcctttgtttgcaaccccagcgtgcccatcagtacagagacaatgtagtgttcagtagaaggacttggaccccacgccatctctctctctctctctctctctctctctctctctcacacacacacacacacacacacacacacactcacttctgggactgtagtaagtggcgaatctgtacttattacttattattcaatgaaaatatgcatcaaaatatgcatcaaaattattatgtgaagttatgatttttaccagaactttgaccttccccccccccagaatcttatttaatttcagttgattttgaggatttgagttgtatcaagcaaagctctggctgagggtgttcgctttgggtgagtcagcataggatatcacactttctaacgcttaccacatatacctattaggatagagaaaaactatgtgtgcctttgaaaagttctatcctggccaaccaggtcaaaaactcattagtggccatgcgagcgagcagtcagaggccctttgtgttacccactggacatcttacctgtccagtgggcttgcatggatatgcttactattcatgctgttttatcagatactcttaacacccacatggaacattttactgcattgatgtgaccatatgtgtattctgaagccagacataaaaagtgagaaacctcttcccttaattttatggcgaacgttatgggttcggaacacgggtttgctgttacgtgtatagacttagctaagcccttcaaaaactggatgttgaaagtcaaaaatgacagtggcctggaccattgcctgtaaaggaagcagttttctgacataagatactattactatacttagtaattaaaaaaaaaaatccaggcaaagttcactaccaaaggaaatggtgtgccacgtaccctggtttctcctcctatctctctgatcttcagaaaggatggagatggacttttgagagcacttactgtaatctctgtaactgccgacctagttttaccaaactgatgacttggacagactctacagagtctgcttctctgcttgtcagtagaccacttcctaatcgtactaacagactttacagtagagtttacagcttgtacaatgaaggcactgtatgtgtgtatatgtgtgttagatccctgacttctgccttcattgtgtgcctttttttttttaaccaaatgaatgcattctacacgatagtgaactgctggaagttccacatttatcaatgtactcaaatataaagaccttcatcaccaggcttcaaagcaagcttccctcgcagttcctacaccctttgtttgtatttctttattctgactcgtatgttagttcacatagaattcagataccgaatgcatgtggtttagttcatttaaatcatgtagggaaaagcataagcaggctatgttgattaccactatcaaaggtacttatggctgctgtacattttaaggcactcctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaactatatgttaaaagaataatgacacttaccatttcaaatagttggttaactgccaacctctagaatctataagatccaaaattataataagcatgcagaaccaacactaaggtacagcaggcaaactgggggaaagaaccaggagccggctccagattgagggaggagatagtcaccacccggttgttctcactggacatctgttttatgcccaacagtattttatgtatccagtagtggggccattgattgatatctagataagatcagagtgtctaacagtaatgattagattatagtgtggttgggaaagtaggaagtgtcatgacacaactgaagctatgagctgaaaagtgaagccctgggtatccctcaatagagcggctttcgtaatggcctcttttctgagtagcaaggaatagaagaatcatcatggagttaagtaaacaaatgcatgaagggtaaatgggtgaagagatagaaggatattagataggttggattgacagatagatggattattgatagatagatagatagatagatagatagatagatagatagatagatagataagagacagacagacagatgggtactttaattttagagatgtttatgactaccttatataaatttatgattggagtagaaagaaattagttttcagagttcaggaataatgcaaagcgttcagtaagtctttgtcagctgtgtgtagtagacacattacattgtgaattctaaattttgagtagttacaaaactgcttgtccttgtttcctcagaaccatctttggattagagcttaaaggacaatcatttctgcttagcacttttctagcaatcttagaaggaatgcatgtgagaacccaatacattaggggacattctgtcatttattgtatatctaggatatgtgaggctgttgagaagcagtggctgtgggcagtcacaccagttacactctgcatctttcattcaactcagaaaggtatgttcacaatatacagtaagagacaggaatgggatgcagagttctaacggatctgcctgccagtgcatgacaccagaagtgtggtttcctgattgaaaacccaagtgtatacatcacccaaaagttccctgatgtcagtacatgaaatcaggaattcagtcctagtaaacaaacaaacaaataaatggaagttaaaactgcctgcaccagtatacaaatggatcgagagaagatggcgtttgagctgttcagcttgtgcaaaattccattgagttcattcctgggaccttagctcacaccttctctggcaaaagaaaaagtgaccaaccaaaatatcccaaagcagagaatagttagcttctgtttggattactgagattttaaaattaaaaaaaaaaagaattttgaaagactttttaaatgtactgtcaagagtttcttaaagtacctactgaatagactacgtatgaaaacaaaccattttatgccatcagaacagaatgtgagcactgtcttactcagtggtctattgctgtaaagagataccatgactacagcaattctaataaaggaaagcctttaattggggctggtttacagtacagaagtgtagtccattgttgtcgtagaagggaacattgtggcattcaggcagacaagggctggacatggagctgagagttctggatcctgatctataggcagcaggaagggagagactctgggtttggaatgggctttttgaaacctcaaagcccacccctagtgacacatttcctccaataatgccacaactcttaacaggttcaaatggtgccactccctggtgactaagtattcaagtctatgaatcctatggggggctattctcattgaaaccaccacaggaacnnnnnnnnnnnnnnnnnnnnctcacactcaataggctccatgtttagtgatagcctccatcccaaaaaggggagaataatagaacaaaatactcctgtatgtatacagatgcatactcctgtatgtatacagcacacacacacacacacacacacacacacacacacacacacacacacacacacacacacttatgtgctccaaaagatggagaaattaagaaatctagcaacacgaactggactcctcttctgggacatctccctttataaactagggcttgaggttttggggggtgtttgtttgtttgtttgtttgttttctactccaacgtttccaccaggtctaaaggtgcttgcataacttgcttaagtcctttaagatattttaataatctcaaagtatttacatcattctgaaagctattgcttttagatccatatgaaacacagaaccaaccttgtacacagttgctgttcattgcagctgatatgctataaatggttgttgacacggagaccagatgtcatggaaaatcttgcaccattaagaagccatggggtggggaaggaacctgtgtatgagaatatgaggagaatctatttaaaaaccaaccttaaaaagtggttgcattgttagagggtagagatcactgcacagtctgtaggcttacactggaacattaatctgaacattccttcagttttgaacatacattccagattgaaaatgtttctgcacattgagatgacagaagaatgtaacgcccagtcaccgtgtacctatcatccctacaacgtatggtgttcttatgatacaaaaccactagatattgtcacgagatgtgattcaatagcctcatacgactattgcagagatgatggaagtcaacaggcaatgacaggatccaatcagagtgagtcaggacatggaccttgagttcacatttctttcctgaatcatcattctgcccaattccttcatcttgctgagcctgtgttcccgtgcaggacggtcccgtgctggacggtcaccctgtgcttctgatactgcctgtcacattcatcctagaaagtcaaaacaatgggatagtattaaatggcacatggaggagagccttcccaaggaggcagacatgcagtcaccagtatatgatctcttctgccttagtgtgacctggtcacaggcattcagagtttgaattactcagcaacggacatgtatagtacagtatagttttatgttgaaggttaggagtggtagatatcaaagcatatgtgccagtccccactaaatgtgtctttagaaattattagtgagccagccttctgcaccccaacagaccatgatagaaaacttactctaaccggcctttctatagagtagaaacaaactctacagaagtaaaatttatgtgatatatatttagggttttactaaagctagccacttaaagcaatcttaccacgacatattaaaaatcagattcctttcataaaattaacagctgttctaacttttcagcttccatcccatagtctttatgttagatttgcctacatgatattcccagatgcagtgatatctcaatgctattaatgttaaaacttatcctatcccttggaggtaggcctgccttctcctgtgcatagctgctgctgaacagtcttcatgggtgtcaagtgaaactcacatctcaatgaatttttttttttttttgatgactcacaggtcctagagtaaagccttcttggtcatctctagctatgaatactgccccaatcattcgaaggtcatgcataattcaactctaaggcatccctttttttttttctgaatacctaagactttgtttttatgggtcttgtgcataaagccccacccagaagcttttcagtgtaggggtaagagtaaattttcaaacattaaattttaaaagagcttactcactaatggcagtggcatttgctcaagtaacttctattctgttaggcttaaaggcactagaatgaccatggtttcttaagtgattggaactcgttctgtgaatgagtctgtggttgccaaattagattagatgcatcatagcagacattcctgatatctcagtactttggaagtgaaagttctaaaggaggagaatcaattcttgcctacagttcaatgtacttgggccaagttaccaatttatggaattatgggaaattatgtcgattaaattagaaaacagaaagcaagttgatcacaaattttagttgtgaaattaaaacttcagaagtgaacaaattaagcctgattaaagacatttagcacactgataaatacccaggatttccttttcaaacatgaagtcaaaatagaagtttcatcagcagagagcacttttccattcttgaaacatcttcctctcaaactccgagttgaatgatgtgtttggtattgaggtagttcagaaccatacttcagcctggaaaagctccgaaggtccttttacattgtcagtggtgacaatagtagtgaatctgatggcagtgagcagcagtggcctgaagagctctggtatttaattataacttgcttgctcacgctctttgtagatttcaccgaatttcttctaagtgctgcttatgggttttgctgttttgcatggctggcttaatgaatagatactgggttaggctgtgtttactcaagcccaaaacaactcacgaaactgacaaatctcacaagcagtcaatttgatgaaaactagttttcttgtttgttgacatagaaacaaaatcatttggctgataaatttttgtattctcagagaaccgtttttggcgcttgggagggccattgtttcccaactgtttgggtggagacataggctccaaattcactcttcagcaccaccaccccaaagcaggaagatttagaaccagtcttccatgtgcattctagtccaatcttattcatccagatgtctgggtgggctaggcttcactgtacataatactcagtacgctttccctaagcatctccccactcagtttcttaaactccatgaggaagtccagggagattgaaagctctgtctcaatgcttattttcaaagttctagtattggttgggaagcaatggtgtagacacagcctcattccaagactgatttatcagtccttgagtaatgatcgataccaaagaaaaatgtgtctaactcacagtattttaggtgggagaataaattatctgtgtaacattttagtcacgctttagaggaatgtaaattacatagtaaaaaaatggcttataattttttttaagctagctgtaacatttggcaaacaatatactctttcttgcctttaagaacaaacagattcttaaagacagccattttgatacacaattcagaatcagtctccaaaatttgtgcagaaattgtttggaaacattgaagaatcaaaatcactacattcgaatccaaactgctttaaaaatcaagtgggatttaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1496 - DNA, 708 bp, Mus musculus
ggtaacgaccggctgggtgttcactcggccgctgccgcccgccactccgggcgctgcgttgagctctccgtgcggcctcggtgaccgcggcaacccctcctgacacctctcccccgccccttcgggagccctcggcccggccaccgcggcgggaggaggagaggacaagggatcgcggagcgggctggtctggccacctcgccccgcgcgccccgcccctgcgcgcactccctcgccggcgagctactttcggacacggaaagtgagggcggccccgggtgacagcgcggcggcgccagtcccgggaagccaggtctgttcgcgtgtcgcccgtcgcactgtccagaccccgccatggcttcgaccaccacctgcacccggttcaccgacgagtatcagctctttgaggagctcggaaagggggcgttctcagtggtgagaagatgtatgaaaatccctactggacaagagtatgctgccaaaattatcaacaccaaaaagctttctgctagggtgagacttcatgacagtatatcggaggagggcttccattacttggtgtttgacttagtgactggtggcgaactgtttgaagacatagtggcaagagaatattacagtgaagctgatgccagtcattgcattcagcagatcctggaggctgtgctacactgccatcagatgggcgtagtccatcgggacctaaag

SEQ ID NO: 1497 - protein, 142 aa, Mus musculus
QRGGASPGKPGLFACRPSHCPDPAMASTTTCTRFTDEYQLFEELGKGAFSVVRRCMKIPTGQEYAAKIINTKKLSARVRLHDSISEEGFHYLVFDLVTGGELFEDIVAREYYSEADASHCIQQILEAVLHCHQMGVVHRDLK

SEQ ID NO: 1498 - DNA, 330973 bp, Homo sapiens
  misc_feature (1)...(330973): n = A,T,C or G
agccagatgtggaggcaggcgcctgtagtcccagctacttgggaggctgaggcaggagaatggcgtgaacccaggggacagagcttgcagtgagccaagatagtgccactgcactccagcctgggtgacacagcaagactctgtctccaaaaaaaaaagaaaaaaaaattaaaattctgggcccagtgcagtagctcagccctgcaatcccagcactttgggaggctgagctcagtaagaggattgcttgagcccaggagttcgagaccagcctaggcaacatagggagaaaaatacaaaaaataaaaacattagccaggtccgttgtggtgcacacttgtggtcccagctactcaggaggctgaggtgggtggattgcttgagtccaggtgattgaggctgcagtgagccatgattgtggcactctgcattcaggcctgggcaacagagacagagtgtgtttcaaaaaaaaaaaaaattctaaaaaaattattcttatttccacctccataggaggtaatcataattaaaaatagttttacttagagaactgaatatctatccatcatctatccatgtaaacaaccaaacacaaaactgaggttaaaatatgtaaacttttcaataactttaattttattaatatattgtgacacttttctatcacaatacttccctacagcataattcaatgcaataatagctttatatattttatggtatgactatcccagtgtttctgaacttcctatgtttacattaactccccaaaatatctttaaacaatctgttaataaagtgctgcaaataggataccgtcttgttagaatcctagtgctttagaaggaaactagaggtgagatatttatagcatttaaagtctggcctcaagtggcttaataaagtctttctcaaaggggcattgattgagaattgggcaaagttcatgatctactagtttaaaattggtggaaacagtaaagtaagtctttataactaaactgttaagcaagctacttgaccaggtgacagggtcctctctctaataacttggtctgatggaattgcctgaagcaaacagtaattcattgatttgtggttttatatttcctgagcagaatttaaaaacaaaaagaccccagtcataccaacataagtgctctacagttttatctaatttatattaacacagaagttatcaattgtcaattttaaaaaattttttactatttattttccaaatatattttaaatattcattgatttatatttttactaccaccacctaaagtctagctatcacttttccttaccttgccttttaaagtcactgctgatagggaaaattcattttccaccagatagtgataatgaactctatcatatagacatgtcacacccattcttaaatcctttcagtgtttgcacagttcttcgcctaattttaagtgccccatgagacactcttctgcccaattctatagaatcatttcccttactacactcttaccacatcagacccacttggttccttgaatttgtcctgtttcatctactagaatgcttttccctgtactttctctttaatttagttattaatattaactatttaactattataaacaaaataataggatcctttggatctcattttgctcatacattctcagaaaaacctgtgcctactccaccaagacaaataatacacattctccgtattcttcctttatattacttaattttttaatgagtaattggtttaatgcctatttgtcccactgaaaaataaaccctataaaagtggagacactattttttccacattatattctcagagcacctggtctaacacacacacacacacacacacacacacacaccaacttatagaataaatgttgcaaaattaattacaacagtcttcatatttaagctgtaggggtccttcattttgttttctattactatgttgtttgacaacccaccataattacctctaccttcaaaaacaccttttcactcttaagttgatagcactttttccttgttaaacaaaccaagcagttgtgaaaaagaggtgttgttcacatacgagttactaattgaggctcttttttttttttaaccactgataaatgaaacagaaaaacattaaaaatgggagagctttaaggataaagatgcatcacctttttcagtggtattgtcataactttcagaacctttaaaaatctgttttcctcattgaatggaaatcatgtgtgggggaagtgggggaagaaggcggggaaaataggaacaagaatgtagtgtttttttttttaattatttaactataaagatacttgttctggttggagttgggccattctacaacacagctaactctcaattaccacactcatggacacaggcacaatagacaaaaataaaatatggccttaatgcaaatcacatgttttcatttaatcgtaattttattcttaaggtttaaattacaataaatatttgtatagcgcttttgattttaaaaatttgtttccatactttgttttagataggggaggataaattacagaaacaaatagaatcctcaaaattcggttccttaaagaacaggaagtttatttctttggtcagggcaagggttccatattagcagcagctctgttgtatgaagtctttcagggccccaggctgacagtggttctgcaatcttcaatatgatacttataagattgccctaggaattgccatcccagtcgttcagagactgaagaacattagagaacattccagaacatgaaccaggtctggaagcggcatatatcacttttgctccatttctttgccaaaaaattaatctcaaaacaggaaaatctggtattctagctatgtattcagcccaaaccttgtttgtgtagtaagatggaacagaccttggtggttaggtttagccacatgtgttaagtcattaggcaaacagatttttaaaacttctttctgctttttgaaggaatgaatcaacaagtctaagccaactctaggaaacaaaaaagcaggagaataagaaataacagggcccttgactatgtaggaaatgaataagtagcacctgaataataataaattagcactggtcgaggtggctcacgcctgtaatcccagcactttgggaggctcgaggctggcgaatcacctgatgtcaggagttcaagaccagcctggccaacgtggtgaaaccccatctctactaaaaatacaaaatgtagccgagggtagtggtgggcgcctgtaatcccagctactcgggaggctgaggcagaagaatcgcttgaacctgggacttggaggttgtagtgagccaagatcgtgccattgcactccaggagagagtgagactccatctcaataataataataataataaattggctggacatctcattacgtaaatgagacagagtactataattctgtaggtttggtgataatagattaaaaatatattctaaagtctattttgattatagtttgtattagctacccgctacatagcatgtagtgaatccttggtattggcccctacatgatgaaaaaataattttcgacttttgaccaaggtaatttaaaggctaagccattggcttttaggaaaagttaacttttaaacaccaagattgttgagataaatgctaccctcctctaaagctacatgaatcaagagaagagtactgttaaaggaattgacaaagtgataaactgaacgtaatgaagagtaatgaaataatccaatgtaaatgaatatatgattttttttaaaggtctttcaggccaggcacagtagctcacgcctgtaatccgtgcactttgggaggccaaagattgcctgagctcaggagtttgagaccggcctgggcaacatggtgaaagcctgtctctactgaaatacaaaaagttggacatagtggtgcatgcctgtagttccagctactcaggagactgaggcacgagaattgcttgaatccaggaggtggaggttgcagtgagctgagatcgcaccactgcactccagcgcctaggaagcagagtgagaccccgtctccaaaaaaaaaaaaaaaaaaaaaggtctttcaaacaagtgggaaaggataaagatggacagatggactattcagttaatgcattggcaaaactagctatccatttgaggggaaaagaaaatgaaagtagatacctgcctgcctcaaaccattcaaaaattttcagacaggttaaaatactaatcatagtaagtataacaatattggaggatcatgtaaggctttttaaaccttgatagattttggtctttatttcaagatcactggaggcatacctgaaacattttagcaaaggaatgatgggatcaaatttattttcaaaagatgtttctctcagctgtgtgtaggagagggaagaaagcacaattattaatgcagttaagaggttgtttccgcaaactggttagagaagacaatagtttgatctagaatgctggtaatgagaaatgcaagataattctagaaatgtttaggagttagggtatgtgtgggtacaaggaatgagtatgaaactaagcagtgagtagtttgaaatgcctggtagggtgtactaaagactttttgaacttttttcctaaagatatatggggagctaataatgatatctatactgagaagagacatgatagatttgtttagtatgaattcctctgaatccaagtgagaaacgatggtggcctaaactaaggcatttgcagtaggaatgttatgatgtatatggacttgtgattgattgtgggatgaccctgaaatttcactgagatatggaggaggtgcagatgtagaaggaagacatattaattttagacatgttgagtcagaggtgcaatgtccaggaggaagtttcctgtagggagcgggcaatatgagtctgaagctcagaaaaagacctttgctacagacagagattgcagggtcattagcactttagtatccagctgattctgttggtgcttccactctccgttctctggaatcccagttctgtgcccatgccctagttctgtgtgcataccccacttctgcagtcttttcttgtaatagcctctacctgtgactttttcctcagtggcatactctggagccactggagctgttcaacccgccaggaaggacggccagaccctgaccccaagggagtttatgtccgtttgtttccctcttccattgctagtgatcaatgaatgactggtgaagaaataggaaagcccttgctttgagggtaacaaaactgggtataacatatactccagagctccctgaaaataaggctgatgctgggactttacttgaaggcacatgctgctttttgtttttgcattgtttttgtcccatgttctccaattctctactgacaaagagtctctccttcaccaaattttagttaggcttctctcaatcctctttcctaccctcgacgtttgaatttccatgtcaaatgtttgcatcagcccaattttattaagaatcctgctaagtttgtttatccagaatcttccagcctgccttcagtaagaatcttgttaggtaggtttagccagactatccccttacctcagaagtttccttttagtaattttccattcatctaccttcctccactcccactccttagatataaattcccacttttcctttttttttttttttgcatttgaagttcagcccaatctctttcccctactgcaaaacccccttgcagtggtaactatacctactgtgatagtctgaataaaatctgtcttactatacttcagcaagtatcattgaatgagatttttttctttaacattatccttgtccctggaaatactacctcaataaatcccttttccatacattcttgtcttagggtctacatctggagagtcaaatttaagacatatgataattaacacagtgatagctatgaaggcagcctaggaaagctgtgtaaaatgagaaaaaaaggcaacctaagatggaatcctaggttgaaagcactatcacttaccacagaggcagagaaaaaagagaccaggaatgatactgaagaaaagaggcagaaatgttgtggaatgggtgaggtattgtgaatagaaagtgtggtatcagacatgaaaaccaacagagagaatttcaggtcaagagtatgaaattatacagagaagtcaagttacttcaggattacaaagaatcaactaaatattgcaacaaaggggcctcattataccctattaaagattgggcatttttaatatttggaaagtcaagactgttaataccataatattgtttttttttttttttaaaaaaaaggtatttttgagcacctgttgtggcaaaaaccctgtgctagtgatacagtggggggactgaatgacagtccctgccaggaagggtctgacagtctaattacagtccagtgtaataagtgtttgcaaagttgaaagtcaatgaaaatcattagaggtacacagaagagtcaaaatctgttattttctttattaatgactctataaccttttatacaattattgtgtattatacatcttatttaatgtaccttcctactgcaattcttttagcagagtgtcagggaaacatgtatgttcatggagggtcaagcatgctgaccaatgtacttgcaagtaatgcaaaagagacatttcttcattgtatggatatcacttgttttcttatttatttgcacatttatttttatttttaggaaaaagattctttcagcacatgatgaaacaaagaaaatatcttctgttgttagctttgcttttatgaatagtttgttttttaactgcaaattcatcttgcactaatggatggtctggtaaacagattatctgctcatcagtagactgtctggctctatatggtttagttatcatagtttggaaaggcagcaacttgctgttacttttttcccctagcctccaaatctgcagtgaagagtggcttcaacacagcacctgctaaaattttcacaggaatctgctatttactgatggactctgcactttggggagctatagagataacattatctcttcgctgtttcttatcttataactttgtagcagaggaaatcaatgaatgttagtatctgttaatatctgcctttgttaatgtaagcattagaaacttgtactttctgggtgaaactactgaagtcttggatttttttaaattccaagttgccaaagaggaaagagggagaatacttagtcattttatatccacagccctctaccctgctccttgcttgtaaatccccacttggccttttaagagttgaaatagagtccaatctctctctcctcctgcaagacctggttgcagtggttctgatcaccatggacccccttgaataaagcctgccttattatcttcaacaactttaatgactaactttttattcactaactctccctcttaactttctctaccatgttcatcagacatgcagttagtaaggcatgtataatgaaatgtaaatacatttggcactaacatccagtgttattatgtttataggtctacatttctacactttttagaatttatctctattttgtagctattcctgaaatgatgttgaagtagaacaacaacaacaaagtctttgatctgactattttttttttttcagacagagttttgctcttgttgcccaggctggagtgcagtggcgcgaattcgggtcactgcaacctccctccttctcccaggttcaagcgattctcctgcctcaccctccaaagtggctgggattacaagcatatgccaccatgcccgactaatcttgtatttttattagagacggggttttgccatgttggccaggatggtttcgaacccctgacctcagatgatccacccgcctcggcctcccaaagtgctgagattacaggcgtgagccactgcgcccggctaatctgactactttttaaggaggttcaaacttcagaaataactgtaaatatttgttcaaataagagaaatatttagtctaaaatataaatcaaagaaagggtacgtacagattaagcagtgtttgctgtaaaaaatgtacacatttattgtctaataatacatcagtattaaaactcagttatgtttcctttattgtactccacaattataaccatttacaattattggtagtttaaataactgagataaatactgtaattatgtagacttcattacttgaatatttaagaaacaattttcttcccagatgtaaatttttatattacctttattgttttaattttactttttctgtttcattcttagattcagggaaaaatattaaattatttcattatcaccttggagccacattgctaaatagttcagatattacaaatctttagccaagaccaaattgtgttttttttttcaatttatagcccaattattaatatttagagaccatgtttcttttatgcagttcttggtatcatctttttctatagcactacattttacacagttatttcttgccttttacggctgggaatcaaaacacatacgaacttcaattttgttgtaataaacgttaaaatttgtgaacatttttagtacttcagtaaaaagctcactcattggcagaagcgttccccagatcaggaaaaaaggaattaggattatctatgaccacaaagtaacattaattaatagcagtctttgggagcaagcagcagcgcctttaaatcttagattctcttgtgtctgcaaattatcttttatctttcagctgtgaaattttgtctatgaagtaataccacgagcaaattagcaataggattgcaaggtttttatagtcccgtgctgtagaacaattggcagtaatttgaaaaagaccgtccataacgctgtttttggtctgcggctaaatttgcaattgcatagtttcattaaggagaactggaaagagggcccagaagttgttctagcaatcggcagcagtttatctattttaaatcgtaatgcatactttttttttcctcctactgaaaacaatggcagatatgctaaagggaaggacacattcttgaactgctaaatggtttttccagatagccatttacggagtgcactcaattgccactatctggctgaaagcaaaagcacacacgacggccccttttcttttttccctttgcaaagcgaaacagtctagacgtgttcacgtgatgtgaatgacgtcagcccccgccgggtcgcgtgaccgacacccagccttcctactacctccccctgaccgccagagtgggaaatatcgcgagaattcgccttactatcagaacttactgaggttgcaggggagttactcagaagggaagggaaggtgtggttgtgcggcggagtttttgctttcattcttttaacgttcacagccaaagcaaaggcctttggggattgccagagtctcagccaccatcctggaaaacagcgggggaggtgggcctggaggtggcaagtgtaatgtggctcaggggccgtcattgccccttgcagaaggggctgcgggggagggagaaaacctgcgcccggttctggggagctggcgacgcagtgaaccctgctgaggctgggttttgccccgacagtcgctggtggctgtgggaagggttgggacccttctctgagagcagtgaacagcccacatccggcccctgctgtgtcaactctgagcggcgtggagatgaagtggttgctctcccttgctcggcccaccgggtgtcgtggcccgggaaccggcctggagaagtccctgctgcccggcgcccaaaacaggggcgtgggcttccgcgacccagggcggctgccccgggccatcctcgagttgccctgcatcttcccgctcagtcagccccagattgaggcagccttctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggcttaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagtaagcacctttgcccggcatccgcatatcccctttccagctgagggcgggtcgcgttgcccccgacccaccggcctccgtcttggggcgagggagtttgggagaggaatgggaggagggcccctggtttgtcagctctggggaaggtgctgtcttaataaagggagggagcacagaaggggtaggacccttactccaactgtggctcattttgatggtccctagcccaccttctcccggtcccccaccctcctgcactgagagacttagtgaatttacgatctctgcagttgtagctatcatcctgagaagtgtgcgcgcgcgcctgtgtgtaatgtgtgtttggagaggaaattagaacccatgtaaaatgcaacatagatcatgttttctgtaaatagagatgcctcctggttagccggcgtgtcggccgtatgacccaggtactgatgagaactcacagcctcagacggtgccatatttattgatgccgaaagttcaacttggcatagagtctatttcgcatccagtagttgttctgtccaggaaaagggccacccaacagaacccaaccccttgccctatatccagtgttgttctttgcaccagattaccgctcaccatcattcttcctaggatttacgtgtgcatctttgcgttctctgggaggatttatttatacaggcaacggaaaagccctctggagactgagagcgctcttaagcgtagcctagcattgtgtaaaaccacctccttcacccgactggcagaactacttggagatgttagggaaggaggcaggagacctactgaggacttatgcaaagggacctaggggccaagccgtgaatgctgatttttgtagcatggaacccaaacccaattcctctttcactagtttcgactgttacttttatgaaaggagtgcgtttatatgtatgttgttggtttatactgtaattaaaggaaaggtaaatatttttaaaagtaataaaaattacatatgtatatattgtctggtgttaaaacatggagaatatgtcggaagagcagcttaattcaaatctctcccctcccccagtccaaaacaaggcatagagaaatcaccataccaggatttgttaaaccacactaatgtgctcaagatttatattttaatgaaaataatcgtcatgtttacttacttggaaccacattaattttttgtttcctaccaaaataagtaggcagcagatttttttgctgctcctcgtctgctctgttctgtgcagggtttttctcagagcatttggtgctgtgagtgtgaactgtaaaatgttttcaaatttcttgtgcaaacaagagcggtcataattggcagttcctttcattttgttgattaataatgtgtgctcccagttaaataaaatttacttttattcttcaacattaaagaaagtctgggtttccaggaagaattgttcatttactggatattactgtacttcactggcaatccactaaaatcaataaaaatgctcagattttataaatttttaatgaaatattatatctgttatattaatgacctgctaattattggtttccaggggggcattctcagtggtgagaagatgtatgaaaattcctactggacaagaatatgctgccaaaattatcaacaccaaaaagctttctgctaggggtgggtattttcaaccacatatattggttaattttgtatttgtcatgttgattataggttctgttgtatgtaaatatatcatgtagttataactgaactttagacttaggtatcatattatatattaagattattttcttcctgaatgcttcttggtctgtacagcttaaaaatacatggaaagatataattattatttgatacattgctattaaaattctatctgtcctatgagcaatagcatgaataactatattttaaagcaaataaatgtcaggtgcattttgcttatagtttaagtataaaacaacttttagaccatggaatggaaaaatataagtctcacaactgtcataattcccttttgcttttgagagggaagtaggtcatagctcagttgaatcatacatttcaattgtagttacacttgaacttaattcatcaaggtatatttaacagtaatagctttggtaagaaaatttatgattgctatattctaggaagtttagttttattttgatgtttctgtgtgcagctcagaccttggtcttcgcattaaggcttcacacagactcatgtaatgtattttacacatgtagtttataggtacagagataattcatactcgtaaaatagctgttgacataaccaaaaaacttggagggctctcactgcattctttttatttagtagaactcatgcaaaagtacttacgctgaaatgttaggcattccaattattgtgggcacgtgtctgaggtatttccatgggaatttatggtataaaaatgaaatgaaaatgaacaaaataccatagtgtacgctcatctcagtgacctggtttattttaagtaatgagagaagaaattccattaggtttagttttcctcatttaatatgtcttttcaaaagtgcttcttaccaaaatcctggcatcattgctttcggtctctgccatgattagtttttccatatttattgcaaattctacttttaacatgcattttaggtttaggttggtattttagtttatccattcacatgggttgttgttttaatttccttcatctgattttgacatgattctgagaaagatctataaagtaaccagcaccatagaatcatggtatgaaaactaatgagaagaatattatgttaattatgttctcttagtctctactccacagaaaggttttaacaatgaaaaggaattgctaaactataagtgacattttaatttaaaaaaatgaaaatgtgtagttagaatctttcagtgcttctcttattttcttctgtgtgctagatacttttggctgtggtgggggtatcatttcttttgaaagcattacaatacctattccaagatttttggtggtgtttctttcaaaacaaatcagtgtagtgcttcacttttactaactttcttaattagagccatccctcttcactcatctgaatttgtcctccctaaatcagaataacaaatgtacttatccctggtcacatacattttactctcttttcccttcaatctgtggagaagaagccttctttggcctgatggaatcttttctccttgctactccaccagtgtttccttacttgctcatattctgcttcaaagaactacctacatgtcccaaagctttttaccgcttctggatgtaatgattttcattattctacttagaaaaaggaactagggtgaagagttaggagacattcttcttgcccgttttctgcaattttttttccttgtgactttgggcaagtttcttaacctgttgtaggttaacgtacctaagagtgagctggtggtgaagaacattattaacgctgcaaccagaagctcttgagtttaacttctgctgcccatacctactggctgtgtgatcttgagcacattaactagtttctctgagcctcagtttcttcatctgtaaaatagcagtaataacagaacccttcctcatagggttttgtgtggaatgaatgaattaacatagcatagaacagcacctgccccactatatgcagtcaatgaatattatctgctattattatctaataaaattgtcataatgatcaaattagattacttttatgaaagaacttataaatccagtggcagccttgatttagctgtgagaactacgtttgaatctttgctctactacttaggcataaatttcgtttagtctctttccttttctggatatcaggttcttcatcagtaaaatgggaaatcatactcatggagtctcatggggtgttctgaggattcagggaattcaatgagaatcatttcttaaactgcaaagtattgtgtcaattttacctcttattattgttctcctgaaaaattacagaacttttccttcaaaatggtcaacaattttattttatattgtcacactaatcagaactggttgtagaatatttgtgcctttgaatgaatacgtttgtttaacttgtactcatattgaattataaactcttgaagaagaaaataccatgctttcattttttgatacaacattccacagaattgagagcatagaaggggctcagtacagagtaacaagaatcaaatgtggttgttaaatgacttgtaagagttaagtacttaatttactcctaacaacaagcaaatactgaaaataaatccgtgaagtagtatattaagaggatatgtcttaacctatgaagtcttttaataacactcatttcagagaagatgatacaaatcatttttgcagaaaaatttttaaaataatgaatacgttcaaaggcaaatgtagaaagaattgcaaaatagtatgcttgttttttctaaggtactgatttttgagagttgcatatggaagcttttgtggagcatactttttttgtgcaaatttttgtttgtatttgaaattccatgactctgtatacccaagcctttagtctatttgttttaaagaccaggcaggtcctccaactccactaatgttctttaaatgtaacattacagctgaaaaagaaagggctattgttaataaatctaagaccatgagggaattgccaaagatttggctacattcctgcataaatttgcacatccaactatactatcaaccaggcatttttctgtgcctagattttaatggatttccagcagacagtttcagttgtatttcctctcagctgttagtcatacataccatatttggggaactctgagtcaattgaagaatttcttaccttttgtgttagcatgtgcgtgcatagaacattcattatactgagcatgtagatgggtacactcatatataatttggcttattttgaaaataagtagtatggaagcatctcaagcatcttatattttatatgtaatttctatcttctaaaaagtttttgttagatgggcattgagggcatgcttagtaaatgttgaatagtgataatagaatttttgccttatattttcatgagaattagaaattacgccattttaatcccaagcacagttagattagtacttaacaaaagccaatttttttctgctgctttgatattctgtttatttatacatgtttagaactgtacactgttgtcaaattatataaagtccaagaagagctgtgactgcagttcagaatccagtggactgatggttctgatggcagataatttagaaatagtacctgtgatttattttgcatttcaaagcctcgtggtggtaaaatattttatgtggaagtaatggcttcttgacattcatctcccagtgtatttcttgatcgttagaaaccatttgactattacatagattctgatgtgtcacagtcactgtttttgtaaaatataatacattatagtatagggttaaaaaataagttattacaactgtattttacctctactccattgctaaagttaaaagggatttcattttatatttctgtaaaacttcaggcttaatcagttaagtcattttgatattctttgattttactagttttattaattcctaaattggtgatattagtagtacatgaatcaggactttataaaactacttgaccatgtatgcaaaattaggcctcatctataaaatctaaatgttttgtgtgtgtgtgtgtgtgtgtgtgtgtgtgtgtgtatccctaagtaaccttttttgatgttgtaaaagggatgttaaaaactaattcttgctacttttcttttatttttggcttccaggcagtcaagaaagtactgtaatttctcaacttcatggttacttgtcttgaattggaagtagaactgagactatgtagatggattaagttctgattatacattattgatttggcaaattggaacaatttggacaaattaaaatttgaaggtttcttggcaagaacaacattttaagaaaaaaattagtaaatcatttttatatttgtacatagaatctccacaactcttcagttatggacccagaagtggcatgtgtcatccttattattttgtatcctttacttacgtttagttgtatttacattcttctataggtcttgatattaaacattcattttcttctttcattgaatgaaagcattactgctcttcagaactagttaggagacacaaataataaaaaaaaaaagtatatccacacttccaggaaataatagaattcttttctgtatttcattaaatgaagaaaataaagaaagtggttgtcaggtgccatactgtgatattaataactagtgtaaacctctacctgattgtgtgagaactttgtttagacaattagattaatacttctcatttccattgaaatgttgaataaactgaatataaaaattaaaatttagcaatatgtcaccttttatggatctttttaatggtaataatcacgaattactagaaatcttacatgtactgggcttttcttgggcatctaacttttttgttaactagaattttaatttatttttaaagtcttccttgggcttatactgaggttgactcatagtatttctagggctggattggtatattttttaacatcagtcttccccatttattagggtgtaatgtatgcagtgttttaataaatcattggcaattaatgattatatagaggctgtgttaaagattttaagttacaatagtatttctagtaaactacactgcaatgcattaaatggagtattagcaatattttaactgtaaaacatatctttatatttcaaatcactttatagatcattaagcatattcacatgtctttatgtgtttatttaataaatattaaatgatttcagtggacagtgttaggaaaaataaaggctatctacctaaataaacataatagaagacatgaatggcattacaattcaagcatgaataaagtactatgggctcttaaaggaggacaagattatttctgcccagggagataaagaaagcctttcatatagtattgatttaaagaaattttgaaagctataatgtagatggggcttaagtaccacccccgcccccacccaaccgaaaaaaaaagtctaaataaatgatttggggaagttgctcaaagtagtttaaatatctgattataacaaaatgttatgttattcatatggtaaatttgttgtaattatcagtatacagttatttttagaataaaattattttaaatgacgtaggctgtttcttaagtgacaaaattcctctaattccagttgagagatttagcaatacttaaggagaaatcatagaccttttatctgccataacttctcttactctagcatagggaaattggtaggtttgaagaggagagagggcagcttttttgttaagtttgtttggttttgtttttaaatctcttagctatcattgtaattacacacaatgacacaatgacatcactgatttttttagttacctgagccccttttctggtgttacagtctcattttaactccttagaactatgtttattactaccaaaatcaataatgccatcttcatcattaataataatttagaaaaatataaatattaatagccattatttgaagagccccttctatgagacaataagtatatatttacaagatactttgttttattttatttaatccacactgcagcctcctagaacaatattatgtccattttaaaaaagaatactgaggctcttgtataaggcctcaaaattagtaagtgataagagtcaggatttcaatctggttttctctgactgtaaattctgactctttccactgtcacctcctgttgattgctattagagaggacttatcttaatctgtctgtatttacctgtgtgtgcttaactgatcttacaaacttcagagtccttcatacaaagcactatgccttacattttatcttcccattgcagtgtgggggattgagtatttctttgggaaaatacatttagagttccaacctgtgagagaagatagtcttttaaatgctactataacaagatcaaagtgaagtttcagacagtccctccatgctgtcttctggaaggacaacaatatagtgaaaaatgttattataaaatggtaggaaaatggttaaagaggagttcagtattttggtaaacttaattcattaactgattaaaaatatctcactatacagtaagtttctaggattacttcttctaaatgattcagttgtcactgcaaactaaaactcagcccttaaccgaagcccagagaaacctactcagaaagctgttctactcttctggttcatcttgtttaaccagtgaacaatggaagacaaatttttgttgttttgtagtttccttttgaacaacattgttgtatgtagcaaattcttacaaaaatgtggcaatttaaagaaaaatataaaattgtcaagttctatatttgttgaaaaaataacttaggtgcagcaagtagtataaaggtacacaaagtattgtgatataatatttatatacagttaattgttttacaataggtttcctgttttccttcagttacattgattacataggaatgttaaaagttttattgcataaaatttgatatatataattatatcatatatatttaattttataacaataagcacccaataagcctccactcaataactagaacattctccctacttttgaagctacctgtgtgctttttgttgatccctatcctttgtatctccccgagagctaatcaccatccctaacttttttaggagagaaacctctttttatttcttcataccctggggttttttaattaactggctgatctcagtgggccagtcattcatggaataaatatatgtagccattttctaggtaaattgtattttattttattttgtgtggtatatgtgtaaactcatggaataaaatacattacttctcatatattagtatataattttaccctcttaaatataggcaatgcttaatttatttggaatttgtttagtaacaggaaattattttcttcctatgtctgataaaattttttttaaaattatttatttatttattttgagacagagtctcgctctgtcgcccaagctggagtgcagtggtgctatctcggctcactgcaacctcggcctcccaggttcaagtgattctcctgcctcagcctcctgagtagctgggattacaggtgcgtgccaccacgcctggctaatttttgcatttttagtagaggcaggatttcaccatgttggtcaggctggtctcgaacaccggacctcgtgatccacccacttaggccttccaaagtgctgggattacaggtgttagccgccgcacctggccaaaattttattaatgataatgtatacacattgaaataaagcatgaataacttatataaaagtaacttattaaatgtaaatatagtaagtgaaaatttatcaaaattttctgttttataaagaaattgtggatagttgatatatgccacattatgctattagtgtttaaattaaaatttgatgttttgttgaggaaataagtacttttgcatttttttgaggcaatgttctggataatttgaatttctgctgagggttatttgttagtaatacagccccaaactcagcatattcccagtagactcatcaactttccccctctgtgaatggcacaataattttcctaagctttcaagcatgcctgatttttttctttttcttatcccatctcaacacctttttcatttcttccttttcaccatcccaatttgaactctcttttctttttgcttcaactctttgttttgtgttttgagacacagtttctctgttacccaggctctagtgcatttgtgagaacctagcttactgcagcctccaatgcctgggctcaagtgatcctcctgcctcagcctcctgagtagctggaactacagtcatgtggcaccatgcccaagtagttgtttgttttattttttttaaagacagagtctctctgtgttcctcaggctggttggtcttgaacttctgggtgtaaggcaatccccctatctcaggctctgaaagtcctgggattacaggcgtgagctactcactgtgcctggctgcttcaactcttttagatagcctcctaaatgggtttgatagataatagttgcacattttttattcgtttattcagctcatcattagatcttttagcactcgctttgctgggcaacttgataagttttagagatccagaggtaaaagacagacattccttcctcaagtatttcctggcctatgagtgtggatgacagcctggcatttagtagagttagtgaaagggctgtgatagacgcgtgcacagggcttttgagagcatgcagaaacaggcttggggaggttggtctcacagatttcctgaaaagattgatgtgtgaggttgtattttgaataaattaggtgagcctgctagagaagggagtaagcaatctgttcacagggagggagaaagttcctgctccatcttcctgatggagtgagtacacctggtactgttgcagtactctctcctttaagatccagtgcaggtcctgcctcctccatggtctctaacttcttcccccacctctccttactttctctagccagagagattgttgtctccttctttgtcctttcaatagatatttcatatcttatggagcttgccagatttctccctttgtattgcagtcatacatgttgtggccttcaggcatttggtgacatttcttagtttatctttcagtctgcgcctggcacagtaattaatattgcagatacttgtaaatgtttgttggataagtggacaaataattgcatgaccaaataagattctgtatcttgaaatagacatgcttcaaagagaaacttatgactggcaaagtaaattgaaaattgactaagacttcatgtcaaatagcatacaataactctataaattaatttgtaattcacaaattatttcataagttttgtcatgacaaattctgctttattggaaggagttttgtataattcagtattttctttttgagcaactacttgcaaattcttattgctgctctttttttaaaccatgtattataaagtggctcattaatgagggctaacattttcatggtctgtgtgtccatcagcaccactttaataattccagactcatgtcatgattaaattattttaacatgtttgagtttaaaaaaattttgatccattctacagaggtatctgattactttttcatttattttttgacaaagcttatttttaagcagtatggtgacactttatagagttttagatatacatatcatggatgttattagcttagaggatatttgattttttttagtaaaggcagttagaggccagctgtttcaactgctgtgtctgtcagttgagaaatttggtgagggagagtgtacttgtttctgtattggaaggctctttaaacagaatgcatgttgaaaagcacttacttgtgttctctcctcaaggaaatttcttgtgtgatatgttgcaagacactgggtggggggggcggggttccaaattctatagctttacagtgctaatacatatactaaattagagacatatttctaatacctattctaatatatttaatattatatattacattctatttatagctattatatatgagaaaatattcttttcataaaagtattcctatcatatttttaaatgatgacttaaagcctttaatcatagtggcaatagtgatttggggagttagttcaggtgtacattttggcagttttgtagaaattgtatccatgatgaatattttattactttgataaagtgaattttatatgctttaatactaaacattaatatttgttaggtatagaattacaaacttcagacatacctctgaaataaatctttattacagttttgtataaatacattttaaaataatcatatcataaaatatatatattctaattacagaatttggggaaatatggaaaaatagaatgagggaaagacatatttgtagttcatttcccccaaacaagcactgttaacattttgtcactttctttttcttcagaatactggactaaaatattacaattttatgtcctgcttttttacttaaaattataaaatttccctatgtactgcaaatcttttgaattcttaataagtgaattatacttcactaagtgactagaaaactgattaattattttggtattcctagtattttttttaatttttgctttttgctatgatgactggcactattatagacattcttttgtataactttttttatagttctgattagtttcttaggaaatattcatagaggagaattaatgggttagaggattaaatatcatcaaaattattcttgcctaattacttcctgtaaattttgtgtgtttccaccaatgacaaagtatgcgagcgagaaattgaattttaaggagcgtgattctaaattttaacttcaatttaacaaaaaatgcttattcaccatgttctggtccttctgctaggtgctggataaatgaaggtacaaaggacaaaagtccctcctttcaaggtgaacagatgtaaagtcaagtaaaattaccattcaggttgataaatctaacaatgggagtgtttactgggttctgaggtgtaggagataactgttgggttgatgagaggtcagggaaaacttcctagaggagctgatgtttgaactggatttccaaaagaatcagtttttgaactgagagataggtaggaaaaaaaacaagttcaaagtatatgttgaaaaaatactcacgagaagccagaatattggaacgtaccaataaagactgaacttgagaaaagcactttctaactcttggtgatagacttatcaggtatagagtttcatgaaacatgcaaaaacgggtgaaaagaatgggagttttttcttccaacgaatcattaagtatggcaagagctgttggaggttcttaaataaggcagattgtagaattttacaacactgagttacttgaaatgaacaggtgataagagaggaataattaacctcttacctacctcatattttgttttagtgagccttggggcaatacaaaaaattaagagtgactaagtagaaaataaaggacgggaggataattagaatttgtttttaaaaatcggctagtactttaaaaggtagttcctatagttgcaatatggattaatgactgtttaaaaaagttcataagtttctgctcaaatccaaaactaagatatctaaaaatggtactgacattattaactgcttgaatgcctattgtcaagagtagtgtttggcacccaccacaggtatttattgaaaacataaaggaataaaatgattcccaaatgatatcatcttatgattaatgaatacacatttgaggacctagaacttttagcagtaagatttgcatacgcttttcctattgaatttaaaaaaaaaaaaaaagttcaaaattctgttagattaattctgtgatatagtttataatttggcataagctggtagtagggaaatagtcacttctttatgcccatgatttatataatgaaacaatcttccattcacttagaagacaacttcgatttaaatatttagcctccctagcaaggcccagccatgcaattttttccctgttagaagaattttagcaacagtaaaaaaaattaatatgtaagattttgctatttttattagttttgaggactgcttgccttgtagtttaaagggggtaaaaaggatcattgttttactcaatgtatatatatatatatattattaatggtagattttttttttttttggttgatgtaggaactttgggagtagagcagaaagcctattgacttcaaaaatagtgactcagggttggtataatcattagtaagcaggttgggaaaaatcctaattccagacctcaagtagaattttagtatcagagtcactcctgttccttaaatgtagatctcctgatttcaggccatttttcattctaatagaattagagaagaaaaataaaacctgtcaacgaggactatttacctcctatagataggattgagacctacttttctgtaacttttgaagttatttttgggaaaaatttccttgggttgactttgcccccttcacccaatgcatctgtgtgatcaggaaaagggaaaacaagatttaattgttaacttttaaaaagtccttttgaaagaaaaaaatatatactgtcttatattgacagagaaccaattattgggttacctgcaacactgtatcctccatttagtgctgataatcataatgtccataatctcccaataagataaaataataaagaggctctgaggcatgaacaggggtggctaaaggatcattgagataacttttaaaataataatgatttatagaaattgagttaatatttgttgaccttctacaaactttaaaacagatagaaggttttaaggtatatgttttgaaataatccaaaccaaataaatctaaacttagaaataccatattagaaatatacagtgaacacacacaaggtcaattttaaaaacagcacttagctttgagcggataatttctccttcaccctgaatgcaaataatttattcagcccttctataacaagcttaggggataaaagaggcaaagggcatgagaaatgagtctttggaaaattattgtaactaacactaatgcttatttagcatctttcattcaaagaccttcagacatttcctaattgagttctgtagtacttctggagtgtgggtaaggaacatttagagactcctgtgcccagtgctgtaaggcctgccatccccgtgtggcatgttgcagctgttttgtagggtacatcatattccttcctgggccagagaatggaggagacagcgttatccagctgaaatcccagaaggattaggggaacaggagtgaattacctggattggaatttggccagctttctgggtcagaaatcctattcctataaaaatgttctatctttaaaacattttatatcctgctttatctccaagaaaataaacgctacatcacttattttctgcaaatacctttgggagcttaacattaatattgaggaatgtgacagcctatatctactattaatgaggaaagaaagcgaggttaacattttatctaaaagatattagaagagaaaaactatttgtattatgcctgtcgaaagtaagctgtgggggacatgaagataataacatatgaccagttcccacaaaaaacttacaaactggtttgatgaataggagacatacatagataattatggggaagatatatatgtatcttcagtatcagaagaaagtattatgagaattcagtgtagcctagtgatgacatttaatggcagaagcaagaaaggtaacattgaggaagcagaagtggcagtgcatagaaggaagaaagaaggacaaagacacaggaatgcaggaaagtatcaatgtttagggaagaaccaaaaatgtttatttgggcaaaggatagacaatctgggaaatcaggaaagaaaaggttaaaaacacgtaaaggtagtttaccaaattgcaaatttgctcttaagtataccagagacacattaaagagagcctctatgatgttacttggtagcagtgaatgaatacgatggattggcctggattatgagagacactgagattctgaaaccttaagataataacagatgtggcaggagggctgaagtttcaaagctgagtcatggggagaattagttttcgtgtaactagttgagaagtgagaatcaagaactgattttgatgagggaagatgattaattgatatgtatttgaggtatacacaatatattcacactgacttatcaaaaagacctttgaaaattgggtgtggtccttgaaaagtgcctctggagaacatgcaatgtactgtgtaggttaccagcattggctgtgaaatcagattgccaagattcaagaagtggctctgccacttccaagttcttgtgaccttctcaagccttggttttcttatctataaaactgtgataatcaattttgcggctatgataatcaattttgtgattcatttgcacggagaagatagtagaagctatgctagtggataagataacaatggagagtatagaaaggaaagaaaagagggcctaggatagtggtgtagggaaatactgcattttaatggatgaaaagagggctagtttaggataaatggaaggatatggcagaaaggtatgaaggaaattaggataatgcagtgatttgaattctgagggagggaatttttgcaaaggaggggtggctagtaatgttcagaattgtagagaagtagagagaaatgaagaccaagaaaaggccttgatttcccatatggcagaatttcaatagtgtttaggacaaggtcacgaggattgggtcattagactgttacttgttttcgtatgctcagaacctagcacattgcataaaataaaataggtatttaatgtttgctgaaggataaagaattaatgactttcttgggattaaggaacaaatggcgataacatgaaaaagcttgcttgtttaacaaaatagggggctgggtgtggtggctcacgcctgtaatcccagcactttgggaggcctaggtgggcggatcgcgaggtcaggagatccagaccatctggctaacactgtgaaaaccccttctctactaaaaatacaaaaatttagccgggtgtggtggcgggcccctgtagtcccagctactcaggagcctaaggcaggagaatggcatgaacctggaaggcagagcttgcagtaagccaggattgcaccactgcactccagcctgggcgacacagtgagactcttatctcaaaaaaaaaaagtagggaagataaaagagaaaaagagaattgggagtaattccagggattcctcaggtcaagggaattaactttggggataaataaaaccaaagcttatttgaaagaagaggaaaaagactaaggaagagaaggactgataatgcaaagaaagagggtagtatttattgggcacagatgaggaggttgtgggcatgagtgagaataagagataagcttggggaaaatgaattctttttcctcagcgggcaccaagagtgagaaaacagcacataccgaaaggttttgaggtggagaagagggcagttatagttctgctgagaagaagagaaatagaagtggggttgagaagttggatggtctttggagactgtagaaaggagacaaccaaaagcattgtgcagtagtagtaacaacctgaatcattagcaggtacaggccttgaatctagcaccaaagtgtccaaaaatggctcccagaacctgtggctcagcaaagtgagactgcagagaatctggcatttttaaaagatttaaggagaagaggtatcttttgtttacattaatttttcttaattcacatggctagtaataatagagcaactagaatttaaacccaaactagctaatagcaaaatccttgatattgtcattctgttatgttccttccaagttgcatctagcagagagatgaggtgagggaggcagttagaaaacaaaaaattgaaaagaaaattttattctctaggaataacggccagaatgatgtcattttggaatgttcagtaacatatttctttttctacttgaaagtgaaacctgggaaatctgtaatttacaatctaagtttcccttattacgattcaatttcattccatttttctgcataaactaaggactctacaggcagcttttgatggctcagggttgtacatagtttttatcagtaggaaagtactatttatagataaaaattatcatagatcagaaataggtagtacatgctatgaaaacataaattggttcatcctggatgtcatattaccaaagttgaatatggctcatcatcatgaatattctatttcttgtgccttgcttacattcctatctatatgtctctggtttagtgactgtgacgattggggcttttggtttggtaagttttcccaaaagcattggtattcctaataccttttttaaaaagtctgtctctttttaaaatttgcttttctaagtttactacaaaggtttactttgctccttgaggaaaaaaaaaaaatgaactcaagaattgttattgaggtaggtgtgattagaatgtgtttgatgttgttttttctttttacataccatgttttttccactttattattcttttgcccatttcttctcccattgctattattattgatgtttaaaatctaattattcatgatttttcccttctctaccaccctatttttcacaaagaaaacagtttcttgagttcagacttcaaagttctggaagacatcttctttgtaccttccccagttattagcttttatctaataaggaaaagtttgatattttttatgctgaaacttttgtaactcttggactttgtttctctggttcccaaggtctctcatgtcttatattgccctcattatatcagtcatcattatttgttcattcatttactcatctatttaacaaatatttattgagcaactgctgtgtgtaggcacagttcttgattcagggggtaggttggtgaagagagttaagatgagagacatgggaaaaggcatttggatagataagtaccatgcagtgctatgaagaaaatatagcagggctataaattagataatgacctcattggagttactttagatagagctgaggaagaagcatttgagctgaggcattaacgatgaaaagaagcaaaccgtgagaaaatacgaagaaagaacattccaggccaaaggaccaaggtgacagtgagcttgcacaggagtagaaagaaagtcaatgtggctggagtgtaattagcaaggagagaagtacatgatgatgttgggaggtaggcaggggatggattgtgtagagtcttttagccaagttaaggaatttggatcttattttaaatgcattgataagccgtttaaggatgtgaagcagggaagtaatgtgataggattttgttttaaaaaatatctctctggctgccatgtggagaatacattgtaaggaagtgtgagtgaaagcaagactatagtagtctccccttgtctctgggggatacgttccaagacccccagttggtgtctgaaactacagattgcacaaaactatatatactgtatttttcctatacatacataaatatgataaagtttaatttataaattagtcacagtaagagatgagcaagtactaataaaatagaacaattataataatatactataataaaagttattctgtgcatgtaacttttgcagtttgaagtgcgacagcaaaactgcatgaatttctttctccttcttcacaatttcatggatagaagatttattcttaccatagatcttagcatatacattttttatttccttattaaggggagaactttcacctttgcacttaaaggaagcacagtttcctttgctgaacggcttctccttggcatattccaattgccagtatcactactcttgcactttggggccattactaagtaaaataatggttgcttgaatacagcactgtggtactgcagcagtctgtgataactaagatggctgacaggcaggtagcataaacaatgtggatccactggacaaagggatgattcacatcctgggctggacagagttaggtgttacaagattttatcatgcttctcagaatggcacccaatttaaaatttattaattgtttatttcagaatttttccacttaacagttttggatggtggttgactgcaggtagctgaaacctcagaaagcaaaactgaattaagaggagactactatagttaggagactcttgcagtctaggggagatgtgaaggtgacattagaaatagtgagaaggatggattttggaggaggaaatttaggacttgctgatggaaaggttgtgaggtgtgagggaaagtgaggaagcatgactattgatctacattagatctagtagtcatctcatagtagatgactactagtcaaaccaactatctaatggtggcactgtaactgagaaggggaaaagtagagtatactaagattggaatgggaaatcaagagtccaggtcttgacttaaatgtgagatttattacaccttacctattagcaatgattcatcattcttacctctcctcctctccctcaaacccaggcaaccactcatctattttctgtctctataggttttattctgaacatttcatgtcagtggaatcatacaatttttttttctgattggcttctttcatttagcataatactttcaaggtgcatccatagtatagcatgttttattgttaaataatatttcattatatgggtataccacattttgtttatcagttcatcagctgaaggacttttggattgtttctaccttttgtccattctgagtaatgctgctatgaacatttatatccaagttttttgtgtagacgtaagtttttatttttcttgggtatatacctaggaatggaggaaatgctgtacatacacacattcaagaaatacaaaggaaacattttatgagatagtactctatagtataggattcaattattactaaacagattaatttgcattataacacatgtgcatataattaatagccaagacacttggaatagtttagatattttgaagtgtgaaaaagaaatggagtgaagaggatggaaggggtcaagggctaaaaaactgcttattgggtactatgcttagtacctgggtgatgggttcaattataccccaaacctcagcatcacacagtatatctttgtaacaaacttgaacatgtaccccctgaatctaaaataaaagttgaaaaaaacaggacatggaagttgagtttcagaataagaaagtaaattatgaccattttcactttgtaaatgagaagtattatatcatgtaggaaagtttttatttaaccatgattttaaattagctatgcctggagttgaaagaaacatctatttcatgtcaaagaaacatcaacctattattgaatgatctctttactcatgtcaattattactagaaagaatttggcttgggagctttatttgtatcatagactttttttagactattgatgtagatggctatttttcttttaattgagtggaaagttttataagtcttatattggatccaccccttcctgttccttttttgttggcaagtgcctgtttttgcatattacttgctgggctgtggcagatacccacagcctatgacactggcataaaatttgctaggcttttgcttttggggtaggaagctgtgctggggattgatagtgggcagaggactgaggagaagtagattgaaattctctttcactaaaacctggggttagtttgatggtcagtgagaagtttccattttaatcttttaaattgaagagtacatttaggattcattgaaagcctaataatgcaacaccctgcctttctttccagtgaaattttgaatgttgaatttcagttcttttgcagcattgtattttcttgatctgcctgacaaaacaagattaacacatctatgaagtatttccatttacactgtggttctaagtgctatgaacagtaaggaatggaaaagaacaaagaaagttgcattttttgaaggaatctttgaattcacagttaatatttatttttacaaatcaaaaacccatttttgggatgtgttatttatttttgtatatatttaaaatttgatgtatatttccaagtgagttagtaaatattgttccccatattacatcattcataaaatgcttcgattaatttttaaaactaggctggattaatagccttttaaagcctttcagttgactcttcccccaaaattttcagtgacatgggaaagttcatattgggaaaatttcccttgatatttgaatggtgaatatatactaatattatttcattatatttttagtgatatatttagtatatggagatatatacatatatagacaggattcttaagaaggagatacaggaaccataaaaagttatgttttgccagaattatgttttgccagagtccactaaagaggataataacacattaaaaatatttttttgcattcactcattgtgcaatatcctattttcatttaaaaaaaatcaggttggtaagtctactggaaacatgagactgcttaactttcccacacattctttctcccttgtgggttttcatatgggtatatttaaacagctgcatgaaaccattatttgtggaggatggattggaagggaacatttacagaccatcttgtataatatttaggtcttctttaggcagaaccatcagagaactaagtatagtgattttatagataggagtttattatttcatctaacttagttttttctcacagtagtttttttttttttttcaaagaacatatttagattcttcactcattcttatggggttgtgctgtataaaagctgtgatttatcacttcttttatagagaattggaaactttgatttctaacattagcaagatgaccatacgcaatttggttaacttattgtgatttgaaaaagcctattttgaggttgtgagaaataatgagggaacctgaaaggcacattgtcttaggcgcatgtttaccatgtgactatggctttccagatggagagaacaaattaaaaattaaaaatgagtgattctagaccttgcctaaattcattgacccagatgagagctcttcactctttcccaatgcatattctcatttactagagagcttgatgttttgttttggatctagttccaattttattatgataaataaatgctatatttaaagataaagattcacaaccagatgatatgaaatgattactaaagcattataaaaatgctattatgccttaacaaaaatataaaggacagtgaaggatagatgcagttaataaagattttttatattatggaaaaatatttgtaacataaaatccaccattttaactgtttttaagtgtacaatttagtggcattaagtatattcacatcgtcgtacaactttcaccaatatctatctccagaagttttttgtcttccttcactagaactctatattcattaagtggtatctccctgttctctcccccgagtccctggcaactacccttgcactctgtctctgtgaatttgactactctgggtacctcatgtaggtggaagcatacactacttgtctttttctgtctgacttgttttactttgcatatcttcaaggttttttcatattgtagtgtgtgtcagaattttatttctttttaagaatgaataatagttcattttatgtatatacaacagtttatccattcgtctgttgatggacatgcaggttgcttctatcttttggcatttgttaacagttaagattttttagatttgtctttacaagggtatatatgattattaaattgaacattctaattggatgaaatgaaaagaaagaaagtatatcagtgataaagtttataattttgatttctttattgtacacaggaaagtgctagatcattttacccccaaatactattattatgttgtagactgcttacttttgatattctatgacataaatagagatgttggagtatacatcatgatgcgtatttatttacctgaagggaaagatggaattcttcataatgcgcatattggatattctgatgaactggacattgccagttctaaactctcatttacgttttgacttcttagtgtatgataatgtgatttaatgaatcacgaggaaccagagggatatttttgcctttttaaacttttagctttgtagtatacattttttctttagcccttcatctgtttttcataattatttttcacttaactagttttatcatattagttttaatatgaatgaaaggccatagtgtttgttatgttttcaaatatgaaatgccctgtacattgcattgcagtgatatggagtgctgtcaatgtcctagacttgcagggaatctgcaaacttgattgaacttttatgagtaataatttagaaagatattaatgtggaatacgtgccattgcattatccgcttcttcctttgtttcactcaatttaaaacaatgcaatacaacaaaacagaaacaaactttgacaaaatccagctgattaacttttgtagtaagttgcctttctacattagtatattttaaatattgaggtatgatatacacagttttgatttctgggattaactagttgaaggctatagggtttaatatgtttctttgtacactcagtgtctaacactagatagagtaaaactgtattcaaaatataccagcattgaagaatagcatctaaaaattggattggagtaagttggatgtcttggaagatctgattttaagatggcagtaacataaaatacacttttatataattgtggtgatgttactgggtgttgttttttttttttttaattctactagtgagtcaggtggctatttctatttgaaagtgaaggttttagatttcaaattcagtatgggttgtagattacatacttctttgtaaagatttcccgtctatatttcgttgctgaatagtcatataaagatggtggaacctttttaagtctctctgatgctccaacaaagaggataaacaacaggatatttttattttatctgatgttcacagtattaggtactttcttttgtagaaagttatggaaattcttattttttgttgccatttgcaaagatgacagtgataatatatttacataaatatactttaatgccatttgtcttttatctggctaatctagtctttttgtttttcctttcttccaaattgttcacattaaatgtaaaaatttctgagccaccttactgtttcttacaaaattgctgtgctttaaattactagagtatgttttaattttttgaacatcattttattactacagctagaataataacccttctcctgtgcatctctcagttattgtaagaattaaatgatttattatgaaaacactgtaaattataaagcaccatatatactttattgatctctgtaagttatacatagttgtgtattgtacaaattgtgttttgttgttgtttgttttttgagacggtctcactctgtcactcaggttgtagtacagcggtgcaatctcagctcaccacaacctctgcctcgcgggctcaagcgatcctcccacctcagcctcccaagtagctgtgaccacaggcgcacaccaccatgcccagctaattttttttttttttttttttttttttttttttttttcctgtagagatggttttgccatgttggccgggttggtctcaaactcttgagctcaagtgatccacccgccttggcctcccaaagtgctaggattacaggcgtgagccaccacaccttgcctgtacaagtttgcaaaaggcagaattttatatatatttcctgtgtattattctaactgggctcttatatgctatcggtattgtagtttcttggacaggcaaacgtttttattgtgttttgtttgtgtgtgttttacttttttaaaatgtcttgggtagttttcggaatctgttttactcatttggtgattataaatttagaagtttgccatgtaagatagtaaaatgttttagatcatttgggttgatttttctgcttctttttttttttttttccattttcctaaacttaggagtaaaactggtttaaaaaactttttgagacactttagaagattaagtggaatggtcatattatactttttcctttggtttttactttgtattaacatgaaggcatatattgcatttagagaaatatgaacacagtaaaatgttttcccatcagcctttcaaatttgttgtatcttgattatgaaagtgttgtcattttaataactagtctaactaggctgtcagctggttcttggaataaggaagctgcttgggcattagtgcttggacctcccactctcttattgtcaatagataacactgaacaatttgaactatttgatttacatacttgttaagtaatttgtatatatgccttctatttggaaaaattatttttgaagtggataaataaaaaaattactataggaataaaagagaacaatgtaaaaattctactaccttagaatgtagtagaatattattttgcaaatttgtaaattgtgattcaagaagtatttttatgaccttcctttccatttgtacactctgaactagatcaaatgaaaatcatcacgagatttttcatgcccatttaatgttttattttagaaagagttaaggagaaaaaaagtaagttgaaacaactgaactaatctcttgtaaccaacattcagaacaaagcttttaaattactcttcatcttctgtgtttcttaggattccatgtgcacagattttattttatgccctcagttcaaagctaaaacacatcaactacccctattatttaaaaaaaagttttttcaacaagagaattttaaacaaaatgtctgttcttttattctattacagaactcaggtgagaatccttctcatattttaacatggaaataatgttttccttaaaaacaacatttttcttgtttagcttaaaagcagaatggaaacctgttctcatttgtacatatttagcctaccctttggcttaccaatggttgagtcatgagcaaaattagtttgtgtatgtattttaaaagtcagatgtcaagtaatcaccttttaaagaggctcattataattagttacatgtatgacagtttactcatgaagaaactgccatttatgtaatttcacagtttaaaagctacatgcttgagcagagtctatgtttctgtatttaaaaaataaagtggattttgtctttgtattaaaacatgttaagtaactatatctttttcatagctctgcttttacaatgatatcaaagcatcaatagaaaggcaaattaatttctgataatttcaacgttattggtatttaatttggagccatacttatacctgataacttgacttttccctttgtttgaggatatttaactcacttaactcacaggctgaaaagaagtagagaaaaaacccagatgttcagtttagcaattaaaaaaggatttgcacttgctgagtacagttttttaaattagacagcatctagttactctttgatctttcatttgtggtgttcatgcctaggcattttaaaactaactaaagtaaaaatgcttactcaggagaaaagacactgaggaccaaggctcctttaataaatggaaggcaactgttattacaggaacataggaaagtattcaaaagatttcttttgaaatcatttcagaagctgcattaaatggttctttcattcctgattctggtttgccgaatatcaccattagtcattaagcacattgctttatcatttcagtctctgtctctgcacatacaactctcacccctcaagctctccactagtctacctcacctttctcttcaaaacttctccaggggccaactttttgttaaagctgtcctatgcaaactcttttactttatatccattacttatttaaattaatttttaccctgtgtttatttgaaatcatttggaaattatgaaataactgaccttaagtctttttcatttatattgtacagtgcttctagtagagaagcactaatatatctatattcctaatatatatatattttgataggatgcgctgcatagatgaagatgagatagctattaactctaaatgaataggcatgaacttttcagggagtcagaggagctatagaaaattcacgtttagctccttttatttaaataatatgtaaaaagtcacatttctttgatgacttaaacctgctgtagttataaagtgcctaaattgtgagtgcaggactcttatcattgaattactcctagaggtcttgaattcatgcacgctgattaaaatatgtaaaaatatgtgaattatcatgtaattgataccatagtgaattaatatcattttgattaaagtcaaatttgtttaaaagttttactgaattcataacagctcaaccaataatattagaaacaccactgctgtcatgtggcaatgcaagtgtttcgacattaaaaaggagtgcagggtggggcacggtggctcacacctgtaattccagcattttgggaggcccatgcaggaggatcacttggggccaggagttcaagaccagcctggacaacatagggagaccctgtctatacaaaaaataaaaacttagctgggcatactggcacatacctatagttccagctacctgggaggctgaggtgggaggatcactttagcccagaagtttgaggcaacattgagctatgatcgcaccactgaattccagcctgggcaacagagcaagaccttgtctcttaaagaaaaaaaaaaaagaaggagtgctgatgtcccaagagtctagacacctgctggactctagttgcctaactttaaagatgagaaaccccggcccaaaggagtgaaatgacccacctcacatcacccagaaagtgtttaacatagaactagatctggttcctatggccctgtaatcatattacttctctatacggctgtggacataacaaatgggaatgaagtttatgagagagggccatataaaaagagcaataggctgggtgcggtggctcacacctgtaatcccagcactttggaaggccgaggcaggcggatcatgaggtcaggagtttgagaccagcctgaccaacatggtgaaaccccatctctactaacatacaaagaattaaccgggcatagtggcgcgcgcctgtagtcccacctactcaggaggctgaggcaggggaatcactcgaacccgggaggcggaggttgcagtgagccaagatcacgccattgcactccagcctggaggacagagtgagactctgtctcaaaaaaaaaaaaaaaaaagcaataaccctggcttagattatcttttatactttgaagtgttttttcatcatcaagaaataaaatgataggaaaacttgtttaatgaagataatgttatatagtgcttatgaaaatagtttcatctattacactattaatttttgattctttagaaactcagtaatagcaggagcatcatttgaatagtactcaaactttttgacattatttccaattgtgattttatttctttataaggcctgagaaataattagggaagatttggtgagtgcctctttagacccgggaatgctaatacacagagttataaaatgaatggcctgcggtcattgaccttcttagttctcctaacccttagttctattttatgtccattatctttgtttttactttgtggcatgtctttgctttttggtgttgctttagtgaaagcagatttatgggagagaggtggaaatgctagtcactcagtttggcttttcgctagcacttcttgaaaatattcagttggtgaatattgaaatgaatgacaaataaaatctgagggttatatgagtttcagtttttaagtcagtcatttgaaatatgtgatgccacagtaactgctaaataagtgactttgtgtttctggttacaagactctactagttcagtggtaagtcctatagccgttgtataagttggtgagaaaagatgtaaagtgtggtacctggtatattgtatgcacaggtgatataaaaataaacaaaggtagaaaaagtcaagtcaggtattcactctacagaaggagagtcaagtcagtgagttgaaccaatgagcaagtggaagaaagttgctgtgagggaagtgatttaaacagttaacagtttcattcttttctatagccaggtgaaggaatcataagttccatgaattgggtaaaaaagttttgtatggtggaaaatgtctcagtcataggcttggctatgtgaatgaaatgattttggttcctttgtagtttgatccttgatgaacctgatattcagtgtaaatgtttcactaacaatatgtgtacattgcagtttggtagaagatgtctttctacctacagcaaatgtttttatagtatatatggctaatactatctatgagtaccttagtaaaatatctctaaaatacaggaaaacctttctgctatggatataaaattatttcatctcaggagactttctagccttactactctcattttaattcatcatattattttgaagaaactactattgaaacacaagacatgaaaacaagaagtgaacagaacatgaaatgaggagcttagaaaaaaaggttaacaataagtatgttgttgaaatgaatttgctgttaatgccatctgaaaagttaaagagttgtagtcaaccttatgaattcattaattaatataacaactttgttgaacacttactgttttttaggaactgaggataccaggtgaacaaaagagtttctgtctttataaagcttataatctagtggtggaacacggacaacaaacatatacctaagatgtgcacgggtgttaatacgtgtgtcttagtctcttcaagctgctttaacagaatgccatagactgggtggcttataaacagcagcgatttatttctcacagttctagaggctggaaagtccaagatcaaatccctagttgatttggtgtctgatcagggcctgcttttttgttcatagatagataccttttctctgtgttttcatatggtggaaagggcaagggagttctctggggcttcttttataaggacactaattccactcatgagaggtctgccttcatgacctaatcaccttccaaaggccccaactctacacaccgttaaattgggcattaggatttaacatatgaattttgaggggacacagactttcagtgcagcaaagataaagtgctatcatggtgatgtaatagaaattgattcagaaagaccagctttggatagggtgaccaggaaaagtttctctgagaatgaggcatttgaattgagactcaagagaagaggagcagccagcaagaaaagagcacgtgaggcaaaagaaatggcaagtgcaaaggtcaggaaattagacagaatttgccatgctggaagaacaaaggaaaggcccagtgtagttcatgttcacttagtgagggtggaagagcataactgaaattggattggtaagcaaaagctatgtcatggaaggtcctccggctcatggtgagaaacgtggattttatcttaagagagcatggtcagccaaatttaagcagaggcataacatgatcaaaattatgtttattaaaaaattgttctggattccctagggtaataggctaaggaaagatgtaagaactgtggaactagttaggagactattgaaataatgcaggaaagagacgatgatgatgacttaggcgggaggttgtttgttaatatataatccactgttattgtggctgcaaatgcaatcctgtgtctttccattgtccatttaaaagcaattttacaaatatcacttttttaaaacagtaactacaatgccataagagcctttttttgttgtaaactactgtggcaagaaattagttttaggtagagaattgcatgtgtacttagctgtgattgtattaggactgttctttggaagacttttattaataatgaattaataatagtgaaggttttctaagcagactctcttgcactgtagtaagtgtttcctatccattatctcatttgatcttcactaaaatcctgtgacatatgtgctgttattatttccatgttgaaaataagaaaactaggggactgagaaggtaaggaacttcccagggtaacaaagataaaaaattatgcatcacaatttgaacctagttctttctgataccacagctcaaaccttaaaaaaatctaaaataccttttattgagaaactacttacttataataaaatgcacagatcttaaatgtattcagtggattttcacagttgcatacacatatgtagctacctccccaaactgaatacaaaatgtttctagcactacagaatgttccttcatgctccttctggtcagttttcccccaacatcctcccactctacagactactatctggttttgatcaccatatgttagttttgccttttcttggacttcatgtgaatggaatagaacaatcataatttttggagtctcatctgtgttgttacttattgtttgttctttcttatggctgaggagtagtagtattttattatatcaatataggtccatttcacctgttgagggacatttagattgtttccagttcttagcaattttatgaataaaccagctatgagcatatatgtactagaatatgttttcatttctattgggtaaatacttaggagtagaattgatggattgtaaggtaagatgtatgtttgcctttttaagaagctgccaaacagttgtctcaagtggttgtaccatttcagtttcctaccagcaatgtatgggaattgcaattgctgtatatcataccagcatttggtattgtcagtctttgttttagccgttctagtgggtgtgaactggtatctcagtgtggttttaatttgcatttccctaaagacaaatgatattgggtcccttttaatgtgtttagtggccatttatataccttttcttttgaagtatttaagacttttgccctttaaaaaatgtgcattatttggatttttattgctgatttctaagaattctttgtatattccagatacaaattcgtgtcagatatatgtattacaaatattttcttccagactgtggtttgcctattcgtttctctagtagtgtgttttttgatgagtagaaatatttaatattgattgaagtccaatttgttttgtctttcatagttactgctttctctttcttaagtaatctttgcctgcttcatagttacaaagaatttcctcttgtgttttcttctagaagatttactttagctttagatttcagtctttgattcatttagaatttacttttgtgtataatatgaggtaaagagcaaagttctttttttttcatgtttgtccagttgttccaacatcattattccctattgaattattttggtgcctttgtcaaattaattggctatgtatgtgtgagtgagtttctggacactgtactgataaatttgtatatccttatgccaatatcacattgtcttgtttactgtcacttaatcaggaagtgaattttattctttttcaagctagttttatctatccgagcttctttcatttttatataaatttacagagagttgtcaatttctttaaaaaataacctgtcctgatgtttctttgaatggcattgaatctctacattaattttgtgagaatgaacctattaatatggagtccttcaatctacatacatggcattatctctcatttatttcatagcccagaataatgcacaagaaagaacacatgagcggagactagttgatcaattacctctagcaaacatagggtctcctctctcttttaaagtctatttaaacaccaattctaagaaaatatgcgtttggtgttaagagagggtatctcatgtgaaagtgagtgagctatacttccttatattaagaggagcggttaaaacttcagaactgtatcgggtttcaaaaaaaattgttttccaaaaaaatgtgcagccctttgactagtaatatattttctgtactagtgaaagtgtgatctctcgtagtttaattcaattacctaataagctgatatgtgatcactagtattctcataaaacatcacataaaaagcaagcagtcgtggtcaggcttggtggctcacacctataatcccagcactttgggaggctgaggtggcaggattgcttgaggcctagggagttcaagaccatcctgggcaacatagtgagaccccatcttgaccaaaaacaaacaaacaaacaaacaaacaaacaaaaattagccaggcatggtaatgtgtgcctgtagccccagctactcagttgggtgaagcaggtggatcacttgagcccaggagtttgaggcttgcagtgagccatgattgtgccactgcaccccagcctgagtaacagagtgagaccccaactcaaaaaaaaaaaaaaaaaaaaaaaagcccaagcaaaacaagcaatcttatgtggaggcagtcagaaagtgctttaaagtcgtgaatagagttgcattttctaagtctaggggaaatgtgtacaacaaaactaatgagagtaaaagcttttgggacttgaattttccagtaagtcaatagggttcagaacattcatctttcaatacttaattttggaggagtaatataatatgtacctcagaggattactgcaaggattagagcaggaaatctatgacaagtgctgagcacattgtttggcataaagaaggatctcaataaacttaaatattttcatctttatctagatccatgacaagttctgggtgcaggggcaggtttttaacttgtttcatctctatgctttcactttagaatgctgttgttgaccatagtattcaaacatcttgcagaagcaccactttcctcaaatgttaatttggttttgatttctactttataggcagatatatatgtatgtatatggtatgatttacttccttagatggtatatatatatctccaaatttagtgtccatttaacataaagactatttttccttttactggacttgaaactattggaacttagaagaatgaaactcagtaaatttttttttctaaatccagttaattacagtagttaatttacagaccatggtatttgttattaacactaaaatataatttagtgttaggtttgttgatagtacatttaaatatacttaggtttgttgataatacatttataagtgatttgttataagcagattaaacctattagcatcaactagaagctacttgtgaactatttagggcaagagaggtttaccttacattagtggcttagaaaggccagagggacttgttcctttataggcaaagtaaatttgacatagaacagagtgcgttcactttttaaagtatattttatattattaggagtaatttattttcattaataaaattcgataggctagagttacaaaatgaaattgaaaagattctttttcacaccctgtttccactctgcaaaaatagttgctggttatctattagtagtaaactgtgtatctttacataattatgtgggcattcatcttttttagcttaattgctaagatatatacatagttatatatacacatgattttgatgctactcaatctgagacccttcctcccacaatctattttcagaattcttacatagtttattttcatttgatgtagtgcatttctagttgcacatcttaagcctattaaattaaaatgggttttaatgcatatctatttttaaattttctgagaaatggatcctttggaaattaaatcgctgaatggagaaaacgatctttatagctaaatgcgagataaagtaaaatgaatgaaaaaacagatttagtatgtcaaagtttgaaaaggcaaagaattttgaccactgtattggttaaagaagaaattttaaaacaaaaaattataggagaatatatatattgttggaagctgttataaaaagaaaagttatcatagtgttaaatgtatgtgctaaatgacctaataacaaaaggaaaaaagatattatctaacgttaccttaaggctgtatgataacagaaattaaccaaggaaagcaagaagaaaacttataaagaacaaaatacaaagacaaataataggaaaaaatcaaaagtatttacagtagaaccaaaagccgcttatttcaaacaaataataaacaaataaccaaaggcatggactaaaaatccaagagattgggaggctttttttttgttttctactttattggtgctttatgcctagagtatagatgtacctggctggcagtaaatgctcggtaaatatttattaaatacattaatatttcttacatattttaatagattaattgaaaatgaaagcaccatgtaataatagataaaatattaactgttataagttaatattgtatacatttatgtattaagcaaagtatacatctcaattccaaacataattttcagagtgaaaacgatacagtaactagtaaaacaatatgccgagaatcgtaaaaagaaaaaaagtataattttaaagacttcaataacaaataattaacaaaacaaatttgtattttcattttgttgtcgaagcccacagttttatataaagtaatccaaaacatacgaaaagtagaaaaatttctatttcattttatgaagaaagtctctttattccaaaatattaacagttcacatgaataaacacagaatccaaaataagagcaaatgaaataacatattgagtagtgttaatatcaggaatgcaaatctaatttaacattaggaattttattaacgtaatacgtaatataacatcaatatgttatataacaaaagtcttaccctgataggtattgaaaaggcaattaataaaatttattcacttcataaagaaaaagtaaatattaattgcagaaacagaaggtttttaaaaatactttaaccttgataacaatcctgtaaatttagtatccttcagtgtttttctaccccattctttgtatgttgcctgaatgctacctatgtcttttatggtgagtaatgtcatagtcaaacagttattggaaatgtataatttcaattggtataattttgctcattttatatatatgtatacatatacacacatataattttttgcagagttttgaaattgttaattgcttataattttcaacactggccagttagcccaattcagataaggagtatagcgtgaaacctcactgatttattttactttgtaggaaaagtagttacaattatttttagtaaagtggccggatgcagtgactcatgcctgtaatcccagcactttgggtggccaaggcgggcagatcacttgaggccatgagttcgaggccagcctggccaacatgatgaaaccccgtatctactaaaaataaaaaatcagccaggcatggtggcacacgcctgtattcccagctagttaggaggctaaggcatgagcatcgcttgaaactgggaggtggaggttgtagtgagccgagatcgtgccactgcattccagcctgggtgacagagtaagactctgtctcaaaaaaaaaaaaaaaaagttatttttggtaaagaaattcatgaaataatattcagtaagcttgtgtttagacactgtaatcttaatgattaataaagtaataaagcaattgtaatttttttgaaactcaaaaaattttatatgtgttttctctttaatcctcaaaacaactctttcttaagagttatagtattattttcattttgtatatgaggggtctagctcagagataataaattacaaagtcgttagagaaagagattcttccccatttttaatatttccttcaaggtaaagggaccttaattagtgcaattagtgaccttctctctctctctcctacttcacttccccttcatctctgctttggtgaaggtgaaatagcttaacgtgattgataaatttgggaagaatgtattaggcaaggggttttggaacaggcttaactgcaaggagcaccaattgggctctgtagtctagaggaactagagtctaggtttcaactctgcagagggaaagctgggttctggctgcatgaccgtacatcttgttttgcccaggacacttccacttgatgtcgtccccaatatgattattcataacaccatatttcactcccttgagtaccccagttggaataataagctatatgttcaccttaataatcctgcataattctagggttcggtattaagaaagcacattgcttgcatataaataaagagccgtgtactttaatattgtctttataagtattattttggcctcagtcagctactccattgttttatttctccatttctgaatctgaggagggaagaggagcatttttgagacccagcaataatttttgattagattagattttcagtgttttactgctttagtaaactttctaatgtactgtgccattccatatgagatatcaaattagaggtcaatttaagcaatttaatttccaaacaacttactcttttaagttatttggcatcatgaagacaaataagttgatgggctattttcaccttttagttgttttggtttaggatttgagaactttggaggaatgtttgaaggtttaatgtagggaagaaaagcaaaaaactttttctatactctcttaagtttgtacatggaaacctgtgaattaaactgacaatcggtaggttaacaagagaaaaatgaatttatgcatgcaacatacatatacatgggcgtgctaagtgatgagtaacttaaagggatcattagaatttggagtttatattcctaacttagtaggggaaaggcagtggggagaaaaggctcctgtgggaagaacaaataggtttctttaagaaagacaagtgggttatttttggtgaacaaacagaagataacatttgttacaatgtttgactgcaccagtacaagtggtctttatatcgtcttagggccagaaaatgcccccagatagaggatttatgataaatttacttttgggctctctgctgggattagaagccaccacaaagagataatttacggcagtcctcatttgttagaagtctttgcttttacttttattcagataagagaaactctgaagaggcttgtgtatctgttgaatcacagatgtcttcagcttaaaataaaatttataccaaccatggagtcccaagtgggtccccacatgaacattggtattcatttactgcaacactctcattttccagcttaggaaacgagggtctggagatgtgacttagacaaagttacatattgtattagtgacacaattggttgtagaatttcccagtcctcaggttcctgggtaaagtgtttttaataatatcccctctctgccttttagggtaggaatagggaacaatcagtgagaattatatttaggtagctgaattagaagagtaaatctgatgtttttatgaaaagctttatttgctatttcttgaatatcaccttaatatctcaacttgatctgtagaattttgatcacaagttacctttccactctcttattactagtaattaaattgaaaattcacctctgttattttgtcacagcctaccgcagatgattatctctaatgagctccttaggtgcagagcctaggtttattccttcctgactgcttagtagtggtatttatagaagtagcgttaaagtgagtaagcgtatgtaattcttatatttacctaagtgaagtttggaaatgaagttttttatgtgtatttcagcctgtttatccttgcatatgtaaaccaattacatcttaacatttgtttctggagaacaggccagaaacaaaatattcacttgtacttaatatgttgtaataatgggcatattcaataaaatatgcactggtaatacaattgggcatcatatctgattggatgaaacagaatatgctaaatgtgatcatttttctgtcacagaatttcatattgagaatatgccagttattttgaagtcagtatatttgctgggattacttggttctgcttgaaaggatagtgggatttttttttctgtgattatgatttctattgttaaaattattattttttgcttttgcatctaaatatgccctttcataagcagctgaaataatctggtcagacaataacccatttctggttaatttgatattagcttttttttgaaatttgaggatactttttagcatttatagatggccaatatcagattcaaatcaccagtcttcttaagaggattttaatgcattcccacttttaaatattctcagtatgtttactgctctcagtagtgggatgtgttgattctgaattgctaaatctattagaaggcgtttttttaaaatgtgtgagtgtgtgtgtgtgtgtgtgtgtgtgagaatgtgattgttgattttctttaccaaaaattggtatttgattagagatgggaaatacctttgagtacttttaaaaatgcaacttaaatttggttactactactgagttgttaatcagaaccctttaactggtggcacaggtaaatcatggccaacaagacctgtggccatccccaaatagactaatgatttgtgaccccttcaaatgctagacatttgaacaattaatattatctgagaactgttgatagcaactcggcttgtcatctgctatcatgagtaatgtagctttgcctttacatttgcaactctgttgtccaaaccaaaatttcacagttaaaatctctgtgatccttagaatataatttagtattattctaatcaatcacctctggttataggagcctgaagggttttaatcttcaacttcaagctacttagctaagtattctttccagcttcttatcagttctgtagtctctctgagttctgtatctttctattcggttacattttaggtgatgttttagatcccatagagatcagcgctttgagtaggtacttggcttcattattcttttatttaatttgggatcccatataataaaatgtgactaaacttagggtttgaactagatgttaaaagtgagaacagtgatcttagaggtttcttccttccccatcccccaagggggccttaaatttttagagttagcttgatagtgttttgtgaatcatacgtatttagctagttaactaccagttgtgttcatttccattctgtttcaaagtagtgctttgaggattgtcaaaagacaaattttcaacaaatttagtttaaagatctaattggcttttaatagcaattcacgaattgagtagcatctcactgaaaaatttagaaaagttgctctgaagggcatggtagaatggtcagtttttataagatagcttgagcaagaacaggaaaacagcataatatgaaaagcaaattggttaatatcaggttacttcaggttactgggttaaagcagaggggacttaccatgttggccagaactggcctatttgagaatttggctatcatctctctcctgatttctgaacattagtatgagggactccattttggtttggtctattccgttgggtcctagtacaggatctcagtccaaatcaatggcttcctataaattttatttaacaggaataaaggatgcaagacatagggaaatttcaagatgacaaacgtgaagctatataaataatcacataaattattcattaacagtttatgtttatcttgaatttactttgttatcactccattttttacttgagcatagatgttagcatattgttaaattgttatctatttcattcatttttaatttagattttcactgttttttcttaatatttagtagtatttaggtttctttctcaaaaaaatttgtcactatatccttttgtctaaaatgttgtctaactttagataaaagcatatagtgacaaaattttcttgaaaccacctttgcaaaaattatagctgagaaaattattacagtgaaaaagattggacctaaccaactcttatcttgcttctaacttccaagctgtccttgttcatccctgggcataggccgaactaacttcgggaggaacttagtttatagtttagctgtgaaacaaagatgaaaacagccctttcccaaacaaaacccttccctgcctggggactagagtgcctttgcaggactaacaaacgaactagccacaatattagaaattatggtttgggagtcatacagttggaggctgcaagattctaaaccttcccaaattgctcctggtgataacatcactattgtaaaacctaagatcatagtttgagatattttgcagaccctgcactgatggatcatctggcatcacttagattgacaaactggctcatctggtcttgtggccaccacccaggaattgattcagtacaagaggacagcttcaactccctgtgatttcatctctgacctgaccaatcagcacttcccactttctgacaccctacctaccaaattatccttaaaaaccctgatccccaagttttggggaagactgatttgagtaataataaaactctggtctttattattaagtagtaatacaactcaaataagactgatttgaataacaataaaaatagctggctctgtatgaattaaactctctattgcaatttccctctcttggtaaatcttctctgtctaggcagcaggtaaagaaaacccattgggcagttataatatttatgtacatcttttgtttctattctgcttgaaaaataattcccatagatttgctttaaaaatttaagtcttctccttgtgccacttaacagtattaattttattgaagactgttgtgaaaaaagttaatggaccctcaagagcatgatatatctaatggttaacagcataaataactgtgatatagtaggttatactcttaggtctatattataattgaggtcagcaatctaactttaatatagttatattaatataattctgtaagtatagctttaaggtttaattatttaactaagactattacgaaggaaataaaaatagttaagcatacgaacaattctctctccagtaatcaaagattttaggaatgaaaattcaactctctccaccatctttgctatttaaaattagagaatagagatttagtagaatcatttcaagtggtattcacaaaaaggtatttgcctttaccttaacactcacttttggagataaagattttatttttcctttgcttatgtacaataaaagtacagttgagttatatatttataactcaagcttcaggcagtaccaagtcctggaattttttaagaattcaatcatgagcattctataaaagttgattatacgagattatccaaaaggttcctgtaaatcttactttatcacctacattttaaaaactcatattgggtagagaccagcaaagaaagtttttctgcaagtaggatttttctcttatttttttaataaacattttctttggctattgatactgtttctaattgattttataaatgaatagaaaagataagagaattctggaaaatataaactactcacaaattaaaatttattgctctttgagacatctgcctttccctcttaatttgtgatgataattgctgttctgagagggacagaaaaaacatatcccagtggcttatttagcaaaacactagaatgtttatttgaacctgatcgcttttaaaacttggaaaaggtaaaataggtcagaaagatgtaatcttttatgggaattccttcaaacatttaattcccaatattaaatgaaaataattggaacacaaagagcttggaacactattcacttgttcaattttgtgttcataactgtatcattgggttgtttttgttttggtgtgcaaaatattcctaaatggcaccaaacatgaatttgtagggattcagttttagaaacacataaagctaaacattctgctcattaccatgtgtcctcctttatatcactaagttcactttgctggatgttactacttttatgcagtaattttattaagtatatcaaaggaaatatttcaagttagagatgagttctacaggcttgtgtgtatgtctttttttttttttttttttttttggatggagtcttgctctgtcacccaggctggagtacagtggcataatctcagctcactacaacctccacctcccaggttcaagcgattctcctgcctcagcctccagagtaactgggactacaggtgtgcaccaccacatgtggctaatttttgtattttttgtagagacaggggttttgccatgttggtgaggctggtctcaaactcctgacctgaagtgacccactcgccttggcctcccaaagtgctgggatttcaggtgtgagccaccatgcccagcccaagcttgtgatttgttcaagattcatcaactgacaagaaaatgtcaatcaagtaacagactactttcttttagtgtataatagaatgatacttggctcttgacatttgtcttttttttgtacaatactgtcatgacagccaacacacttgtcttttgattagtaaaagctgggggcttgatagaaatcgtagactaaatttaactagtacagcaaattgagttgcgatccatatctgtgaatcttagaaaatttgttcttaatatttttgtactactgtgagcaaatgactgaagtggagcaattgtagagaaggttgatgcaaatacatacttagaagcctagtacctgaaataaactaggagcaaattcttcagtgacttcagtctccggtgatgtggcacaagtatggctttttctctgtttctggcattaggcttttcagagaaactaatgggagtaatggttctctaggtgtgtaataattttttatgactcttgaaattactccaaaacaaggtctccctatcagtgatttgtggaatagtagtgccctggaaatgccagtaagttgttctgagaaaagagaaattacttgatcaagcgaatttgagaaactttttgttacacaatcagctgtatactgtttcactgtaggatatctcagagtcaaaactaatgacatatattgtgaattgctaagaaggaggtatacagttcacagcatttcccaaaccgacttgatcctggaaaccacctataacatctagtaagatgagaatgctccatagaaattaattgaggaatgttatctaaaaacctaactatatattaatgtatactttctagttactgttgaatctaatttatattcaaagtttaaaaaatgttggtagaaataacttgataaaattgaatggtcttttatgatataaactcatagcatatgagaataaaaggaacaccacttaatagtaactaccaaaaactctaaaaaataatatttaaaaatgaaacctagaaacatttcctttaaattaaggaagaagagaagaatgctcactgttaaaaggtttcatactggaaaagaagaaacaaattctcaatatttgcagaggtccaggagaatgtacagagcaatcttcaatatcaacaaaagttgctagatcaagatcaatataaaaaattaagtgttcctatacacctaaccatacagttacgaagggtaattttaaaaagagaccatgtagaaattacataaaagaatgtaaagtaattgagaagaaatctaataaaggttgtagaagatcttttatgaagaaaattttaaagtatcattgaaagctatatctgtatggatgggtaagagtcagtatgtttaaaatgacaagtctccccaaattaatctataaattcaataaaattttagttgcaaaataccataagggttttcatataacttgataatgtagggaaggtaaaatttttctctaaccccctgtggtctccagctggtactgatataagacagatcaacaggagaaaaacatacacattttatttacatgtgcctgtaaacaaaatgctctcacaagaaaaatggagacccaaagaaatgactagctctaaatgcttacatactatgtggaacaaagagtggcaattgtagaaaagtgactaggaagagaggggttagtttaagaaggtctgtttgtacagatttctttcagccttaactcccctcctcttgtgatgagactatttctcttctcctggtatagggaaggtatgggagtttcaactcctgctttatgaagaaaagggaaaatcagagtgcatctcttgcacctgctgtttttcaggtgcctttagctcaaaatgatcaacatgtcaaatggtgtattttgggatggcatcctgaacttgttcagtagataagttgatttatgtggaataataagggccaaaaatagcaaagataatttttaaaaagaagaagaatggagtgagaagcagcggaattggagtgtaattgttataccagatacccaaacttacttgtggtaaataaaagaatgtggtattggtacagggaaaaggaaacatactgatatggcagaatagaagagagcactgaaaatggatccacatatgtgggaacttgatgtttcttaaaggtggtatcataaactaatagaaatagggaccactgaatacatgataaattagtttatccacagggaaaaagataaaacagacactatttgaaactttaccccaaaagactaaatatgaaaagtaaaatggtaaagcttttagaaacaagttacaacaagttatagaagagtatctgtatgatatagtggtaatgaaggatatatttgttttaaaaactcacaaaaaacagatgccatcagtaaaaaattaatagaacttaccacattaagatacaaaaaaaaccaaataaatgcacccccccaaaaaaaaagtttgtattaccatgaagaaagaatatgctacatgtaaatatgtaagccacagcctgagagaaaaaaaatatcacatgtgaaggataggtacccaggctattaaaaaacaaaaattctgcatattgataagaaaaagacagaagtccttatagaaaaaatgaggaaaggataagaactatcacataagaattgattgaagttgtcagtaattatatgaaaagatgttcaatgatatgagtaatgttaaaaaatgcaggttgacaaaaagagagtccaggtcacatccattagattggcagctactggctgccaatattattattaaagagtcatattaataatactatatataatattgttatactatatataatattgttatcatattatatataataatgttgttatattacatataataatgcaaactatcacaagtttacatttaattatatataatataataatattaatattaatgtcatgtaacacttattgttggggaaagcatggagaaacaaacttgtacccatttctgcaggagtatagatttgcaaagtcactttgaaaaccatttgataatacctagaaaaattgacaattttcattcatatactcaaggattttcctactagtttacaatgtaaggaaactctcacaattgtgtataagtaggcctgtacagagttggtcattcaggactgtttgtaaatgagggaaaaagtgaacacaatttaaccatctcctcagtagggtaatgcctaaaataaactgtgatatacagttatttagtaaaacattattcaatggttaaaatgaggaaatttatttatttatatcaacatggttaatctggaaattagagtgagtaattaaagtttcagaggcacacttacagtataataccatttctatgaaattttaaatgcagaaaacagtattgcatatttgtggatatacatgtatagtgaaagactaaaaacatgcatgggacttatacctatgcattaaaaaaatattttatccctaggtagaaaggaaggaaaaagatggaggcttgagggtttatgtatatatatgactttttttcccttttttttctttttggaaacaaaaatagggaaatcttaatattggtttaaacatggcggtggataaatgtttttgttatatattttttacgtgataaaactttcactagaatttaaattaaaaaaaattcaaagtattcacagatttccatttttacaatttcagaaataggcataggaagaggagccgttttcagttgatcactgtagctagtgccttgaagatgaatgtgccttgaaactttcaaattatgtaatttgaggtgaatgaagtaatggtttatagcttttgctgatttgttaatatttaattgggccaggaacagttcaagtctttaaatagaagtatatttgtacaatatccagcttagcatccagcttgggaaacactatttcccatcagctttaaagcataagtctataaataatatatgaatttgaaccttattctaaagatagtgagagatttaaaataacagtaaacaaccatagtcttcctgggtcattcttggacacatttttgagtaggtcaaagttaattcttggctattctgggcttttctcaagtttgcttctatcccttagagattgatggctgcatcaataggtgatacattcacatacttgaaagtataagtgactcaggatgcataatgagttttatctctaaatgatacttagattttaagaaagttcaatgacttacactaaaagaatgaatttctaaaagtggaagtttaaggcttgttcattggagtggtgggtgggggtaggtgtttagacaagggccttcaccagacctcccagttccatcccctagtgagtggctgctctacttaagagatcagtgtttgttctttttacctaggaaaataaagtgagagaacaagtatatttaatgaaaatggtaacgttattttaaaaaattataaattagagaccaattagaaatcacacaacctcatcactctgaaaaatattttgtattcagatgttctttctaagcatagaatgaagtctaagctgagatgtcaccgtggagagttagtgaaggccctgtgataggttttcaataagttaaatgtagggtccatttcactgtgatagccgttataagtaaattcctagatcatttattttcataggtcaacataaaggctagttccatgttgatattactctttgcagaataaccatttcattgtaaaccaatattattgtgtcatttcaatttacttttgcagttgctttgaggccaaactttatcaactcatttaaatatctcttttagctcaaataggcacaatctccttagtaaaaatatgttcacatctatacaaatagatattttagcttttagtttaggttttgaatttatttctcagtattattttcttttttaagcttattacagtttccattgagacagttggggtaaagggagatttagtggcattatctatgtgcatgttagtattttaagaatgaattgtgaaggataagttgggaacttctaaactgtgcatacatataggctaatatattttcaactttaagtatgtatgataagatagataatataatgaaacataatagatgatgtatatagtatatttatagatttactaatatataattatatttttatatttaataaaatataataaatttatattttttgtaaattcattgaaatctaaaattcagtgaattttattcaacctaaaggctctttaacgtatgtcaggtattagaatttaaaacaagatagcacaactttgtagcaattccacgagattcagatttcaaagagtttgagctagaaagtatttattatgtagaacacattccagaattagtccaaagaagacatgcattagagaaacattcgatctcttactattgaagttgtgtacttgatagatacttgagagcttattaaagcagtttcccatttttcagtatgaagctggtatacctaaatcagcaatctttgattctatattttctctgaaaataggacaaactcaccttcctattctggtattgccttgcctagctgctgaagttgtagtggcagcaacagctgagacagcagcaatatatcaatagaaatagtctgtaggatggaactgcagccacacacaagatctaagacttgtctaaaatttaatacagacattgctttgctatatcaatctaaataattatcccttaattatcatccctttattttcaatgtttcttgaataaaaggaaaggaataatcgattgatagctgtgattgttgtgtgttgtgaacagtagttccaggtgtgtgccaaagagcaaggtagtttattgtctttgtcagaggttagaaatacatggtctcagatagtcctaggagctcagaaggtctctgtattaataattttagttccttggcttttgttcttccagtcataataaacagtttgcatatcttaaatttgctccagaaacctgatatgaatatcctctaaattacacaattgtcctttttcactgggctggttagtgatgagtttccagctcaggtcctatactctaggaaataaatataacttaacctgctatcatctacatatatgtcattgagagcttttgacaggaatttattcacaaatatgtaagtcttgtcaaaataccctagtttttaaatatcctgaaatgtaagaatctcggaaaatctgtagttctgagattctggtgaacccagagcgattggagccttaaatagttttcttccaaatatcctaatttctttctctgttttgtttctcataacagaatcaaaccatggaaataaatgaagttaaagataaaagtgcaggtttgccagtcccaccacccccgtgcctggcattaaattaaaaataaatgccattctaaaacctggagctgcttttgctcataaaagggagttctacctagttaactcctgtttattttctggggcattaatattcagtgtgaagtctctcatatatatatatatatatatatatatatatatatatcgttcacggcttttagcttttcactctactccacatatgaaagcctccttgaaagcagagcagattggaatattgtttattcatatagttaccttatggcatttggcatttctgactctttggaaccagggacataggaatttggaagattgtaagatagtgattctctagtacagcctgcttacattcagccaatcagcccccaaaatatttaaatcattccaccctgtacctttcaccttctaagtacgtatacccatatgttaaaaacaatcttcccttttctactaattttttctgtttgtcttgtgttgtaattgaattgcaagatgtgggacaagtattttaaacactttttttttcatttctggtcctgatataattcagtgaatattaatatatttaagttaaaacagataatattcttaagtcataaaaaatgataatcttaatttatctggaattgagaaaaacatttattttggattacaagtaaaatttctctgcaggaaaagctagattataatgtggatactcaaagaattgagatgattttgagagaatgtaatttatttcacagatgatggagtgatttattcttaaaaactaaatggaaaaaggattttctgtctttatagccaaatcagcttactgtatcaatatttttctgtccttaaaatttcacatagtttagttccattaaaaaaacaaacaaacaaacttctgttttgggccaggcgcggtggttcacacctgtaatcccagcactttgggaggccaaggtgggtagatcacttgaggccaggagttcaagaccagcctggccaacatggtgaaactttatctctactaaaaatacaaaaactagccagacatggtgcatgcctgtagtctcagctacttaggaggctgaggtgggagaattgcttgaacccgggaggcggaggttgcagtgagccgagattacgccactgcactccagcttggggcacagagcaagactgtctcaaaaaacaacaaaaagaacaacaacaacaaaaccttttattttgaagggaagaaaacgtgttcagtttgatagcacatttatgagtagagtgtagactgtcaggaatatttagctttttaaaaaagattattcctacagctgaggaaaaaaaaactttctcccactcttgatgtgaaaattactaggtgatttgcatgtgagaataattttactgtagcatctgagaagtggtctgaatgaagaggtgagcccagttagttaccaggcaacaggtggctaaaggacatgaactctggcaaacatcaccagttcctcgttcattttattgtcagttggagactctccagccatgcagcccagttcttgagaattgtttatagaattgtttgcttctgaaggaatttgtaaccacattttgtttgatgaatactaaacaccttagaagccttctgattatactggcattgactttgtcatgaaccacttaaaaagtgagccatgatgactagtaacacaaatgtgggacccttttggatgaccacaatttgcctataatatagaaatatggtgctattcaaaaaaaagctcagacctgtgaacaccagggaagggggagagaatgggataggaaattacagactggagaagggactttttttttatggttggtatacttatactttcccacttttcagttgtgtgaataatatgagcaaaaattcagggaagtttcatggtgttgtatcttcattccttttggaaaattcaaaatcttatgtattgtattcaccagagaatggaagggaactaacaactgagcctctaatattccagagaattggtatcagatgctttatgcagattatctcatttttattatcacagcacttagacaggtagatactgttacagtctccttctacagacaatgccactagagagctgaagcattctgaggttaaaaatcttacctattgcctcacattatggtttgatttacagcaattttcgttctattgccccctatcatttggagtaattgactgtgttcaataatacttaatagttcctttatgcattttagtatatttgtcttgataaagtatatgcagaaattggagttaaaaaggatcttgtaaatcagattatagttctcactcctgtacttgagccagcctaggtacattaaatatctgtctagtttaaataattctagaaaagattccacaattttccttagtaacccaaatatgtcattgccttgatttaagccattttcttctggtttgtcctaaatagagatggagaacagctggttaccattcccaatataataacccatatatttctagaacattataaagcattccctcaggtttttcttcacagcctgactccttgtatccttttgatctttcttctttttccaaccctttcatcatctgtgtgggcttccttcctttttatttctctgcattccctttcagatgtggagatcataactgggcatggatagccagcatgagtcaagcagtgatgagtaaaataagaaacttacctcagagtttctaaactaattttctatttatgaaccccagtaatgtgcttgcttaaaacacaacgagaatggtggctcgctatcatatttcacttgtaggtctgctatggtacaaggtgtgttttttctgctacatttcaattctcgcacgtggccagcctttaccttgtatgctgtgtcttatattccagaacatattattttgcaaaatgacaggaaagacttgcataagtatgaaggatattttgatgtgaaaaaaaaaactttttaaaagattttaatgtattcaaagtgattgtgttgttaaaaatgctttctttctttacactgggaaataacttatgcctgaatggttgataatgcaactgtctgaatcatttcattaattacgtagagttttctaatatactaaccccattttaaaagcacttctaatccaccaaagttatttctttgtatctattttatttgctgatgggaatttaataagcttgccatttattacattacttattttactaaggaaatgttaaatagcactaaatagtaggcaaagttgtagccataccatcctttaaaactcactctaaaatgtacatattttgttaaaatagtgagccacatttccttttcacttcagagcctatatagtttataaaatctcattgtttcttaggagttactagcatagtacccctttcagttttaacttttctcattttgttactccacgttatgtcagtaatttaactttttagttatagacaaggggtcaaattatcatttttatttagggaatgtcctattttcacatgacttcaacagaatagtttctgttagtgcacctaccattttcattttgtctcttacagtgttacacatttatagatttataatttgagtttttcacacatgcttttttagtttaattaaaagttcatgttcattcagtaagtgctgtacagtacttgagaggatgttcatcactggtttaataatactagttcagtccttgatagatgttagcttttctccataagtcctacaattagccattttgtatagaaaagaatctgtggctcagtgcagctattggaaaagcacttcaaaatttcttaactactttaccagccaattagcatctcctttactcatgaggagcaattttctctctttagccttgatcttaacatgagacacaccgcccgtgtctctgtctcctgcccccaccacatgcagaaagttatatggtgttacaggtttttggagctcttccccacaactatgccagggttccttgctttgagaaggcttcactgagactgatagaatggttttcttctttgcattcttgatgcatacattacgtccttttaaaatgttgaggaggcttattagcaagagaaatatatttcttcccattaaatttcattcactatcaatttttaagaaaatacagtctccagtctaaggagatctatggagaaagcaaaagctacctttgaatagtctcttagaagagcacatttgttaaaactttttattttgtaacaattgtacatttatgagaaagctgaaaagatagtacagaatgttctcatatacctagcgcttagttcagaactaaaaacttttcaagaccagctagcttacattgtctccttcttgaaggccagatactggctaccttttaaaagcaaatgcaaaggcctttgggtggttccttgtgtgtaggtagttgtagtgtggagtatatagctgctgaatgcagaaatcagagaacctgaggcatctaaacaagcttttgaagtagggagtgctaggctccatttaccacttttctttttttttttttttttgagatggagtctcactttgtcccccaggctgaagtgcagtggggtgatctcagctcaccgcaagctccgcctcctgggttcactacattctcctgcctcagcctccagagtagctaggactacaggcgcctgcctccacgcccggctaattttttttttttttttgtatttgtagtagagatagggtttcaccatgttagccaggatggtctcgatcctggcctcccaaagtgctgggattacaggcgtgagccaccgtgcctggccggaatctaccactttttaaggaggaagaggtatttctggaaaccaccctgatatctgattaaatataacttggtaacagcaactgagcgccaaagaaatctgctcttcatttttttttttaacctgccatagtttgtttaaccctggttctaacttttgacaattcttactttattcaggcagcttgttcttgtgtagtataacttccagaactgtaaaagcctcgttaataataccttcttggtcatttaatttcagtgctttatttttcactgataaatttgatctagtttttagtgaaaaggttcttaacctagagtaaataaacttttgtggattcacggtgggctttatagtgtgtatgagaatttgaattttcctgaggatctgtaggttctatgactgttttcaagagtgaatgcaatcactctctcccttctcacttccttctcaaatagtaacctttctcctcagaaaatgtcaagtaaattaggatgatgttccacagtactaatgggatttaaatgtgcatttattctctgttggtatacattacaatatacgtgtttctagtaagaataaaatgtgattatggacttgctttaaataaaatgaatttgggataataaaacttaaattgctagtgaggaaaattaattttctcttgttcttatataaaacaataaagtcaatttttttagtaaaatatgccagaatatcccagtacaatcaaatagcttataataatgacatttcagtaggcacaaggaaaaaaaattgcagattatcttattttcattctagaattgttaaggacataaaatctgagaagcttgttagattattgagaggggaactgatagaaatgataatcttatatatttatagaaaatacttaaatttcacttggtattcctctgacttccagataaacactatgggaaagaaggccctgtgattctttttaagaataatactgtgcttctaaggctactttatatcaattatgttttctgatgaatcacaaaatgtgattgtacaaaaacaagcaaaaaggttttcaggtatttgagatttaagaagccatcattttgccacatgaagtacctggttcttaaaaaaaaaaaaaaaaaaaaggtcataagaaatagaaagctgcaaccatggcagaaattcaaaatatactttgagaaaatacaccctccattttgtgctttctataaaatagatcatccattcatcatgaaagattgtgcacttcttatccagttgtagtgttattcctgttgcatcccaaatttatttccttcattcagagggtatttgtaaaaagaaatacatctttaaaagtccaaacattttaacttaaaaaattttgattttaaagaatcaacagtgcattgaagaagttcttataggtttggtgaccagttaaaacctaatccctggccaggcgtggtggctcacgtcagactttgggaggccaaggctggaggattgcttgagcccaggagttcaagaccagcctgggcaacatagcaataccgcatctctacaaataaaaaagtcagttgggcatagtggctcacgcgtgtgatcccatctactcgggaggctgaggtggaaaaattgtttgagtttgggccagtcaaagcttcagtgaattgtgattgtaccactgtactccatccagcctggacatcagagcaagaccctgtcttaagacaaaagccacaaaaaacacaaaacagacctaacctatttttaaaattttactgtagcattttctctacaccactaatataccacattgttattatatcatctatctgtatcactcactgaaccctcgactacttgagggtgaaaattcaatcctattaaatctgtattctcatatttagcacaaatcaatctgtattctcaacagctagaactcagtgagtactgtttaaatgaacaaattcacatttatcaaaacatgctcccctattttctttagctgtgccgtccagtatagcagctactggctgtatgtagctagtgagcacttaaaatgaaatgtgtctagtctgaattaagatttgatgtaaatatgaaatacacactagatttccaagattttgaatgtaaaatcacttatgtatatatatatattttaagataagagtctcgttctgtcacccaggatggtattcagttgcacaatcacagctcactgtagcctctgcctcctgggttctcatgactcagcttcctgagtagctgggattacaggtgcataccaccatgcctagctaattttgtatgtttagtagagatgagatttcgccatgttggccaagctgatcttgaactcctgatctcaagtaatccacctgcctcagccttccaaagtgctgggattacagatgtgagccactgtgcccaaccaatattttcatattaattccgtgttgaaataagaatattttttattaaatacaatataccattaaaattatatatttttttgctttttgaaatgtggctaccagatgatttaaagttatatatgtggtttgcatttgtggcttgcattaaatttccattcaatagtgctattcttaagcaaaagttggcaaatgatggtccctttggccatatctgtcttgtttttatatggccagtaagctaagaatgacttttacatttttaaaggattgtaaataaaaaatgcatgtgcaccagagaccgtatgtgacatgcgaagcctagaatatttgctgtctggtccttaatataaaaaagtttgcttacccttgttctaaagaagttatgagggtagaactcatggaccttagcctctagcatcttacactctagtgaaagtaacctcttagtaatgttacataatggaagtgaaattttattaagtgacagtattatgaatgtattcaggcattgtatgatatagaagtacactagaggggatcttgaaggatggaacaatttgagcagaaaagagtgataaaatagtgatgcactccccagatcccccttcaaagaactactaattgagctaggcatggtggctcacatctatagtgtcaccactttgggagaccgaggaaggcagatcacatgaacccaggagttccagtctagcctgggcaacatggtgaaaccccatctctacaaaaatttgctgggcatcatggcgcatgcctgtggtcccagctactctagaggctgaggtaaaaggatcacctgagcctagggaggacaaggctacagtgagccatatcaggccactgaactccatcctggacaacagagtgagatcctgtttcaaaaaaaaacaaaacaacaacaacaacataaaacctacgtacggtctcagctgctttgtaaagaggccccttgtccaaggtcataactttcccagggtggcccatattcagtgacgaatggcaggggaggtatgaaggtcccatcattttagctaacctgagacaactttgggattctgtattttagctccagagctccttaaggtgttggccaattttccttggaccagtgctttggcctagcttctctccctgttcaattctgcacccttttgcttctttactgaggttctgatcccaagggaattctctaatcaacattttgcataccacaccccatctcagagtctgctgttactgggagaatccaaccttcaatgggcaaaaagatgaatagcattccaattgttgagagttaagtaaacaaagagacagagggaaaaaataaaaaattcttttggaggtgaatgagattaatgacctgaatagcccacagtgtctacgtttgaaatgataagctataagattgcccaaaaggctttatcctggggacagcagaaagcttttggagcagggatgtgacatgaagaaaacagtgctttagaagaattaatctagtaaagacaaatgggattatagggaacagaaactgttaaagaaaaatatatccatttgtctgctaatttttttttatcagtgcctgatttcatgcatcatcagtaagtgatagttgaatacgttgtttaactaaaaccttattagttgaaatttgagaacttgaaattactctgatgatggactgtgatggatatttcctgaaggatggatcaggttcctttcccttagtctattcctgaagagggtaggaaggatacccttcaagggtgtcctaggctcatctaaagggtggcctggcattttgcccactccagttttccaaataccagcagacacagctgagcctattcttgccagttagctatgattgctttcttttccttttctgcagagaaaacagagttgcccacagccagcgtcaggaggagggaaagtgaactgtgtggtcaccctagagaggtagctgaagcagtttacctgggacctcctgtgtttgtttgtttcacagtcttacactactctggttttgaggaaagtgtttttttatttttgttgttttttctcaatttgaaggagttggttatttgatagtgctatttaaagctaaggaggagggccctttgttaacaaggttgggaagtgtggcacaagactaccttttagaatcatgcccacagagccagcaggagttgaaatagcctactttcttaccactgttaccgccttgagaactgaacaagaaataaatattttgtcagtatatggtgatttttctcaacccgaaagaatttatccctccttggtctttattatgaattggtagaatatactttacttaaattttattgacaaaagtaaagatggacaatatacaattatgagcttattaaaaataacccataacccttcttgggggcagggaaatggttgcctctttaaagttagcaggttttctttggttcctttttgaaaagttgcctcaatcttgactggctttaatcagtaactctgaaataaattcaatttagttgcccgttggatattacatacttgcgtttccacagaaacaatttagtaaaatttgatattcaaaaagtaccagatggagatattatagacaagcaggaatgtaggatgcttaagtacatagtcatttgaaatgaaataaacaagtagtagaactatcttcttaacatgactcataattcctaaggaacatttgtattatcaaagtacctagtagttttctaaaagaatgactgtcttttgctcataaatttatttttaaaagttagtgccttggtttatcaaaatacaagttaagacatgtttatatcataatgaatgcagatacataggattgagtttatttcagtttgcattagaacaatttaatctcaacattcaaaatgtatgtactatgtatatactatattggagttcccacaatgtgttttgttttgttattttgatgtggggctgttttttattccccataaatctgatctgattatttttcttgatgatgggcagaaaatgtttatagattatgtaaatcactgattaggcatagagggtgactggaaagtggggcagagtggaagagagtagaaacgtggtagtgtcctctgtcttctagagcttctagttgatgttctgtgagagccgacctcttagtaaaccttagattatatgcttcagtatccacaacataatgttaaaggaatcaatagcacttaaatatgtcacttttttctgagaatacattgtctggaaaggtaaagccttggtagttcaggtatgtgggtggtatcatagatattaaacaaaagaaaaaactatcagataaacaaaaccaaagtagccatttttcatatggtttttactttaattccatggcctatgagagatataccatccccagatattttccagcaaacctcttctgtactctgttcaggttggctcctcagtcaatcccttttagctgcctttgccagtagataagcccagggatcacattatatgtgttctcagttgatggaataccactgagaaacatcatttcttctaggcaatttggcaatatctatccaatggaaatatagatataaccattgctccagaaggcatacttctagaatttattatccggacataatcccaaaaatgtagaaaaagtgaacatgaaattcccctcttctccacccctggcgtccttaatttcactctccaaagtgaaattgctatctgcatgtcttttcagacatgttttatgacaggtgatatagctatatacccattttttaatttatgtaaattggatcacactctgtaaactgttctgcaattagcttctttcatccaacatgtcatatacctatcacaaaatatgtttggaaagacagatggtaacacctttggagaatgggattaaaggagccaggggtggagaagaagggattttcttggttactttttcttttctctactgtttgagttgttttagcagtaaatatatttgtaaaatattttaaattaaaatacaaactactagaaaataaaagtgtgtaagataataataatgaggatagctaacattttattgagttcttacaatggaccagacactgctgtatacatatggcatgtgcttttcctcattaaattatcacagaaactgtacaaggtacatctattgagatccccattttacggatgatgaatttgaggcacagagagatctttggttacatgtccaagtcaatgtatgagaaaagagtcaaataagagcattgatatggaatatagatggtatccatgatggtttgacttaatgatttttcagctttattatggtgcaaaagtgatacacattgagtagaaactgtaatttgattaaccatacaaccattttatttttcatttttagtgtagtattcaataaattacatgagatattcagtactttattataaaataggcttcgtgctagatgatgtaggctaatgaaagtgttctgagcatgttttaaggtaggctaggttaagctgtgatgttcagttaagttagatgtattaaatgcattctcgacttagcaatatttttaacttctgatgggtttattgggatgtaactctataataagttgaggaacatctgtactgccatttataaatgatttctcctgtgtgatccagaagagtaaacattgtgactcgctagttttgtgagcagaaaggaagaaggtgggttcttttaaacaccatgacttctgcatttgttcttcggagtttaattcaaggagaaaatgggctatttcattaattccaaggacttctatttgagggagtcattttcagaggaaaaaaatcatctatgctttggaattttttttaggtatcttaaaacaggtattatatgagtcatttctcataagaactggcttagtatagtaagaaagactccttctcatattttccaagattattggtgggttgagagatgtcagcaaatgatttcctctgttgcaatagttatccaagtacagaaagaagaaaatatatagtaggccaggcgtttgaaagtattttagaatagcatttcctttattcaacaaatatttattgtgtacctcagaaagttataattaatatatttttacattcaaattcaaactcctggctcttgaaaatctccataatctcttccctttttgtctgttaagctcttcctccacttttccaacaaactgcatctatttaggctggtttcttgatcattcttctgtaactatctatgtccttaagcacagggattatctgttggttcttagtgcctctggtgcctatagcatgggaggcttagaatggctagtgaatgaatgagtgaataaacacattcttttttgtctccatgctcttgcatatacatgtttccatatgtagattttgccttcccttctttcttcaaaaccttgagaccagagttagtgtgcctatagtgagaccctcttccagtacgactgacctcctggctcagatgcaacaggtctctactgtttcctgtaccaaatcaagactccttggacattgagggacattgtgcttctttgtatatccaagtgttagttcttattatgctgcttttcatactacctcaaaacgttcatatgcattaccttctctgtactcctaatgggaccatctttccattagatgcaggggatatgaacatgacctctggagagatgacctgagttagaattctgactcttctacttcctagctttgtgaaggtttcttaaaatttctacagttcagttccctcctctgggaaagaatgaaagagaagcctgccttttggaattatgtgaggattgagtaatctattaaagtgcttagaacagtacctggcatattgtaagcattcaaatgttagccattattactgtgcggcttctgtgtatattttatctcatccgtgatgaagatgagaaggcaagggctgctcctggcccctacaaatacacttacctaatagctattatcaatagatattagaaggtgggtaataacaacccttgagaagaccagggagatgactgaagattgattttgggtgattttttatgtagagactttaattcatctctcttgcttcttaatggatccaccaacttaataaaaaataattattgattgttatatgtgttagacaccattctaggtcctggtgatataccagggatcaaaacagaagaaaatgcctacctccatggagcttacatttcagtcctaagtaaactagaagtatgtgagatggtaatagggctgtggagaagaatgatgcaagggaagggggctaaggagtatatgtgtatgtgtgtgtgtgtgtgtgtgtgtgtgtgtgtgtctgtgtgtctgtgtgtctgtctgtcaagtggtgtgcgttgcaattttaaatatgatggcttagcaaagacctcccttagtatggtgcatttgagacaagttttgaatgaggtaaaggaatagccatgtggatatctgtggcaagagcttcctaagagttgtcaggaggtgcaaaggtcctgagttagtagcatacgtaatatgctcaaagagaagcaaggagaccagtgtgtttggagcagtgagtcagaggagagtaatagaagataaggtaaggggcaggggcacagctcatacatagcattgcagatcatagcaagagctgtatcatttacactgtgagcgatggggaccatttggaaggttttgtgtgcagggataatgttatctgtcttaggaggcaatggggtcaatctggttacttggttgaaatttggttgaaagtaaactgcaagaaaggaagggagataaattaggaggctattgaagtgatccaggtaagacagtgctggcttggacccaggtggttgtaggggaggtggtgagaagtagttgtattctggttatattttgaaagcagaccccataggagctgctgacaaattgaaaatggggtgtgagggaatgaattgcctcaaagataaggtttatggcctgagcaatttagcaggctggaattgtcatttactgagatggggaaaactgcaggaacaataggtttggtgggaaggaacaagagctaagtttggtcatgttaaatttgatatgccttttagacattcaaatggagatagagagttgacccttggatatggtccagaattcaggggaggagtagagaggtcaaatttggagataaaaattcaggcttgtcaatatacagtatttgaatcactgagactgaataggaaattatttcaaaatttcttctgtcattccttttccccccttagtttatttttctttattttacttactcttcttacctatcttcccatcccacaaattccaaggcagaagttagtattgacagttatcatccagcttgggagatgtggaggaacattgtacttttcttttctcacttcgtgatgtaatcagagtaagtgcttattgtagtgaggtgacagcatcttcttggtgactattaggttgtgatcaaatcatgttctaaatagaaagtgcgaaacttattttcatgttccttttattagcagtatttatttttccatcaaccatatgctaataattcatgaatcaatctataaacacttaaagaacactgtgtacctgtactgagaatgaaataagagaaatattactaaaagtttctggcctcaaaaaatttgctaattagtagaaagcctggtctcacgtagtaaaccaattagagcacaatgtatgatagcactgaattgtgccttgggttgtatggtgtggcttataaggaaaagcttattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggcagcttcattgcaagagctgaaagcattaatgagtttgtgttaatgcttcattaataaatcatcagtggctaagaaactagatcttccttttcctgaagtctttaatgtatcttgatgctccattaatctgggggtcagggaaactcctaaagtttgaggtcagatgatatcatatggtatttccattctctgagcaaattggctgtttcttacacccctgtattaatccgcctacccctagataaactggttagctgatatggataatgaatgcgtctttaattttcatgtgaggtttttaagactaacaaacatgagaagattgtatatagaggaggagtgttttggtttttgcttggtaatgctactctagcatgaataagtgagtagatatattaaaattcatttttatttagctttggaatgcttatagaatggtttgtggcagatatgtcttcctatttgggttcattttgatagacatgaaaattagaaaatattatttagatagtgtaaaaaagtaaaaaaaaattacctttcagtaatctccaaacaattttaatctagacaaatgaaagcatttttattgatagtaaaatattgttttatttttatacttgtgtttggtgatagccatatctgtcctcagatttcacagcagatcttttaagttattaggtcctgagcgaaaatttccaataaatccctactaacctttcaaaaaacaaacatttccatcccaggtggaatgcagggaatatgagaaacaattagacacaaagagaagggaaacagggcattagttctttctcctctgacacttgctgcctttacttgatgtttcctttttctctgtgaggatcagagtttgaggagtatttgggtcttggcaagtgagtagctaatctttagcaaggtcttaactgaagctaccaataaaacgcaatattttaaatgctttacactaataaagtctaaaaaaaaaatctgttagcattttggaatttagcagaactagctaaggccctctttggctttcttgacttccaggctggtctcctaggaattttttatgggagctttggggctcataaactgtacaaatgttggttctgacaacgtaatgaaaccacacaggccaggactgctgcttgaggagattattttaggactggctttcttatgaccccttactcagaatacttcttgccttccattctatggacagtatccctcagaaaggttggcttagtaccagtttctagtacctgctgtagacttgttttatttattttttacatctcctgtaggtcagagggaacataatgacttcctgtgggtttttgcctgaatacggaagtaaaagtaagaactttcatgaactctgtgtctttatgaaaaccattataagcagttctgcaaattatattaatagaacttgaaaagatttgttttaagtgatagtctatgaagataatagttctaagaataatgtaaaatgtatatacttgtatccagggaatatatcaagatagatagataggtagatagatacacacacacacagatatatacactgaatatgtatgtatgtatatatgaatatgtatgtatgaatatatgtatgtatatatgaatatgtatgaatatatgtatgtatgtatgagtatgtatgtatgaatatatgtatgtatatatgaatatgtatgaatgaatatatgaatgtgtgactatatgtatgtatgaatatatgaatatgtgtgaatatatgtatgtatgactatatgaatagtgtgaatatatgtatgtatgatatatgaatatgtatgcatgaatatatgtatgtatgaatatatgaatatgtatgtatgaatatatgtatagatatattccctattcccaaatattttgtgcatgtatgttttgtatgaatatttagggcaacaggaattacagtagtaccatgtaaatgtaaataatcacaatttaatattactcaaaattttcacaaacttagaaaattatggccatattttaatgtagtgaacgatatcaaattgatgttacttattttaaatatattttatcaggaggtctgaggataactgtttgcattctccttaggtagggatgaattggtgttttgatttgggaatggaagaaatatggtcagttgagaactcttctgcagacacaaggcacctggaatttatgaaagaaccttgagtgctagagataatcttctcttagagaacaagaggttgaagattgaggcacttagcaagaactcttaaattattcagtggtttcctcagcagcattttaattcttgctcgtaactgtttcatggttgactttcttcttctcatgtattgctatttttctttgtccttttctcaggaataggaagaaaatttcattaaagcacaacacagaattatattcattggccacacttcacagaagattcattgcataatttggccagtttccctcaccacccatttaaatagtgtggcaaatgtatttggtgggatttcctcaaccattcagaaacatttactcattttatttttatttttatttttattttttgagatggagtctctctgtcgcccagggtgcagtgcagtggtgtgatctcagctcactgcaacttctgcctcccaggttcaagtgatttttttgcctcagcctcccgagtagctgagattacaggcattcgacacaatgtctggctaatttttgtacttttcatagagacggtgttttaccatgttggccaggctggtctcgaacccctgacctcaagtgatccgcccaccttggcctcccaaagtgctgggattacaggtgtgagccactgtgcccctgacccatttgctccttttagatttagatatatcagtagaatgattgtagctcaggaaaatctactcagccagatagcattacctttattccttccattagcatgtgcacttctttccagctagttgtccaattcaggaggcacagatagctgtaatctaaagtatataccttcatgttctgaactattggtagagcaagtatggtaactaaatctaacactccatgcaaactaggtagagttttcagtcttgtagattttcagccaaagtgttgtaatgggtgacgtatgtctttttaatattaatggagggtgttctaccctttagtatcttttttgtgacagtgatggtggtgaattgctgtcatggattctggttgttatagatccagagtgttctattaaggaatattctgtgttgtaaatcccaagacaattgtgaatcttaattactctgcttgtaattacttctttagtgcaataaattaatcttagtttatgtctaagcattttgggtctcagggcattcataaacaatctctcatatttcctgtgtgatctgttactgttatcaagagaagtgttcagaaagagaagacaactggccccaaactatgtggaaactaataaatacagaacagccatttttgaattttagtctcacagtagcttataaatctctcaaattgcacagtgcataatgaaatcaatgaatatgtgaatacattaattcaaattaaaacttgcccaggactgatctggaaattgttcaacattagtaagaaagcatgagatatttttaaatgggagagaagtctaatcatcatacgtggcaaaaagataaggaagttgggaaatgtgcaataatatagacatcatttagtagatattttgaaaatacaactttggctcttaataataataaaatgtataattaaatactgttgcctcagtttatccaagatgatacttgtttggaggcataagactaaagatcagtgtaggaacacatctgctcagggggacctttgtgcccacaactgggagctcattttttttaatttaaattacctccttaaacatcctggaacctccttccatagattttttttcttggctaatataggaattcagatgagatgtattattggtccgagtagtagaagttatggacctgtgaccttgtgttctcccatcacaattttaccaacatcttcagtagtatgaattcaggaatggaggtagggttgcattggaggtgaattataaatcatgttaaattgttcaagaattttcttttgttttccttggtcatcaaattttgaggtttgctaagttttgttcttttctttgtttgagctactttttgttccttttatcctgcctgatctggcttcattttgtcatttttcatggaggttctcttatgtcacctattcgcccaccatggtattggtggtattcaaacttaatgttaattctttcatagtagcttggttatatgttcaaaaaatatttattgagtgttcattatgtgtttggcacttttctagactttgaagaaacagtggtaaacaagacaacgtgttccctgccttcaagaagttagtgttctagtgggaatggaaaactggtagggcatgagaacagatttcttttatacaagttgtcaaacttgtgataaaatgtgataatttcagattgtagtaagtgctatgaaggaaataacaaaagtgatgtgattccaatcaataaaatgatagtggggctgcttgagaaagaacagtaagggaagatgaattggtaacatttgagcaagctacccgtggaaaaagcaaggggagaatatttaagccagagaaaaaaggaagtgcaaactttctgaaagaataagaaggacaggatggaggcaaagaaagggcactaatgtatctggagtatcatgaacaaaagggaaagtagaataaaataaggttggagagacagggagtagctagtttaataggaacttacagaccttgaatcttaggttgggttctgcatgaaacagattctggagtggagatttgcaggaacaaatgtaactggagagttctcttgttctcagcatcaaacagctttgttcatgctggaggaagtcagctttctgagagattgacaagagtaggaaattaattggaaaataatcttcttttttgttctaatttatccttttaaccatttttttttgagatggagtctcgctctgttgccaggctggagtgcagtggcacaatctcagctcactgcagcctccgcctcctgggttcaagcaattcccctgcctcagcctcccaagtagctgggactacaggtgcctgccaccatgcccggctagttttttgtatttttttagtagagatggggtttcaccatgttggccaggatggtctcgatctcttgacctcgtgatctgcccgccttggcctcccaaagtgctggggttacaggcatgagccactgcacccggccatcatttttttttttagtgtgctctttcctttttttttttttttttttttttgcatcttctttgtatattaatctgtttttgctcttttttcttcaatggtcattttggggtataggattgattttgagacagactgaaaacagttaaaaatctctcttagcttttcagacaagaagcaataatgaggtggcctcgtttagtggaaactggaaagcaaagatgtgatggacttcagagatatatagggtccggaagttggcaattctgtgactgaatgcagggatgaaggaaaccaaggagttaaaggtgaggaaatcagttggggcaataggaactagaagaggatgagttctgttctgtggagggtccttctgaggtgcctcataggacagccatctggagatggacctctggcagctggaagtgtttagaaatcagaacagagtgcaggctagagacacaaattttagaaacgtgtatgaaggtaataattttgtaaatagatgaaggttactatgccatttttaatgtcaagtacatataacagagagcatgtcatttaactgaaaaatgatgaaaagctattttattttcacatatttaaagattgggcatagttagaaaggtgaatgcaccttccctcccactaaagcttctaagaccttttgaatgaggttagtaccagatgaaattctgggaacacacagacctccttgtgagggacacacgtttggcagatacataatcttaaggagagatccattagtttgcttcatgctgcttttggatggcaagaattttgtactgttttgcaacagatatagttttgatagattacattggagggcagaattttctggaaggccttttcagatttaggaaccatggaaaatcagtcattatttagtaatcaagagaattaaatgcttttattttgctgagcctgatctacctagtgaatgttttatttctctccgtgtgtgtatttcattttgcaaatataagtattattctgtgtactgctttattagttataattcatgtatcattttgtaacagagaagtatcttaaaattataatgtttgcacaagattctctgtgatgattgaaccaagaagggatgtaggaaacaggtagggtgcctgatgatttaatatttcatcttaaagacaaaggagaataaaaacagtccatttgtatttggctgcttttatgttactggcaagaacagtcagaagctccccattttcaactggtggttgggtgtccaaggaattcttgagtttgttatttcatatgaaggatgtgccagataaaaacccttagagaccgaaagtttccttgtttagtcacaagacaaacttgctcttttcttgtagcaaactatattactaccctttgtctgacttgttgatttcgagttggagggcagtgtccattggtccatgtcagtcactagtgcacctaataaaaggcctaacagatatttaggttgtcagtgtttgcatgctagttggttaagccatctgaattggatttgattgatgacctcgcttgcccttaagaagagggtttgtgaccacaagccacagaaaatgacatgtaagatcaattgatggttagtaagttaaaaaacatcccatcacccattttgtgtgaatattgtattgctatgggttttacttgggaacatataaaaaggttaccacatactccaatatgtgtttttcctacatttcagtaacacctgaatggaaatctaacatgaggactgttgaaattatttttttcaaatggggaagggagaagaaggttaataattttccatactcagattagaaaggtcacgaccatatcagttcaaagaagagaatgcatgtgctcatggctggttaccaggtgaattttgcaaacattttattatatacatagttgattttttttccttcctgggaaacttatatccatgaatctggagttttacattttggagctacattttttggtcccttctacctatattatttttaaaagatatctttattttaaaattgagcaacttgaagtgtatgtgtgtgtgtgtgtgtgtgtgtgtgtgtatacacatacctgtattgtaaataagaaaggtgcttaataagtttgtcttaaaactcatgaaagcttggcgtaaaatctcacactaatcactatggatgagaatggctctcgttgagaaataagggctgatggcttttttctcaatgatcatgttaaaaatatattgagagcattgtaggactccagatgcttgggttgtggctcacaatttttacagaattaatttccaaaattcttgattactccaggaggaaatttattccaaaagtaagctgtgtgcttccttcttaaatttaaaaattaatgcatcaaaggtgtaataaaaatcatctcttacaattagaggtcctaaagaaatgtttgaattattatggcaattagaagggtaccttacttaagattttgagagttttgttgctagcaaagcagagaaataaaaagttaattacttttgtaagggaaaacttgggaatataggtatgtccctgtaccttttcagatatgtaaacaatatttaggtatttttacagagaattgagaaaaagtacaggcactgacactactacaaccatagtagaagacactactacaaagatagtaaaggacaactttctatgtagataaatatcagttatttggagtttattatctgaaaatattttgataatttcttcccatttctttcaagataaaaattaagttttaatagcagatatcttgcttagaatcaagtacattttagtgacttggcatttattcattattcgtttatttagtttatcacttttttttttttttgagacagaatctctttctgttgcccaggctggagtgcaaggcatgatcacggctcactgcaatctccgcctcccaggttcaagcaattttcatgcctcagcctcccgagtagctgggattacaggcatgcgccaccacatccagataattttgtatttttagtagagacgggggtttcaccatgttggtcaagctggtcttgaactcctgacctcaagtgatccacctacctcagcctcccaaagtgccaggattacaggcatgagccaccgtgcctggcccttgcttgtagactttcattctctggttccatactccacaatattatcagccctatctctcaaaaatagcattggttatattatagcatcaattaattacattgacataaaattaaaatgtctctacttgtcacttcttgtaatattacctaattttgtttttctctaatttttcataatttatacacctaatttattacctttcacgggctcatgtgtttcctatttaaagtctgaaatgtggccaggtgcagtggctcatgcctgtaatcccaacactttgggaggctgagttgggaggatcacttgaagccaggagttcaagaccatcctgggcaacatggtgaaaccccatctctaccaaaaaatatgaaaattaccaagtgttgtggcgcacgcctatagttccagctacttgggaggctgaggtgggaggattgcttgagccctgggaggcagaggctgcagtgagcagagatcgcgccactccactccagcctgggtgacagagtaagaccttgtctaaaaaaaaaaaaaaaaaagaagtctgaaatgtaagtcatttgtatctgttcaaatgatataaggtggtatcaagcattcttacacatgatggtggtcttagaaaatcatttagaggatgctaggagaaaaattgagctgccatctggagaggctgctggattggcgactccctcctatcattggtttactctctccaggtgccttactaaagagaatcaacaaagagagaaggactttgctcagtaccttctgccttagaggcctgtctggtcatctgctgccagctctttccagggagagatgaggagcagcaggcctgtgctctcaagccctcagggaatgcactgcctccagtgggacagagtggagctgttgcttgtgtcattgctgcagcacattatttgaaactgacctcaagacttggatttgctcagtttatttttagaagtaatgacagtatagcactttgaggcctgaatgttatttctagacaagagtaatactgtttttctgagaagtagaatttcaggatttcaaatggattttttggtaaatatttctgaagcttttccagtaactgagactttctgggcagaaaggcaagatgggacatagtgtgcatcctctgttcttgctgacctcagtatctcagagtgtgactagacgctgttaccgagcagctgcatagtcatcttcttcccttgttctgagcaagtcctctgttacacaaagaagaaaaaagcaatcattcttttcagtcatttaccttccaacttactaaatttgaaattataattatacatacagtacatacaaggttgtctgtagggagtatatttgtttttatgtcttatattctggcatgtatatgagtttgcctaagagatttggagatacatacacatgcatacatacatgtgtctgactttttatgtaaatatattttgtatgacgtgttaatttatatgatacatggctatccaatgtggttatctctacaaagaaatgtactcacagatgcatttaatttttacagatacaattttcattagctttctaactgaagtccctgcctgtagactttcattctctggttccattgtgtactccacagtgtcatcaaccctgattttcaaaaacagcattcatagccagcagttttgtcttgcttcctatatgccaggcactgttctaactttttatatataaatctctcaacaattccatgaggtaggtgctgttaacatcctcattttacaaaagaagaaactgaggtacagagaggtcaaaaagctcactctaggtcagaaacaatcctaagtggtaaagtcagtctgaacccaggcagtctaactctaaaatctatactcttaactactatattgtgttgcacacagaatctggttcctcgtgcctctgatcaaaaccgatatttcctgcagcagaaaatcttaacatattagcacaggattaatttgttagctttttatgtttttccctgctcacatttgaggttgttatccacagacaagtatatcaaactattgctgttctccaaaccttccagatagttttctgactctgtgatgttaatcatgctattccttttatctgaaatttacttcatctttttctacccagaaaacgcctatttattcttcaaagcccatatcagccttcacaactcttttatgcattgttgtaaaattgtattttctctcatctgtgtttccgtagcacttaataagtaactccggttttggtgcttctttcattgtatggtggtgtttatttgcccttaagtgtcatgtgctcttcattgggagtaccatctcccctctgctgatttcattcaactgtctagtaaccagattcacctctcagccatgttcctgtatcatcagtgctgctctgcggtgccctgtctggttttcagtcacagtttcctgtgcaggtggtggaggattttgaaatgcttgaaactgaaccattacacccacttgagatagtttcttttgtctgtgtatgataggaggtgggtggggaaaaataagtgcacacagcctattacctggagttgagatcaccaattaaatgtcatgaatagggtaagataacacatattagttgtgtttaaaatattttgctccttagatttttattcactcttcactttaatttagaaaggcagttttcagatgttggatgagcattgactaatttccaaatacctttttatttgttttctgcattatagatcatgtgactcaaatgtatttagggtagctagcagatgattgaacatgatgaaactatgagtcttttatttatctaagtaaagcagtgaatgcagatgggtttattatagtcatagggccccatgtactttagtccttatttcatccagcaaaacttcgatgactaattttgacttcaattgaggaatattttatttaaaacatttgcttagaataatagtcattgtaaaggaacacttttcatgtgtttactgaaccaaatgctaagatgatacaattcctaattttaaataagataaatatcaaattataggtttttgcataattttagtaaaatagatgtgagaaagattggagattatgtgaggattctaggtacttaagttggagtagaggagaaagaaggaagaaatggcctactcataattgcattacagtttttttcagtcttgaacagaagttgaagtctgaatggtactgaagtaaatgagagattcaaatccaaaagaagaaaaagtcctcattataaattttggaaatgcataaaaatggtgaatgataatattctgatatttgaaaaaataaataaagctacattttaaaatttaatttataaaagtctgagtgactttttaataaattaaaatttgaaattataaatttatatgagaaattaatttttctcatataaaaatacatttttataaatttctcatatactttcctcttaaagcagtttatatgtggcaattttttaaaaaatgaataaattaaaactgaagattgctcttcctcttctatcaaaacagctaaaacatttagctcctattctgtgatgcaaagtttaacatatgtaatctgatttaattcttgcagttacctgtacagcattatcatcttccatcatatatgcatggaaaattaagcttagcaatttccccagaaaggaaggggtagaataggatttaaactcaggtccactgctcctgtatcccatgctttttctagtatattttggtagagaatgtcagttttgagtacagacatactttgtgctggagaaaccagcaaactggaattacaaactaatcaaatgacaaaatggaactggaaaaggctgttttttttttttaattgaatatgttactggcatatgtaaaacagaagtcatttaaataagatattcatatttcagttgtcgtttaaatatcagtagagagtttgattaaatagtggattgtctgggtgtctttatccatgatctttgcccctgcagttatgatcacttatttttatagcatggaattaactcagcataaaatttgaggtgagattttgttactcaaaataatcttgaagttttctgggattagtgaatgttttcttgggactggccatgtcactcactatctttgcactgaaaatgaagaatatacagtatattagtccattttcatggtgctattaagaactgcccaagactgggcaattcataaagaggtttaattgactcacagttccacattgctggggaagcctcaggaaacttacaatcatggtggaaggggaagcaaacacatccttcttcacatggcggcaggagagagaagtgctgagcaaagggggaaaagccctttataaaaccatcagatcttgtgagatctcactcactatcatgacatcatgggggtaaccacccccatgattcagttacctcccaccaggtccttcccctgacatgtgggaattatgggaactacaattcaagatgagatttgagtggggacacagccaaaccatatcacacagtgtatctcattttttactttttatacagaagtattgcacataatatgaagaataaagggaaagaaatatagcttaaatatgactatcagtaaaatacaatatttgcttcagtaaatgtagtcaacagggagctaagaaatacctgggtcttccagcacttcataatttaatgaatgattataggaaaattacagaaatccttttgtacttcattctttctgactcctaatttaggggaatggtctttgagacccacctttctcacagggagatggtgaagattaattagcccatgctagccaagttcccagtgctgccccagagaaaggtgttccataaatcagacctatcattaaaatgccttcatttgtgtctagtccttgcacaggatggtgccatcactccgtatcctaatgggagtcacccacattcaggccaaggacaggtttttccataacacaaagaacgtttgttctatgtgactaggcagatttcctcctctgtgtgcctcagtgtcctcatctatcaaagcagcagtccatagccagataattcctaagaggaacttaccctagagttgctctgatttatatctttttgtttgtttgtcccactcagcttcttgaacctattaaacttttttttaagctcatgtcctacgaaagaactgtaacagacatagagataggccattcagatgcccctccaaggaaggcagtcaggagagcctccagcagtcagggtcagcttcagctgcacagagctggccctcccaaagtcatctccctcttgtggcacctcacatctgatgactaagttaagaccccagcactagacaactctgatggacagcgtttgttctagagtgctccactggtttgagacattggatttgcctcatggttgtttctcatgcttcctgatctttcttccttctcctttccagatctgataaaatcttacaggtcttctatgtaaatatcttacgccctataagccatctcagcatctgcttccatagaatctgaacaatgacaagaacttaaataatgtgaaaaaatttgtgactggcttgggcaatgtagcaagatcctgtcttgattttaaaaaaagaaaaaaataataataatgtgaaaaaggactagtagaagggaaatcctcaagccacaaattactagacttctttataatgggcttgtttcatatactgtagtttattaatttggaaattgtattttcatattaaaacaaagcatgccccagaagaaaggttcagtcactttaggtaacttttctttagctgtcttcaaataaatcattgtgagaggcctttcttcctttccttttttcttattctttcttaaatagtttagatttgcttatctttgtcttaagaaaactagtaagtctgacacctactatgaagttgatctgataaagtaagttgtatgctgcgtatttccaaattagatttcctattgtaatggagggctagtatttctttatttgttctttaattcacagtttacatttagaagttttgcttaaaattattttatgttctgaaatcagagtcgtcaaaactcaattcagcgtttttaaaaatttgctttttctctacccatggttaagggatatgacttactatttctgtgggtttcttttacatgttattattgatttttaaaatcaggacagaaaaagcagagactggagaatatgtggctggaatatatgatggacatctagggaagaattaagaaagaaaagaaaatggctggggagaggcaagtatttaaaaaacaaccgcatgtgttagtagagaagaggataagagtctaaattttgacatacgtgtattagtaaacctaagctacttttgactttgcacactgtttatttatgttgtggtcacagagttaattatatctgttagaacaagcctttgaaagtttaatgagctctttagcattaacaacctttcatatttccttatttttttttcacctttccattcatccatcttaaattttgcagctcttaacaatgttattgcactagaaccccagagcagcattaggtgagtggaatgtgttccagggttaaaataaaaacaaggcacagtacatagtgtgttattcctattacataaagtattatataaaaacaagctaaatttctgctattagaaatcagaatagtggttattctggtgtggaggtaggggcagggagtaggagaggcttctgggtgctggttatggcacccagatctgtttcttgatctgtgtgctgatcacatgtgtgttcattttatgaaagatcattgtgcaatatactcatgacatctgcagttttctgtctttgtattttatacttaaatattcaaaaaattgggtgaaggaaatgcctgtgggctggatttactttgcttcacttagacctttaagaatcacagaaccacagctagttagatttaagttctagtcttctacaacactgtagggtttagagtaactatagttaataatttattatatattttcaaatagctacaagagaggattttgtatgttcccgacataaacagatgacaaatgattgaggtgatggatatgctaattaccctaatttgatcattatacattgtatgcaggtatcaaatatcacttgataccccaattattataatatgtgtcaactaaaatttaaaaactaaaaaaaaaaaaatcacagaaccaactataaaatcacagaaatggaaaaggtcttagtttagcccactgatgtcacgaagagaatagatgcctaaaaggctttgaagtcttgcaaggatcctagggaacgatgatttcatgtcttacagctgaggaaactaatgtcagtaaggttaggtccattgcccagggtctcaccagagcctgctaaagagctctcagatccacctttctctgctgttcagcttctttctactgtgtggcttagcctgtctcctaatagcagcttcttcatagaactattcttattaaaaacggggcttgagttaacctagcttatgaggatttctaatgacaactcttacaaaaagggtatttttcatttaacttgtaggcagcctgattttcagctgaccagaacaatcaaattataaaatattctagttatttgagatgttaccatagatagctttaaaaaatctttattttcatgacatttattttatcacatagctattattgcatagtttcgcttgatctctgaagctttatcaagatgctactagatactatcctatgcatattttccacttaacacaagtatgatatcccctttagatttatatgtattctgctaccatgaaaagccatttttttcctctgtatacatgagattatttttacttgactgacttatctctttaattcattgcctgtcattcagctcatatcatatatatcacatatatgagattgataacctaataaataatcccatttttgtcaatccagtaatcattgaatttactagaatctactcagttcttatccaagggccactactgacatgggccttcttatttagatggtattgcatcgcttgactcttagagaaggctctggatgattgacagattatcctcatgtctgacggaagtaagacgagcaagttccttcaagaaggaagtaagccaagttgtatcagatatagtctccattctgttactttcactttcctgttgataccccttcttcctgtttattctgaatgcatttaataaatatttacgagtatttgctgtagatcatacactgtcttaggagctggtataaaatggtgaaacaaaaaaaatcaacatagatcctgctgtcttgggccttattttgttagagacagagcattaaaaaaaatctttcagctaaatagaaatcacaaatgggtcaagtataatatagaggtggaatttgtgctatgtatgtgagccaatggtagggagtctgagcacattaggaatggcttccttgaagaaaagatacttgctttaggatataaagaatgaatagacagacataaatcagacagaggagcgattagtattccagcagccaggatagcatgcacaaaggttctaaaggcaacccaatagtgtaggggagtgaggctgaattttagctcttcgcctttagggttttttctggctaggcctaagaattaaattgacataggacagattaacaggagaaaagcacaggaattgatttaatacaacttttacaaagcagtgggagtcctcatgaagaaatgaagacccagagaaacaattagagtgaatcagttatagattgaattggacaaagaatagtaagttgtgaaaaagcaactaaattatgtggagaggcttaagagacaagagctattttagcaaggtctgtacagaattttctttggctcaaatttccatccttgatgataagaatgttgctttccttctggtatagggagaggacctttcagtgttcctgcttttaagaaacagaaaggaggccagaatgatcttgtacctgctgtttttcaagtacctttaattcacaatagtcattatgccagaatggtatatttttaactccttcaatggcacatttgaggaactcaaagaaggccagcatgacagggtcaaagagtgcatagagttgtgtggagcaaagtaaataaagtgacttatggattgggaacagtggaggagtcagtggactggtattcctgatggtttgaaaaaaaagccactctaggagacactgaataatctagaaaatgggcagtttatggccagcaactgtgatttttaactccctgattctggaggaggatggccaagtttcaaggaatgactgcgagagtggtgactgaaatcgagtggaaatgaagaccactggagacagggaggtcaaggaactgacaggctgagtgttgaaccagttatccttgtgtctgttgaaatagcccagaatgttggcaaactttcagtgaagtagaagactggatagatgccaagtctttaatacataaagtgggttgaatggtggtggggaaagagaaccacttagtgtgcccagtaaacatttcataagatttgaatggtttgtatgatagagataaagtttctagattttcaatgttatattttcccaattgttcattatattttggccattatacagatatatgaaaatctgaactaaaggagtttcctcatctggcttgcatatttcaagatgataggaattgtgtcataatcactggtatagaagctgtacagatcttggcttacccaaagacaagtggtagctgtgaatgaataaagcatagggataaattatgaatgaagaaaatagtgcatcagctctattagatggaaggtgttattatttttaattttatgcacatgtgcaaattttatgaactttacatggaattttacctctctgactacaattacctttgcatctacattaattacatagtagtcgcatgttttttttttctttcagagatgaactttttaatcagaatacttacttttcctctgattccatgggaactttaccatttatactaactttttgtggaaccaatgagttagatccttttgacagaaattgcacggaggggcattctctgatatggggatacatcttgtctggaaaggatcttcccctgtctgcacctccattcatgtttgtaaacttttatcattctccatttgtttatctggctagtgagcaatctctctgtaccaataattgcctaagggatttaaccagcttatgaaagtatgtaagttatgatttttaaagatgaaagcaatatgttatatatatgcctaggaaaagactggcaagacattcatcaaaatgtaaatagtggtatatctaggtagtggggtagttttatatcatatttatttctttaagctgaaatatacatgtttttcagtgagaatctatcatgttttacaatgagatttttaaagccaatattaaggtgaaaggaaaaggtaaaacaagggtaggggaaaagtcaggaattaggctatgtgaaaagaagagtttctttttctattgtgtagaagataggtaagttgtcaaagatggaatatgcacgcatggatgttagcagtatgtttaattctactgcaagaagctaatgcatgatgctctcttcagaggcttctggtcacagtcccttatttccaggtcacttggcagaattcctagagtctcaagttttaaggagcaaatagtagaagttcctccttagtgcctctgttgtttattctctcggggggagtagtcattgatttctgttaactgtgatacaaaaaacccactaagcacctggggcttcccttgccaccccctttccatttgttaggaagccttctttaagctctgagaatatctgtggattaacacaagtcagaaattgttttcagtatcactctgcagacagacatttagcaggtgggcagtagatctgttaatttcccatgggagaggaaattaactgtccagcctggacaggtttttgtctgccagctttgaagtttgtcacatagaggaatcttcctctttcagaatttagaaggaaccacagacaatttaagtggcattgaatatgcttccttgtaaactgtgggcatcaagccaggcagagttgcaataagctcttaactttaggcctgacccacttgtaatgctatgacaatgccaaatgtgtgttctaaatgatgcagtacttacctgagacagagcattctgggtaaaaggtaaatgttccttctcaatgaatgatgaacgatgacatctagaatgatgattaattgagaataccactctgctcagtctggggaattttattctgcatttcatatgtatcataaattcaatatcagaatcaataagatgatacactcctgaagtgtaggttatctagaaaaattttaggtgattttaaaaaaatatgcaagcatatttaacaactgctttagtataatctacctagattgttcttcctagctctgcttccaaagggtattggacatggaattgtgaaagcagaggtatgtgatgtaaaggcaatgatattcagtaaattcaaacactagatggttatatatttgttaaatatttataataaatctgtaatcagaattctaaccatctagcttcagtgggatgcaagtgggaacaactttattcctcttcccactgaatatatttatttcagccatgtaagaagtcttggttagatctcagagctttgctgtgtcttttagtcacaagaacagtctcatttcaggattttaaaagtcctgatcagagtaatcatttaaaatttcttacctcaggttgggcctgtttcaggcttgacagcctccttgcaccagggggtgtatggtactgacactctttgtcacctgacttcctctcccactcactggctgcccttagggccttttagagaagagctgtaagggactgggcaagtctgagtcactggtgcagttccaacctgcactgctaccctctgttagatgcatgattgctgactctctcttcggataaatcctcttagggacctctgggtatagttcctctgatagtcatgccgcccctggctggatgtttttagctgtctttgcagctcctgggtttctggctttacaccccacttttgggattacattgccttgccaggtggtccttttgggcattgtcccttgtgagatcattcctcctgtgggcctgtatcctgtccatgagaattttcttgcaattgttggaagcatagcctgatcacaatggagtcctctaggctttgcaattccaggacagttagcaagccacaatttcctgcctttaaagtcagatttaaaataggtagtagttatttttctctaactccaggagatgcatttttttcaaatatttctctcagagacactcattcccttccaatttggtacccttgagtaagctcttttgtggtgtgaagtaggaggtggtacagaatgttctaaccactctatcctgagtagtcctctctgggggtctcattaccttctcttgtagagccaaaagcaaacagtgggctcatgatgacagaatggcttcaaatgaacccttggcaagttctggtttggcacctgtatctgataattattttgtttttagccttcaaggtttcagctaaaacggaaaatttcatttgttttatattttttaattgatatgtcatagttttacatatttttgaggtacatgggatacacaatttcattttaaacatcttgactcagtagtattttttttcatttaggtggctgcattaaacctcatttatgtgtgtgtttgtgtgtgtgtatgtataggaaatgaaagcattcacaaatgtggtaaacaaagaatatagaattaaattaattttatttttaattaattaattaaattaattcaattaatagaattaaaatatatagatgcaagattttaagtgtcttacattttttaacttggggattgtagttcaatcaatgataacttcattttcttttttcaattcaaaggatattcttataattgctagtttaattattagtttgcaagtacttaaaccgaaacatcttacttcatcttccaaaacagctagcagttcccttgtgtttgcttaataaaatattaattacaaatatgttaagtagcatgtctgatataaggactttttcccttaaaaataaatacatagtatctcaaacttacagtatcttaataggatagagaggaataaatatacctttacacatgtataagatttgcttttttgtcattcttggcagagtctgtactggaagccaatttctttaccttgactttcaacttagtgatcattttactatggcgggtcactcatgactaatgtaatataagatatgtatgggattttaatgactagttttagcagtataaatgagattctattcacttaaagaagaaagttaatattataaattatctgaggtattttaatatgcaagtcttttttgtgtttagaatttaaacaatacattctcatcttctactttttttcataagcataacaaggaacatgcatccacacttagcagcacctcacatgtatgcaatctgggaggttcttcctaaggaaaagattacaaataaaaaattaaactcaaaagtgaatatatatttaggatgaaatagtcataagaatacaaattttaaaaagctgacagatactacaaagaataacaaattccagaaaaataacaaaaacatttttcctcctcctttgttcacacacttgtagggtgatctgtagttcaggttcatatgctgataccacctctggtgtgtcaacatcgttatctcatggcagactgggaggtgggtgtatttccaaaacatccctacattgggatggctggcaataacatacctcaacatagaagtgactgcaaaccaggtaaatatgttttattaaacctaaactacatgtatgttcagtgcagctcaactttccctttgttagatctcaaaaatgttcatgcttgctccagtgtcgcccaacacaaagagaagtgcgatggaggaaaaaggagagtggaaagaaatagtgatcataactgattactgttaagatatcatgttttgcaacttttatgaaaacatatgagtctgtaaacattgctaaggtcctttcaggagtctgtgcatatgaagggcccagatgcctaagctactttagcttcacagttacctctcaggagaactcagtcacagaaaaatgaataacagcatgttccagatgctttaaaggaaccataaaaaatctgtgttcttttacatttcattccctttattcttctaaattgttatccaaagttattcttttatctctatttttaatgtgttagtattaaactacctaaggaaaattttcctgtggaaaaccatataaatattttatacttttcactttttgtataaattcgtgtacttaattcttaggaaaaatgcttaagaataacaaaatatgtttatcataccacaataagaaaacaaaaaaagaaaaacaaaatccctgaagtaagtgttctcttgtgttactgtacaactgcctgtaaaaatcattggggccactggaaaaagatggttaagggtggattgtgtttatctttttttttttgagacggagtctcgctctgttgcccaggctggagtgcagtggcgcgatcttggctcactgcaagctctgcctcccaggttcatgccattctcctgcctcagcctcccgagtagccaggacaacaggcgcccaccactgtgcccggctaatttttttttttttttgtatttttagtagagatgtgtttatctttagtatgccttgtttccattctgggtccttctaatctctagatagccaaagcttgaaggattttaatacaaagtgtctcaagtgacttagctctattatgcctaaaagtcaaaatggaattgtgcagcaaatttctcacaagcaaaattacatctaaggaaagtactatttgattgtagactgagggtagagttaatatattatacaaaatttatctcatcagtcctctataatagtataattggaataattttatatgaattaaattattgatatacaattaaaataaagatatagacaaatttaaacctctttaattcttaacatgcaccaactaatatccttataacttgtggtttatataagggcttgttacttacaatattaacaatcagttgaaacatcatagttttttatttatttatttatttgtttgtttatttatttattttttgagacagagtcttgctctgtcagccaggctggaatgcactggcacaatcttggctcactgcaacttccgcctcctgggttgaagcgattctcctgcctcagcctccagagtagctgggagtacaggcccacgctaccatgcccagctattttttgtattttttgtagtacagacggtgtatcaccatgttggccaggctggtcacgaactcctgaccttgtgatctgcccacctgggtctcccaaattgctgggattacagacgtgagccaccacacccagccataatagttttaaatggtactgttgacagatggtcatctgttctgtgtgaactctgtctgataccatgtgtcctaatgccatctggaagttttgatttcctcctttggacaggtcttgactctgacctactgagtactgcttggatcctctttctcctgaaggtacatgtcctggctatctggccattctgcataccactctcctcttcttatgcttcctggtttactcctcctgcctaaatcctctggtgaccttcataagacatgtttcatatcttggaacatgcagtgagtgatatagccatgttaacagaatgacagacacacagacagacagacagaggcactctcgtgaaaggaagacagcaacaccatcacagaaggtatgaaaactgaggggagatcgctaatgtcaggtagagctacgaagggtataatcagagtttcctgcccatctccttccttgatcttccaaaggaaatctacagtccaccaacagtctccattcaatactatacctcctccagtgtacctgttctacacaattatgctcccacttttccccttcccaagggataaaagctcaattcagattccccttagcccatcacctagaagtagtataaggcttagtaagaggctctcttgaaacttctattaggtcttagcagagtatgcccatctccttcttaatagctatgtagatagtttatataatcagacattaaataaacatttatatgaaaatattttatataaattaggattcactatagtttataattttaaaaggactacaataggttgtatcttcacttaaattgcaactgaacaagagccctataaaatgtagattttgctttacattttcataattttgtgtaaagcatttttaaataacatatataatgttatatctctgaatagatgccattattgttgtggaagagggaaaataatttcttctgtaggacaacataagaatggtgccatcaaatatcaatatttattcctttacagtcctgtgaaagagaataaatatattatacagcagctccctcttaaacaattttatgataaactattaatcagaagagatgtttcagatatgcaaaatggatgaataaaagaatatagtaagtttatagataaaaccgaacaattttatttatttacaaattttacactcagacaaataatagttttttctatattatttttgagatgtttagcatatactataaaactgaataattgtgagtttttgtccgtattttactgtattcagtttgtctctttctgaccatagataccagtggttctcccactatttctgttatcggtggcctggagggcataatcatatgattttatgaaaaacagttatttttataataggatacatgtaaaataaataatttttatggaattaatataatttttaatgtagcttttaggaatttagttcttttaaagttggacacatttttagcaataataatgataatagtgttgacactataattttttgaggacctcttttgttccagatacagtgcctggtgctaggtattttatgcccatgttatggaaggagctttggaaaggtcaagtaacttggacacctagctagtagttagtggtagaaccaggatagcaattcttgtctgcttcactctgaagccagaggtctttccatttctctggcttgtctcttacagtgtgtctagtgttctacaaaattagggaccttcgttatgggtttttattcctctgtagtcagttgaaaattccattttcctccgtagatgaaactgcagaatgaaggtaaaatgaagtagaggcttggttcttttttcacgtaattttttttttcaaatgttggggttgagcttctccacaaggaagccatggtttccaggccatatagaatcaaggttggactcacatcataattcataatctacatttgtatgagcttccagcacagaatagactttcaaaaagtttcacttctaaattaagatatagaaactttcattcaaaattaagatgtaggaattttcagcatctatatctaattctactttgccatgaaaagaagaacaatcatcctatatagttgtaggatcttactgatgcttccaaggcatagtgggcagcagaaggactggtccctaatgtcagaaagattctaggtcaaatagttaaaaattcaaatttatgacacaatgacatagcatagttttgtaatatttaattatgaatttttaaaactttttgttaaatggatatgacagctttaaattcatatacatcctgttcaggttttgtagtcaaatggccctttccttagccccttctaccttgcagtctgttcttaaatgtgacctacttaaatggatagattctatattctttctagagaaatgcctcattcagtgagacataatttctctaacaagaaaaatgcattcactgtgtaattccaaaacctccaggaagaaggcctctgagtagctacattatagtgctccggaatccatgcactaaaaagtgcatctttctttaagagaggatctctaggttctcacttccagcttatttatgattatatttttaagcttttgttttctctatttctccgttcacagcaattgtgaaaaaagaaggggcatccatccttcattcatttattcagtcaacaaacatttatttaaggcctgttatgtgcccctgaaactgttttatgtactggagccattcacagcactaacagctgacagcaataactcatgaagagattttttaaaaaaatgtaataagcagatgcaacagtataaaacttcaaatagtttaggtacatttagtattatcttcccctattctgagaatgagtagccagccaggtttcttccagaggggcaagtagaatgtctcttactcgaggctgtagtttcttggaaatgaaacaaatgtgaaaaatttcaaaatcgagttgggttggctgtagtaaggaagccagggaggcaaaattaacctgccctcaaaaacagatctgaggcattgatctcaaactggagcataaggccaggaaaggtcaggactaaagagataagaatagggaacacagcagctcagcagctcagcagcttaagctgacaagccgaaaggccagcaaggtaaaaattagtgatagagctggattttaaacattccatttttcatgctcccatgggcaactcctctgtaattttgatataagattattttgggagtgggattctctttgtggggaaggggagtagaagaattaaaccttctcggccatggcaaattcaagccttccttaggttttatgcttatatgtgtgtgtgcctgcgtgtgcgtgtgtgtgcatgcgtgcgtgtgtgtgcatgcatgtgtgtgtatttgttgggaggggcagtaactgaccaattatgacagaaggcaacccctccttttgcccaaatccctcccttggcatttggtaggtggtgcaggtacctgtgggttttcacacctctgtagcctctgaggacttcactggattacaggagagtaataattaatgctaataatgaggactcagtggtgtcaagaaagatgaaattcttttatatatgtcattcatgtaagaaagcaatgactgttagatcttcccccaaccccccaacaaggttaatattttaatgcttgggtatttggaggagtaaataagtacttttgaaatttgcttattgataagagcttattctctgatattgcctgagtagatatattgttgctttatgtagctttagtgatatttctatcgttgagtgaaagtgaatcagggctagcactttaatttgcatttgtgatcaggattattcttttgcataaagattaaaatttgatttggaacaggagtcaaggatttacttcattaggtctgaattcacattttccacctcatttgaaataaaatattttgtaagttaaaatatatcttagctgggaagcaatgttataacaacatttcaccaaaattcttgagaaatgttttaaaatccaaaagtctttctactggtaatattattcccccgctgacttcatgtcaaaaccaaatgatgatgtattttccttaaggcattgtttatatggcaggtcttcaaccatatattactaacagtttgtaccttatcagacctgacaagattacagcctgaagagttatattttgattcatataagagtatggacttgagcttcaaaggaataataaggccaaactattatagttcaaggactttaataaatattaaatgataaataaggctggttccacactggcttcagggcctgtggataataaaagaaaatcttcaaatggtgccaaacagtattatggctgtcttgccttttataatctgtctttactgcttgccactgtagttgtcagagctgggaatgatgaggtagcatatgtagtttttgttgctgacagaattaaaagtaaaggagactttaaaagtaatccatctctgtagcaggataaatacagaaatgtgctttttggtaatactgtagtaggtatttaatcactcctcacctgcctactctctctaaaagtcaggttgtggacttgatgttaaatgtgaaacataccaggtgatatgcattttcattattgttaatttctagttttaatggaaactagaatttacttatatcatcatgtttgggatgtcaaaacatgtcccagtgggagagtgcagaatgcctatgattcatagaagatcactaagttatgtgattatatggaggaaaagtaaatgaagctgcttttcaagagaaagcccatcagtactattgttataaagtctactgtgggctgggcacggtggctcatgcccataatcccagcactttgggaggctgaggagggtggatcacctgaggtcaggagtttgaaaccagcctggccaacatggtgaaaccacatctctaccaaaaatacaaaaattagctgggcatggtggcaggtgcctgcaatgccagctacttgggaggctgaggcaggagaattgcttgaacccggggggtggaggttgcagtgaaccaagattgtgccattgcactcctgcctggttgacaagagcaaaactctgtctcaaaaaaaaaaaaaaatctactgtggcagacaaattctaagatgccctaataatcctgcctcctgttgttcatgcccttgtacattgaaattgggccagcctaggtttttttttctaaccaattgaatatggaaaacatgatgggatatcacttctgtgattaggctaaataagataatgacctgcccttttgcttaccatactcttccctttggtgactttgatgaaacatgttgccatattggcacatgcaaggaactgagggcatcctccagccaacagctagctaggaactcagacccttacctcaacaagtcctgtaggaactgagtactgccaacaactatgccagcttggaagcagatccttcctcagtcaagatttcagatgagaccccagccgtggctgacaccttgattgcagcctggtgagagaccctaaagcaaagggctcagttaagatatgcccaggttcctgacccacagaaactgtgagattatacatatgcattgttttaagcttctaagtttgaggtgttggacacatagcaatagaaaactgatacattagatgtattagtttgatagggctaccacaacaaagtacaacagactaggtggcttaaatagccaattgtgagaaatttattttctcacaattctggaggctcagaagtctaagatgaaggtgtcagaagcgttgatttcttctgaggcttttctccttggccttgtagatgcctgtcttatcctcgtctcttcacgtgatcttccttctgtgtgtgtcagtgcactagtccccttttcatatatggacaccagtcatattagattagagcccacaataatgacctcattttaactcagtcacctctttaaacattccatctccaaatacagtcacattctgtgggaactggagattaggatggcttcatatgaattttatggggaaacaacagttcagctcatacgataatttttttatagttatgtttatctctatagcaaaaactctgtagaacttactgtctgtaaaggtcttttgcttcctttttattctttattttaatgtaattatatatttttcagatgatttatatatataaaaaaatcacatagttcagcacatatattttcatatccctgtctccataacaaaattcagatctctgtttaagtatatgtctttcatgtactttattattattattattattattattattatttttagacggagcctcccgctgtcacccaggctggagtgcagcggcacgttcttagcacactgcaacatccatctcccgggttcaagtgattcttctgcctcagcctcctgagtagctgggattacaggcaccaaccaccacacccggctaatttttgtgttttttttggtagagatgagattttgccatgttggccaggcttgtcttgaactcctggcctcaagcaatccacccgcctcagcctaccaaagtgcggggattacaggggtgagctactgtgcccagcctctttcatatactttaggtataacactttgcaatatttatggtattgctgttagaggcattttcaaaatctacctttactttttgtgtttgcttgcatacttctaaataagttggaagtagcttgtcttaagaataagtacttgttaaaaagatagggagtttgaagaatttacatttatttgaagtaggtataattttagataatggtaggtccagagagtatctatctttgtatttgggaatccagatataatggagatacactgttagagcctatctaatgctgggctgatttattaagacactgttttttgacactttgagttattaatagcactatacgtgtttaaaatatttttctaaatggccaaaaaaaatctacattatatacattatatacaacagttcattatagcacagacgagtggttttcagagtgtgtctgcagacccagggagtgccagaaactctcttaggggatcttcaaggtcaaaactatttccaaactaaaactaaaacattattttccttttatttaaagaagtgttgacatttttatatgtgttgacatgtgttgcatcataaatgcaaaagaaatagtggatgaaattgctggaggctttgcattaatcgaggcagtggtgttaaactactggcatttgtattttaaaatagggataatattgccaatataagatggtggttgtaagatttaaatcagatattttgtgtataagttttcaactaatgaccactatacactgctacccttatcagcaacatgtgtttctaccatatttttgtcttctctctatgatttattttgtgttttgatgagtcattttggttatatttatgtttataggtacctccaccaaaaaatcaaagaagaatattaagataattcttaaaacacaagtctatagtgtttcatgtttcttcaaagaaatggttagggaaacatagaaaggtaaagatgagcaagcaattagggatttttggaaatctttgatattaggaagagcatcatatacctaggaagttgagccaacaattgtaaggagaatggttaacagaacatatgactgaacagagaacattctccattagggataaaatataattacctgacttagcacttattccattggcaattcaatttccatatatgcatcctctgctctaaattggtatgtctatactgggttatttaacttattacaataatatatacttgatgtaaagatgagaaagaatagtattgttttgtgcaatttccactattttcccgaagtctaaatctagcactgttctatactgcactctgtcaagcatcaagtcagtgaaaaataaaattagattgttgaactatgtgctattcacttaattctaaatttgaattatcattgtttcaaaatgaaatcaaaggataagtaaatgcaaaggccttttgtcattttgttatgctgtttattgtgttttattattttttgctttatttttgccttattctgtttttttttttaacagatcatcagaaactagaaagagaagctagaatctgccgtcttttgaagcaccctaatattggtgagaacgtatttttaatgttttttaaatgttaatttaaaattttatgttatttaccacaataaaaatgctaattttataatctagaatatttataacttttaaaaaataggttcctaactttcaatcttggttacatttgatacctcaaagttttcctgtgtttgctgtttgttttttgatgcaatctttgaagtagaaatgtgaaaaattaagtttgtggaaacaaagatactaaattaattaatagtgtatgttttctgttgtgctgaaagttgtgtaccaaccagtggaaaacctgagtgtaatttaaagaataaataaataaatttaggtaatccctggttatattagctttattttaaccacataatttggagtctgctatgttaatgagttcaatgtcctttctgtagagtcgtataatgaaaacaataatcctttacctaattgggaaaatagttgtgaaggtaaaaatgaaacaagtataacaattttttgaaaagttatatatatagtttttcaaaaggttgtgattatgtataaacacttcaaaaaataatataaggtctcatttgaatagtgcttttatgtgtctttaagaattgttcagctacaggccgggcgcggtggctcatgcctgtaatcccagcactttgggaggccgaggcgggtggatcacgaggtcaggagatggagaccatcctggctaacacatgaaaccccgtctctactaaaaatacaaaaaaattatccgggcgtggtggcgggcgcctgtagtcccagctactcgggaggctgaggccagagaatggcttgaacccgggaggcggagcttgcagtgagctgagattgcgccactgcactccagcctgggacgagagagcgagactctgtctcaaaaaaaaaaaaaaaaaaagaattgttcagctactgctgctgaagtatggaaagacaggatttatgtcatcactttactcagctaaattacattccatatatcctgtagaaagtttactttaggccaggtgcggtggtttacgcctataatcccagcactttggaggggtgaggcagaaggatcgcttgaacctaggagtttgagaccagcctgggcaatatggcaagaccatatctctacaaactattaaaaaaattagctggatgtggtagtgtgcatgtatggtcccaggtactagagaggctaaggtgggaggattgcttgagcccaggaggttgaggctgcagtgagccatgcacttcagacagcctgggtgacaaaatgagaccttgtctccaaaaacaaaaaagtttaccttatagttattgatttgattctagaaatagtaaaaggactttagaatatttatccctcatgaattataaaattgcatgacttttcaaaatttttaaaatgtgatgaatataagaaacaagaaaaacacaggaaagaaaaagtaaattcagaaatatgtgtaaactggattctgtgataataggtttgattattttggaaaaatgttactgtcccagctccctcaattttattgttaacctaagtatttctgatctagaagcagtgagaaaaggggtaacagtgatgtagaatttgcaaaatctttcactgaaaagtttacaggtgttttaattttatgtgtaggggcattcaatttctattcctgctttgatgtttttagtattctgcacttagtgggtgcatcttagggtcttaaatgaatggatactatgggtaaaaaaaattgtaacactggcaaattcacctatatcattcactcactcaacaagttacatttctaggtgtatagtaggaacaaaacatactgccagctgattaaaaggaaccttctggtttgaggagagaacaaaacaactctgacatataaatctacctctctagaagcattttactctgacaaaaatttatggcatttcttgtttggctgtattggtttgctaagactgccagtaagagagtaccacagactgggtggcttaagcaacagaaatttattttctcatagctctggaagccagaaatctaagatgaaggtgttgtcaggtttggtttcttctgagacctccttcctaagcaagtaggtggctgtcgtctcactgtgtcttcacatggtcttccctctgtataatgtctgcgtcctcatttcttcttgtaaggacaccagtcatattggattagggcccacactgataacctcattctcacctaattacccctttagacactctatatgcaaataatacagtcacattctgaagtgtgctatcaggattagcatatcaacataggaatttggggaggacatcatttgcccacaacattggctaaagagaaattacgcaatgaaccactatagttcaaagattacttctcttgctcaggtttaagataaaatcaaatctttgtttagtgaagttgcaattcctgtgcagaaagttgttatttgtttgttttggtttggtttggtttgtatcaggtcctcctatgaaactcaatttttgtggataatgaaactagtttcctccatttcctctaggataccaaagtcaaacactcgaaaaactgccaagctaaaacaagaactcttttcattttgacactacatacagactaaacttataaaaagagaaagaatgctggggaaagttctaaacttttgtgtcctagatagcattgtcaacaccttctgacacagtgtacatctttttgcgaggatccataacagccaaatgtcataattccttggttacctcactggaggttttctttaaccttttaagatttcaggagtacaaaaggaactgtgacaattctaggtccttgaaccctaggacccatttctaaccacaagagagatttcgagtgatcctttatctcagtgtataagtcatagatggattaaatttatgagacataatctcaaaaattgtaacactggcaaattcacctgtatcatttactcactcaacaagttacatttctaggtgtatagtaggaacaaaacagaccaatatccctgccctcatggagcttgcagttttgggggagacaggcagtaaacaaagcattggatattagatggtgataattgttgaggaaaaataggaagcagagagggaaatactgggtgttggggtattccagttttaaatagttggtcaggaccatttcatagagaaggtgaaatacatttgaatgcagacctaaaagaagggaggaaggaagtcatttggctctctgggggaaaaacaaacaagcaaacaaacgaaaaacattgtaggcagagggaaccaatagcctgcataagggccctaaggtcagtagattccaccaaagctttttatctaatgagagaaataggagatgagttctttctcattttatcttaccttaattgatgaatctccatgacatgtaatctgacagtgttgtgtttattcatgtaaagaacgattttaaaacatcaataacaacagtgactgtcataaaatagtaagcaacagccaacaaaggaggagtgttttaaagacagatgccataagtggacatctgcaaatgcattggagagtagttgacccagggtgtaaggaaagtactgcagttcctgtcgatcatcgcactagttaacagcaccacatgaatcactagtactcaatcatgactgaatcatattacacagggaaaacagcatttgctcttgatttccctgacataggtaatatgatatctaagtaatatcagactcttatcctcttctccctgttctctattttattatttccttggttttaaaatcagctaggctttagaactttaaggaaggaaataactatttttgaccattttttcccctgtgaaaatgtgcttgtttcatttttatatttgaatgtgtctttctcttggcacagaatcaataatcttgaaaacttgcagcaagcaaaaggtttcttccaaagaaacacattttaaaccaactaaaaatggtgattcattaaactactttttttcatgtgttattttttatgtttttctgaccttaaaagtaatactgttagtggaaaatttggaaaatacaacattgtataaagaagaaacctgagggctcaacttttaatatttgatttattcatttttgcctttttataatcttatatatatatgctaattttcagcattctcttgtgtgcattttcatacccctttagatatatcatgaaaatggtctcacccaacaaaatttcttgagtgtgtagccattgccaagctttgttctaggctatatgcactggtgatgaaacagtgattgagagagacaatggccctcttttcccaaagctttgcatcctagtgtataaacaaaacaccataataatgtcgtaaggatttgttctatgcagagaattaaaatagggtaatttgataccaggggaccgggtggctactatcaaaaacaaacagagccagacaccagttaaagccgatacagattttattttgtactattgcaattgaggaaagaactgaacttcattccaaacacagcaatgacagctggggatttatagtcaaggagcagagtgagggggtcagtggatggaagatttttaagaggagacatcaaggatagggagttgctgaactggactaacaagattcttgctaaaggcaggccaaggacttagacattaagggtagaggatgaagaccttgatgagatatcaaaggtgggaaatcacttcgtaggattcttcatttaggctggcttaggaaggttagggacattgtccaaggatgagatctagttgaaaagaggaacctgcctgatgtttggttagggagagagtcttggtcactgctttagagcgttttgtcaggcaagatatatctatggaggtcacatttaaactgatatctaaatgacaggtggaagccatcatgaaaaagagaaaagagtttcaggcacagagagccctccttgttaggggaaaagtagggaaaccagtagatggactgccatgggggaaagggagtgactgaacagggcaggtagatatttaaccaagtagggtttcgttaaccagatttgggagtttgggtttcattctacatgcaatgggaaaccaatagtgggattttaagcaaaagtgtatcataatctgctttgctgtgtctgctatgtgtaaaatggtttcctagttacatgagcacaatcagtgataatagtgttcagtcaggatatcagaatctagtcttatcagcctagtacccctgaactacatcttcttggataagaatttaaacagctccaggttggttctctctttggtgtggtccacatgatccaagaaagcaccatgcatcttttggctcaacaaattgtagagtacagcccgtttttaaagaagctccatctttgctgtgctctagccaggcaatttttgtttgaacctcaaactggaaagattatagctgacattaagatgttgaagcaatttgaggagaacaccttactttgtgcttagcttagttaatgtttgatcattctgttcaccttttattttaataaaattggcttatttttctttgaggaattaacaaatttgttgtaagccagaaattctgagctatatgtcaacatatgtatcaaataagtaaaagaaaaatacctttcaggtattgaaataaaatatttgaggtgatagccaaattctcaaaattatttgatattcatactgtttttattcttggtctttgatttgaggaatttatttaaacttatggtgaagctcagataacaaacaatggtaaagagaaaataggaaaacaggaaaaaaattcatttaattcaaccataagagtccaaaaacagctgggccaggaaaggaaaagaaaaaatattgagaactttgatctgacttatctgattgtcccaagagagaagatattcatgtatgggcctttatttgggaaaagatcaatatttgagacaactttgcagttcatgggatgatgaattctgttgccgggttgtcccattccctaaagacttgtgtttacattttgtgtagactttagaaagagcaaggtaattttttgaaagtttgaagcaacatttatatttgtagattaacactatctttataaggtaagcgtttcccattataatatggcttaatgaacttcagcagctagagagcaaatggaagagctatgtaaccttttgaatctagtctttagtgataccctggaacccctagtgcagggaatgaattaacctttctagatcacgtcatagctcaatgattacctcctctctactggctttcctacccactaccccaaaatgcataaacacactcactcatacactacaaagtgtaacagataataagaggcatagtgttaatggaaagctctatagattcactgggccacagtttattctccttctgatgctggcctgctctgtgatctgcttatacaatcccatccactcaccaagttctagttcctctctttgtaaagcagagaaaatatttgccttttttatttccttccaagaatcaatagaatgaggtaatgcatcttactttggtgaggagttaatatattttgtaagacgattaatttaaataaacagttgagtacattattatggggtactgcttaccaagtagtaactaattaattcatttcttagcatttagtagtgtctttctgagatgtgcgtattcaacaatggggaaatatatttcagaaactttcaaatatcatatattctatatgatatatatgttgtatatagtatataatatatgatatgtattacacataatcagataattgtaatattgcaacagcagatcctatacattatctagcataaactctaatttttttgttttaatatttaggagagctaaaattttccaaatgtatatgatttgtccaaagtcacagttctttaatgatattgccagacctaaattgttgattgcttctgtaaagagatggcgatgtttagggaacctaacttgaagcagcaagattgaaaaagcaatgtttttgttcccttttgaggagagttttgaggttgtttttggttcaaatcgattcctcccctcacataagataaacattaactaaaaaactttcaatattaatacaggaagagaaagcctttacattttagacagcataagttacagctacctaccatatatattagccctggtatagaaccagtgtgtttaagaaagatgctctgcttaaagatgatttattgtttcacatatataacagtacataaaatttcatgtgctgacaggtggagattaaagaatatataagagcctttactttctataaaagcatgtttcccattcctatgagtaataatggcatttaggatctatataattttcttttcctaaaatttaaaactggaagagctcttaggaattacctaagaccaacctagattctacaaattgaaggtttaagtagtgaagtaatatgcccaggatcatacccagatctaaaaagagatgaaaaacacacaatctgtgtattacttcgtttagcacgtagtgtttcttctttttggtgactttggagatatgatgtcatcctgtaaaagtaatattttaaccacaatcttagatctccctagttttcacaagaaatttttcgctcaaataccattcctcaagtttttatgaaataaattaactgtcattttttgtttgttcttttgtctttagcagatgattttaaccataaattttgcctttttatccttctctgcatgcagttgtcttctaggttcctcaggttctgtaaggaacccatacaatcacattgtacaggttaagcttactaaatatttctcttaaatatacccagtatttacttataaatgagtaaattgccttatgtgtttattgtaccaatattccagtttttgaacccttggaaacaaaatcacataggaaagaagagtagagttaatgcagagtaaatgttaattgatctactgagaaaacaaagttaatagttttatgaatgacaattaaaagtctttttcaatggcatcagaagttgagcaacagtctaagaaagcgacgcagtttttttctgtgacctctcccttattgatggttctgcctaaaaattagagtagtttgtaatcaaacaagagtaagtaatttttcttgttaactactttctctagtgactctctaacagattaaaagtattttaatactatttagtagcaaaaagcaaattatcttattttatatttaccttatttgattaaatctcagctctttattatgattatttggtgagaaggccaaattacttcttagaatatataacagtctgcaaaattgattattctcttttaataaatgtgagaactagcacagcgatatatttttctcttcaaataaatatgttcaaaaaattctaattatctgttttagctttttttcctttgtttatacaatatggtgccagttatgtattctttataattcttggtagaaagttaaatttatcgtctttttaagtaaatgcttattttactaaaaagacaaaatttgaatataaaaattgtatattcaagataatgcttcaaaatcttttccattggtgaatttgaatctgagtacatttgttactggtttctttgtcaatatttttttccatgtatcaatgaaaaagccacttcactaagttaatttagaagtaggtagatttatacatgaaactggagaaaaagagtccttctgttacaaatgaaggatagtttcatttttagagttacttatagtacatagattacactttgatctatcaatgcataatatttactgaaatagttctgatttattctactaagcctatttgatttccatcttgccctgtctccactacattcagggtagaatcccctaacagggtattggaagtttatagtaatttcttcagctcagaagtcggccctaaactgaaatttgaaagaaaaataatcccaaacatgaggagtactttgttttgttggggcttgagttgtgcagaatcccacctccactcccttttctcaccatggggaagaataactcatgtcgctagggagcccagaagatagttggggaagtgataacactttttgttcacttaaaaatcattcctcttttccctttattccagtagcattgataataaacttgcctatggtaagtacttgtattaagatgtgaagtaggccgaattagaaaaaaaaattagattggaattccaaagaacttcaccactagaactaatgataaaactattaactgtgttatcaggctctggtctaaagtgttttccatgcattagttattttaattctcataacaaacaaatatcattcttgtctccattttacaggcaaggaatctaaagcctaaagaggttacacaatttaatcaagatcaggcagttagtaaatggtggagttggaatccaaacctgcatattctggcatgacaatctgtgctcttcaatactgcactgtatcgctgctgtataactctgaattagtcatactattctttaataagtgcagaaaataattttaaaattttataaacattgattaaaaaatccttgcttaaattatctaattttagtatttattattagtccttgttccagagggaaatattagcatgacattattattcaaatgcttatggaaaatataggtattatagaactaattatattttaatgacaatttttagtatcttggtaaaaaatctggcttatcttttacatcttttaggtggtcacatctggccctgaattaattattatcgctgtacaagacagtcttttacttttctctcttactgatcatgaaaatgaataaaataattgtcagaaaacaatgaaggctaaggaaacaatagtaattaatataatttgtacaatgtatgacaaaacattttaaaactctgctttacattgtagaaaaagaaatcaggaccagatagtaatgtgatgatgaattcttacatcagataagccctcaatttttttaaaacaatcattgcttataacttacttagagtatacagaggaataccaatttaggggtttgagataacttttgaaagtgtactttagagttcaattatagcatttctttttgtcactttttttcctagctgcagtttactttggtaggaatttgccacagtagaaaaggtagcttcatattcttattatttacacatttgaacacaggaatttgttttctttaaaaatgctccataggtagaagtgtttgctctctgaatttgatttatagtacatcagtttaacaaaatcatatctagctctaatgagctcaccatggatttatgatcatgtcaggttattgtttgaaataacttgttaattttattatttagtttagaagtctaatggtctatgttgaaggaaagtaaacagtgatatgacttgaattctcttaaaatattctttcacgtttttcacttcagtagtaatttataacatatcctgtgaaatgacagaagattttgctcacactgttgaagttcagtagtttttataattcagtctccaaagattactttcagtttttagtgatgggctattgtgtgttttaaccaaatgcatagaataagaggaaaaatttttgtagcataccaagttgttcaccaaagaagataacagtatgtttcgtgagcattattttgaagtgtaggatgtcttttctttcacttgttctgttcagaaaatgatattacttactaatacatgtgcagaatctcattattttgtaaacactttccttgagacatccataattattatttccataggcataggcagttttgcatattcacatgaatttgtgttggatatttgtcaaaaaacatgctatgctttgtcttatctatttttcatttagagcaaaatgctcactttcaaattgaagtgataaaacatcccattatattttgattagatctggaaatgttttttcgaaatcttttgaaaaatttaataaatgaaatgttaatttaatttgtttccacccattatatttttctctaatttctttttttttttttttgagatggagtttcactcttgtcatccaggctagagtgcagtgtcacgatctcggctcactgcaacctctgcctcccaggttcaagctattctcttgcctcagcctcccgagcagctgggattacaggcatgcaccaccatgcctggctatttttgtatttttagtagagatggggtttcaccatgttggccaggctggtctcgaactcctgacctcgtgatccacccacctcagcctcccaaagtgctgggattacaggcatgagccaccacacccagccgtctaatttcttaaacaatcattagattagttttatgtccacatttgatattggaattaaaggaaattatattaatctggggaaaggtaaaatgaaagataagaaaaataaaactatacataatttggaagttgtctcctatttctttgtttgagttgaagtctcactctgtcactctggctggagggcagtggcacgatcttggctcactgcaacctctgcctcctgggttcattcaagctattctcctgcctcagcctcccgagtagctgggattacaggcacgtgccaccacacacagctaatttttgtatttttagtagggacagggtttcgccatgttggccaggctggtctcaaactcctgatctcaggtgatctgcccacctcggcctcccaaagtactgggattacaggcatgagccaccacgcctggccagttgtcttccatttctaatggttaagcttgattgagttgaatagcgctaactctgttgtagctaaagtactggtagactacaaagatgaatgagacatattccttgaccaaaaagagttcacaattttaaaggacaaataattatgtatgcaactgaaatatagtgtgattatatactataatgaaactactaataaggtgccatgggagcactaacatacaagctaagaatcttaactgaaatatattggatggtgaacagaattttgccataaagttgtagggattggactgaagagcattatagaaagacaggcccacaaaagaaaaaatagagttaaaagtctttgtcgcacttgaatgactgaaaacctgtaatgattggcgttattatatatgtgtgtcagaaataaaagttgattgagaataataatggagagtctgggaaggaatttgatttttaatctggagaaaataaagaattaattaagatttatttagtcgactcatgattatatcagttttttaggacagatttagtagtaataagcataattatgtggtgtcaggaaaaattggtgttgaaagagcatctgaaagtctctggagtgaatgtaggtgtaaggcatgatgagttcctcaaccatagcaatgggatcagggatggcaaggagggcaaagctaccaaagatgttgctgtggaatcagatcttgagcaacaattaacttgtggcagatgggctaagaggtttctttgaggtttctagtttgcgtgactagagagatgttgatccctttaactgacaataggcaacaaaggaggaaaaaacattgggagaaattagaaatttcactgatttgaaaacattatttttttaaggattggaacatttccattatgggggaacatggacaaaaaaggaagactagaagtcgcaaatgccactacccaaacccctgatctttcactttttggcagaagatataagcttcttaccatgtgagcatcctcttcaggatggaaatatttggctgtgactgtgatcatctttcttagactaagactgaatgctgctgagtcaagagcagtcaagttgggtgctcaaagtatctgctgaaaaagcaacataacgtctgtagcaactccatcaccacctaactgtggttgagcacttatttctagggtgctttttccccccattctgtccactaaagtaaagctcacttcttaccggtcccttgtgcctttcccaaacatgtatcttttgttggctcaactactttcatttgtgtatatcccatcagacttgcatgtgggataccacatagagctgtagagagtatgaatatatgttttgagtcatctacatgtatgggatagtgagagcatatgaacgtgcccaacagtatattaccaagggggccatagacagaatgatgaaaatgcttatttgtaaaaatttgacttcttttaaggagcaataacaacagccattttcttagattactttcattctgaatatattttaaaacatttaatatataaaacagctaaatttttattctagatgaataaaaggaaattatatttgggaacaaaatattttgagatgtacaaaaatgcagtataggcttctttttacaataataatccaactaccccaattttaaatagggttatatcaatttatactcttagaaaagtaggaagactataaattttaactacagtcttaattttgttaaagctataatgagttactattttgaaggtcattatttccttctgccaatctccttctcccaaataatttctcatttaaaagttgtagtgccaaatgtgcatttaagcttatttgttaggaactctctaagagaactctgataaaacatggttttcaaatgttattctcatatgtgttgattattccagtgaccttttcttttgatatttcttatataaatctgccattcaaaattaaattacatcttctggtcattttctaagaatatattcataatatggatgagagaaaagagatggaaccatttttcccccacagaaagacagaggatcattcatttaaggtaacagttttcaacctgggatgattttgccccctctactctctcttccttccggagacatttgacaatgtgtagaaacatttttgactgtcacagttgtgggtgccattctggcatctcttgggtggaggctgctaagcatcctacaatgcacagaagagcccttcacaataatgaattatctgctccaaaatgccatagtactaatattgaggaactcagtgatttaaagtaagagttacaattacaacaaaaagataaatagccagcattatttgatttacttctggggccatgcaattttctttttcataaaaaaagtaggcagtgcatcttcttaagtaaaggacaaatctattaaagaaaataaactgcttttgaaacaatttatattgtatctaattaaattgaagcatagaaattgtacggtaagcagagccaaggtagcatagtctgatgctgacatatgctaattacaatccttataaatctattcatcagaacagattttattaggcaaccttggcaatcctgattccttcacacacaaaaaggtaatgaaagctatttaaatataatagaataatttagtcttttaactaattttgacgggtcttttccccaattaatctgaatcagtgatgtgttactatggtgtaacaactgcaaaacaccttccagtgaaattttttaaaaaattatgtaaggctatcatgaggtttttcggtaaactagaaaacattattttttgagataataaataggttggaggtttatgatgcagttatttgtttttcatttgggaaggttttaatgtttaaatggtgaagtgacaatatccgatttaattttaacaggattactctggctactgcaagtctgaccatgtctttcctctcctcggaaactaatcagtggcttcccactgcactcagagaacgaggggatggcatgcaaggcttgcaaggccttccacaatgaacaccctctctcccttcttagcttattgttcttctgatcttagcttctctccccctcagttgctctgctccaacccctctgggctccttgcatttcttcacctgttcctgatatcctcctgctgggcctttgcctggagttctttctgaggatacagcaaggaggcatgctggctcacttcctgcaggcctttgctcatccaaagtggaggcctgccctgacagctgtgtgtgaaagagcagccttcctcccccatgccccacccagcactccctagcatccttcttgctttatctctgatgcacttaacaagattttgtatatttacttgttgatttgattgttttctacccagtagtatgtaaaacttcatgagggcatggacttttcttgtttattattgtacctaaaaaagcacctgccgtagagtctgcgctcaataaatacatgctataggagttaaacaacgtgtgggtacatatattttttttaagttcaagtttagattatctgaagaggaacaaacacttctattaagagaaaagcataaattttaacttatggcacagctgttttgtttaagttcatctgcaggcttttgctttccttctggctaaaatgactatcaatggccctgggctggcccacacctaaagactgtaaaacaggagagcaaacaattgacttctccctgacttgctaagtcaacaaaccacatgagtcagcaaacctctttttactgcctgaccttccttaacatctccttatcgtattctgaaattcctattctgctggctggaatcttggcccagacccttttggtgatctttgatgtgtttctcatacaccctgcagcatttgaatcatctttgtcaggagtgtgaggggctcatggtctcttttatgtggcagacacctaaaactgctagctgcttccttaccttcctcgggagcattttgatgatactccagaaagcagaacagcactatcaataaatgtcatggatttttttttttctccttgctggattacctagcctttcagataaggttggataaaccttattctagggtagccctttatttgactactctacccttccaagcaaaaagctgcttttcaaatgaagttatcaaactacagtagtcaggaaagaaagagaaaggttggttatctctcactgtcacttgggagctctgtcctggaacaaggattgacaaacttttctgtaaagcacccaatagtaaatattttgggctgtgctggcagtgctacctctttgtcattgtagcacaaaaacagccacagaaacttcataaatgaataggtatggctatgttccaataaacctttacttatggacactaaaatctgaatttcatttaatccatctcaagatgtaaaaaacattcaggccgggcatggtggctcatgcctaaaatcccagcacttttggaggctgaggcgggcggatcatgaggtcaggagatcgagaccatcctggctaacatggtgaaaccctgtctctactaaaaatgcaaaaaattagctgggcgtggtggcgggcgcctgtagtcccagctactcaggaggctaaggcaggagaatggcgtgaacccgggaggtggagcttgtagtgagccgagattgtgccgcttcactccagcctgggcgacagagcgagagtccgtctcaaaaaacaaaaacaaaaacaaaaaacaacaacaacaacaaaaaattctcagtacaggctgttcaaaaataggtggtgagctgaatttggcaattgagctatagtttcctgacccctgctctacagtgagatgacttcatctttgtggattacttggaccttggaggtctgctgaactccctaatgcttttttttcttggatctgacaaatagctttatttgtgtctcccggccactttgtagattctgaatcctagaagggagaagctaaaatatctgggtgcagtgatgatctgctttgcttcccacttctgagtttctctaattctggaagatagtgtcatttcaactctgatttctggtttagctcagctctcaattctaggtctaatgtgatacaaaaagccttacacctgttgcttggttttgtttcagtcttgctgttggtcttattgttacctaccttctcggttgcccattgactagatttcttgcctcatgataaagctctggataatagctgcctacctcttggtgccttcatctgccaaccaccacacctaggtaacctatgaattttagacttaagctgagactactcaaggcttccctttattcattttccttgggaactgatgatctatttcagattacctttgaatttacacacaagtgctgcttctagaataattttgactcctgacttttgctcttacttttaaacttttgtcccatttatgatataggtcagctttgtcttcatttggcagatttgtaaccatctaagccaagaatctgacaagatattattttttctgtttcttctgattttattgaggtctttttctttttgaacccatctgtttccccatctttctcaaaacaccctgagtataccagggtctgcacgtcttatgaagtcaaagttagaatcacttcagttgtgagcttgcctttcttaattacacaaacttcttctgacaataataggtataaactagaatgacataatttgatgtaatataagaccatttttcagagtacagaaaagcatattgtattcaccttgatttgcaaatatctcatgaagagaattactttattctttgggcctatttttcacttgtaaagctggcctgggtccccataaatactctgtccagtttaatttgagtttaacatgacactgaggagtagtctgatattactcagagagggtgatacaactctgaacttgttggcccttatcagatataatttaaatttcccctggaaagggaaataagcacttggaatcaaggcaaagagccaaatccagcagattatcaagatggtcggtgggaggaaagtctgatggtttccgctgctaagcgtgggagatactgacctactctcattcacttacttttgtacatagatgtagactgtgagctgccaaaatagagaacaattcttactttctgtcagcagcttatcagaattccctgacctccaaaaatgatgaacacagtccggaccctgttcttatgactggtgattgatacagctggcttagctcttgttttttgacttgcttttattgggccctggactatttgttctacacactttaaatttgggtgcatgagcacccaggtatgacttcatagacagccctgtttctgatctgaacctatcatacttgcctctggctttgcccttttatcctcccaactctctacactagtgcttctgcccttgttggactttttttaaaaacttttttatcatgtttgtatcttatatcttggaagacagaattatccctttctattgaaatataatacttttagcatatatttgaatgaatatagattgaagaaatgtaatgtcacttgtcttccaggaaagactttcagttttgtggattaaaacatttggtattttgattgtttaatttctaatcttgatttataggacacagatagtttctgctcttcttttgttacatatctatttgtaaatgatttggtaatactgttcagatgttccctttttctagcttttcattttaaattgtagtatctttcttttattttatagatatagtttagcatggtctctgctatggtttggatgtaacttgaccctgcccaaactcttattgcaaccataatttccagtgcagcaaggtgtagggtagaaactgtatgagagggggcctaatgggaggctttggatcatgaaggctttgcccttgccctggtgggcagttggtgcctttctagcagagcgcgactccatcttgaaaaaaaaaaaagaaaaagaaaaaaagaatgtcccttgttctaaccagcttccacagacagccttatcagaggagaagtatgcttttgccatctctttatggaaaagaaaataagcctttagcctagatggctattgttgcccaaaaaagggaggagggataaatagcttcactccgctgctaagttggtatcagtttgggtttaattcagccttagcatgtccatctgtccacttctgatgacacttgtatgtgtgaggaatgtgggagacagggaatggaggtgagtggacattctggtagtgttcagatatgccttgattttctccaaccctggaagggagtagttctggaatcctcctacctgtccctcaatttttcactttactaagattataacttatagcttccttgagatagaaatgactctgcagagcccatcctgaatggaaatcataataaataattcctatatccagggaagtctgaaaactaatcttgtttcctgtttttggagcacagtaactggcaaaatacatttggggtgagtttgacttttagagggtggttctgaagcattcttatatgttagattcccttgataaaatggcagattcttgagcttcagcattacaaattgatctggagcgggctctaggaatctaccactttttaattttttgtttgcttgttttatttatttattgtttattattttttattatttttaaatttttttagactgagtttcgctcttgttgcccaggctggagtgcagtggcatgatcttgactcaccgcaacctccacctcccgggttcaagtgattctcctgcctcagccttcctgagtagctgggattacaggaatgtgccaccatgcctggctaattttgtatttttggtagagacacggggtttctccatgttggtcaggctggtcttgaactcccgacctcagatgatccacccacctcggcctcctaaagtgctgggattacaggcatgagccaccatgcccggcaacttattattttttaaatcaagcacccaggtgattgtgatacaggttttcaaagccacaatttataaaaaacgttgtgctagtgataatgttttagaaaactaaattcccagtaaagctttgagccaggaactttctattaaactctgtagctctctaggctccctgtcctctttatcactttcgtaacaggtctagagaatgaaatctgcaagaaagaaagatccttagatagtgtcaatctgaaacatattgtatctaaacacttaacataattatcttatttaattttctcaactactctgcagatataaatattatatcaagtgtttttaatttagttcagtaaatatcgagcctttactatgtgctctgtacagtgaaaaagttcagtctcaaatagatatattaatttgactggggttgcttagtttatgaagggtggaaccaggattcaaatacatttgtttgattccaaagttcatgtttctactctacaagccttctgttcttcacttcctcatctgctcaaagctgtgaaagctctctgtgcagctgtattactttttatttaaataaagcactagaaggtgaacaacatgataccaaacactgttgacttgtaaggggctttcttcctgtaagagaagttaggacatttacacatgaaaatactcagcagttcaaagaagcatgtaattaagtgcccaaattagagatataaagagagaggctcatattgtctgtggaatgttttctacagagcattgaacacatttaagaatctgaaaggataagatttagaaaggaaggaacaatgttgtctccaaattatgaaagttaaaatgagtctgtctatggatgatgccaggtaattatccttctaccttataaaagttgtcaacagacaattagctatgtaagtaattttcccctcattcctttcttgttgaacagtttctgaaagagaagcactctattgtcatttccttaatgcacatttattttctaagcgtctgctttcaggcttcttctatgtgttcctaagaaattgctctcatagtgattatcaccacctccttattactaagtccagtggaaccttcttgttctggtcttacttgatgtctctctatagttgaatgctccataccttccccattacaatactgattaggttttgttaggactatttacctaatcatctaacttttctgatagatagtaagctctctgaggatggggattgagtctgtcttgtacgtaaggaaacaatatggcccaggaaaccatatgagttacctcctttggcttttgtaacataagtattttctagatttcttctttatctccaaccattcattcctaatctccttcgtgaattccccttctgcctacctcttaaatctacgcagggcatttcattcatatattagtaactcccaaatctattttagaggttttaacgtttctctccagacacgtttcctactagctagtggaatattcacttggatgctattctggtactttggtaatcatactgtgcataaaatggaacttgttttccacccttgccccactcagctcccacccagacctgcttctctgcttgtgttccctgctataagccttgcccaagctagaaatctggtgtcatcctctctacctctccttcccttgccaacttatataagcacttagcagttctcccttcaactttctcagtggcttttaaatctatcccctccccctaacccacatgctttaataagccttccctcttctgaattcttccctttgctatgaagaatggggttttttaaaaatgcaactcggatctgtcactctcctcaaaatcctcccatggctccctaatttatcaggctaaattctaaaatcctgacattgcaaagtcctttatattttgagttcccctatttgtttgctactctccagccatacagactccctccccaaaactgtaatttcttatttttccatcttctcttggtacttttccacttacattctcttggtgggagacgctcttcttctccctcccactttgtctggctgaactcctcctttctgtttaggcctcatctttggcatcaccccccagccttccctgatgcccctaattggtattctagggtgggtgttgtagtgtacaaaggtgcctggctgaaggagtgagtcagcgctggtgcagggcttcctttttctgatttgcacagtggccctatgcaggctagtagtggctctggtaccacattacttatttacatatccttattccccccacaaaaagccatttggccttagggacctcattcactttttatcttcagggcctagcaaacaaattgtcattagatccagcacagagtatggtataataatcttgcctattcatatccactgctttcacaatttactatgcattttttttctttttccttctttttatttttgtccttaagagacaggatttttctctattgcccaggctggagtgcagtgaagagatcatagctcagtgtagcctcaaattcatgggctcaagcagtcctccctcagcctcctgagaagctggggctacaggtgcacaccaccacaccgggctattttttttttttttttggtagaggcaaagtttcgctatgttgcccaggctggtctcgaattccaggcctcaggtgatcttcccaccttggcctcccaaagtgctgggattacaggcgtgaaccaccgtgccaaacctacatttttatatttattatttttttctgattaacaataaagctaggttattagctgcctgggaagaggaggaagtagatttttacattcacttttaaataaacttttaaattcacatgagaaattccaccttaccacaattgtctccctaacatgtctttggactacctctgtttctctaagtttttgtttttttctggtgtctgaattaagttggtgacagatttgggggatatttgagtagcactttatctagagttgcttgcacaaaagctgagtaggagcatagccctaatgagttcgcattaccgaaacaggtccctgtttgctgagagtgaaattcctctattattttcttaaaccccgctttgctaaagttataaagtggtccaactgcattctacctttaactccaaactgttctcttaaatatgtacctggcagaactgagagcacattgtgttttgcatctcgtaggtatctaacctacccccaagggagatattctctatgggaatcacacctcagaaaagaaaataatatactttctcctacctctctcattgttcgcaggctcatattctccaaacctctatctcatttttcttcttgtgctctgtggttcccactctcaaattttctctctctctgtctctatccttctgtctctgacacacacacacatacacacacacacctgtctttctagtcagagctgtttctgtgttcctgttcaagctccattgtttttaacctcagtcagccttcccttttcttcacttgaattagcttcttcatattatgcatgggtaaatgcacagaattatttgagtgcactgttagctcttagcttcagaaaggattcagaaattagaggagtgatcaggggagccagctctgaagctacaaattggaaggcactaagagatgagtggatgtgtaataccatatttgggagaaggaggatggagagctatatgtttggttaaggatgggcttggacaaggctgctattctttcttgcttttggtccacaaactggtgtcaaatcctggaaactgtataaagatttagtatttattattatttagtatttattattatttcaaaaacatttcaactctggtatgtccaggcagcctatctctgcatggtagaggcctgggaaccaacctatggattaaaaaaaaatgtgtacttttatagtttctaggaaaaaagttcagattatatcttcctaggtagatattttatagaaatttacatccaagtttataccacagtaaatctctaagggacagatttcaaggaaaccccctgaatagttggattactgttttcttgcagctaaaaatttttgattatgtgcccaaaccaaaacaaaagattgcatttagcttcctcgatgagaatttctgaaaccaaatacaaatgaaaccacaggaggaaagataaggactcacaagtttatgaaacttgctaatgggactttaactccctcttagactcactcactcaactttcttattccatttgatatattttattttacattattttgaaaaacaaaatgaaacattgggggatatgttccattttgaatatagaactattttgagaattgtaggaaaatcattgtatatttagaattacacgtgtcctacaaaattgtcctcatacatttattcatccatttagcaaatcttttttaatatctgtcatgttaggtactcttctgtacacctgtgatacatcaataagcaaagctgacaaaattctttgcccttatactgcttctattctgggaacaggggctgtgaataaacaaataaaaaaagcctgtcatattgtggtcagattgtggtcagattatggtaagtgggccaagtgtggaaggaagtcagggagcatgccttgcagatacctgagggaggagcctctaaggggtagtgagatgggggtttatctggcaaggatgggagcagcttgcaggccatgcagcatagtgtggtgtggagtgaggggactggaagtagggcaggggccctaggtcattgtgaagacctttactttccatctgagtgggattgttatggactgaatgtttgtgcccacctccccaattcatatgttgaagttcaaatccccaatgtgatggtatttagagatagggccctttagaggtaattagatttagaggagatcatgaagatgggacctccttgatagcgtgagtgtttttataagaagaggaagtgactagagctctctctccactatttgagttcacagtgacaagggggccatctatctgcaagccaggaagcaggtcttcatctgaaaccaaatttgcctgtaccttgatcttggacttcccagcctccggaactgtgagaaataaatatgttgtgtaagccaccagtctaatggtgttttgttatggcagtccgagtagattattaaggataggagggcttcagcaagttctgaagagaggagtgagctgatctgacttctggttgaagaggatcactctggctgctatgctgcaagaggactgcaagggccaaagcagaggctggaagacctgctaggagacagttggagtaatcggtggcttgaattgaggtagcagcaatggaaatagaacacagtggtcagatgcaggatgtgctttgaaagtagagctgaatgtactggtggattggatatgagttattatggacagagagaggtcaaggataaatccagagaaactgtgaggatagagttgtctcagtggaggtggacacagctgggagtgaggtagaatgttgtgatgggaagatgaaaggatttgttaccggcacattaattttagaatacctattagactcctgagttggagatgccaaagacgtcattggatgtgagtctgaaatctggtagagagttcagggttgggaatataaaatcagaagttgacagcatgcaacaggaatgttatttaaaatatttgataaccagtatgacttgagaaccaaccaatcaaagcagatgcctgctttaaccacaggcatagctgtacagctcctgtcagcaggctatcagtccaatatgcacttgcatttgctaaaacatatcctttctacattggtcattctcaacctttacagataaactacaaattttatcaatataccataaatgcagattacccattaaaaccaaaaaaggcaccaactagaaagcataagcagggaatatttattttctccactattatatttgtccactccctaattcacattatgcccactgtattttcttgtaagggttaagtacaagtatttaacatactaacatatttgtgaaggccagggactagtttgaaagtaccagctttcaagtacaatggacttgtatttgagtcctggatactccattgtactgtttttgcagaaataagctccttttccttcctttttctgaaaataagtctgtaaagctggaaataagactacttcacattgttataaggattagaaattctatatataaaggatctattacagtgcccattaattgcagtacaatttcccacacaaattgtaggattttagagcttgaaaagaccttaacttggcttgtgttcttaataataactggtcaaattattataatatatcacacaatatatgttggatttaggctgtaagctacattcagaaatgcttgggcataaatatgtgcacacttggacaccctgtttaccaggaggaagtataagttcttatcaaaggaaagaatgattttgattatttctttctcataggtcagattgtaaaaacccagcaaaaagtgctttcgcatacagcattagcaatcaattatatctttatataaatatttgcctatgacaccaagtgacttgctaacccctcatttttgttgataacctctcataggacaaaaattacattgccgccttgctctgatatttcagggttgagctggtgtactattttgtgaagataattacaaggctaggtaatgcatattttaggtaaagagagtctggccttctaggcttccaaagatcctataagttcaagtccttggtacctctgtattctagacagatcttgggggaatgccttggctgcattcacagatagatagtaatgtaagttccatgaggttttgtttcatgactgtttatttacttttgattctccaatacctataaagtctcctggcacagaatcaatgcccaagaaatagatgtcaaattaatatgtagaaacaaaaacgctctagtgctaattctacctcaatgtcatatgcaattttgagggaagcagacactgaatgagtatcttatttctgtgaaagcagcttgtaattgatttacaaatgtcattccttggacctgtgactgccagcattggactctgtgtccttttatgctcaataatgctttttccctctcctcattaaattctggatttttcttacctacttttctctccctaccaaagaaatagataaaataccatgctcttcattttattggtgggtcagtattaattgcccaattctgtctttgctttgaaagaattcttgcctaagaggtctctctctccataaagtcgataccttttccagtttcccagacaagcctgaataaatatgtcagaacctagcagtggacagggctatgaatgattcaaaactgtctattccctacaacgtgtaaatgaaaatatagacagctgtacaggatcagaataggggagaaggaacagggaaacctggaaggctgctcttttgtgaacaacagcctggaaggttgggaaatgattttcagtgttttgtgggactgtactacagattggactatgccatctacttgtgctaaaaagcacaaaagtcttttaaaagcaaaggtgacaaaagtcttttaaaagcaagtaaagacattctccagaaatatttttaataaaacatgcacaataatgctgctttttccaactattgtgtggttgtaagtttttgaacctaattcttcaaattataacaactactaaagatttatcaaatgtaaatcctgtgccaggcatgatgctcaaccctctgatggattgtcttgtttagcagacacagctagcacattatattatgtacatttttacaaattgagggaaagaaggcagagatgctaagcactttgcccacagttacccagtaagtggctgagctggtactgcatgccaggcatcctgcttgtggagccaacagtcacttctgtactatctcagtgacagctatggaggcctgggattattttatttatcctattggaaatgacagttgtagcaatgactaaatatactgtgacattaattccccctggaagtgtaatttgattatgtttggtaaactgaatgagtgcctgatctctatgaatgcagcttttaattgatttacaaattacattatttggagcagtgactgctggtattggacttggtgtcctattgcactctttgttgctattgttttctttcctgcattgacgttgttttctgtattaagctgcctgaatcatgtcctttgaaaatattaatacctttttgaagaaaaccaaggaattgtggtaactccatggtgaggtagcctttgagtggaaataaccaaaaattacctgcagtgggaattaccttttggttattgtgcataaaaatggcagagatagataaatggataggtagataatgttttcttaaatttatttgtatacatagataatctcacagcccatgaagactcaacatataggccttttaatgcctacgtttagtttcctcgtattgatttacttgcaaattttctaatatattcttcagtagaatttactttatagctttatgtccagattatcttggcttttgcctttggataacaaaacaactattccttcatttgaagcagatagttaagaaaacaaattaccttttgaaaaccataaggctgactttatgcctaggaatagattatttctcagtcctagggaaatatgcattgaacattattttatgatgctttttagtactttgagattcagttcaagctgacaaggacctaagtattggatctgaaactcctcacattctgttctgtttctccctgaaagcacctgtcagtgtctatagactttgaaaccaagatttaacagggtaacatttactgactatattatgctacattatgtataatagtatgacaggacaatgacttacaggtcatatgaatattattagctctctctgcctcctttgatttttttcttttttttttttaaactgagctactgcactccagcctggcagagtatctctctatggggtatcacccaggctggagtgcaatagcacaatcaaataatacacacacacaggccgggcgtggtggctcacacctgtaatccaagcactttgggaggctgaggcaggtggatcacctgaggtcaggagttcgagaccagcctgaccaacataatgaaaccctgtttctactaaaattacaaaattagctgggagtggtggtgcatgcctgcgattccaactacttgggaggctgaggcaggagaatcgcttaaacccaggagacagaggttgcagtgagccaagattgtgccattgcactccagcctggacaagagcgaaactccatatcaaataataataataataatgataatacacacacatatagaatgagagggaatttatgagaagtttgatatttcattgttttggatttggagaatgtttccacttagatcaggaacctctctattcacatcatataggctttgattgtataataagtgatagcaagtattgttagcctgtaacttcttaagccaaagctcctgagggaggatcataaatacatatgcctatcattttcccaattctacataatactgtttcaactaaccaaagcaggcttgtatctacaatttcatcattggagtccctattctcttacattttccttcaaaactttcaagtgtatgtaaactctataaggacacattattttcaccatcatagtagtaaagcatgctcatcatccagaacacttgtttcttcacttagtgttgacgtgtatctactttctgaattaattttcaggttctgttgctaattgcaagcaggtttatggtgccacatttttaccactgcaccctgtgctcattgatctccctgaagctctagttcagttccaacctaatgaaaagcaaatagatgccaacgacaatagttacccagctaacattttggttttggtctgggtcatccttctgaggcgtatgacttgctgttttgtatgttggtgtgtagagaggagccgatgtgttccagaagccctacatctaatgggcaataactcacaaaatcactagctagcagattctcacagttaaagggcgaatgttcattgaatattggaaatgtcaactgcagcctgtctgggtgatgtttaaaattatcaatgtaccaccttcaacataataattccctacattttctttgctttattttttattttaatttttaaaaaatggagacgaggttttgccatgttgcccaggctggtctcaagctcctgggctcaagtggtcctcctgccttggcctccaaaggtgctaggattacaagcatgagccaccatattcagtctacaatctcagctgaaccattctctgctcacaaatagcactagtgataggagataagaagaggtgatttttgaatggcctaatgtaaaagaccatcacagactttagaataccaatttgtggctctggtttaaatgaatagatagcccctggactccattagtacaactgaggggctggattgtaattgttttctgaagtccctgtcacttctgaaattctgagatttgatttttttaatatgtcgtgatccatgatatgttacataaaatgctaatatgctagacaattggcatatccacagtatttgagtagactttctaaattcatgaaattacaacactctgagttatgtcttagcaacttagaagtcagaagtcaaatttctagtctttcttgcagccagtgtgcaggcatgtcactaggcttgtagacttgtcccatctaacagatgtttgccatacttcatttggggattcatcagtgtcagaaggcagattttgcacagactttccatttttctcagtgaatgtggtggtcgagggctgtggtttgaggagtcagcagtatatttaatttttgatatgaaagtgacattggtcctggtggcattggcagttgacatatattattggtattaattgcagcagatgtagcggcagctgtttttccatcaggctagttctgaagcttagtcttgggactttttttctggaaacttattcctgagccctcccaacaattctggaagctattcaatattggtttaataaatttcttagaattgatggcgtatacccaagtgtttgcagtcaacaatcctaagaaccctgactgaacaaatgtgcaagtgatttttctcaaagaccgcataaccccaggtctaataattcattaattttagtgagaatgaatgaatgaacaaagtagaaaactagccataaacatgcatttgcaaaacctctgatcaggtgtaaggaaacattcattgataatgtttctcaaggcatttttaaaaactattctattttatgctttgtcctccatgcccaaacaattcaactctgtataaacagttctcttcattgaaaataactacgcattcattttttgctacctaacaaatggatattgtagtatagtgatttgaattagatgtgaataggaagaaagataaaagtgaacctaagtaaaatgttgcatttatgtctgaattccctggtctctggattatatgagcctgattcatcatactgctaaattaaattgccattcttaatcaatatcctaaatctccactgaagagagtttttttttttaaacattgtgaattatacatcatttcctgtatgtaagtctgcccaaagttagagttgaaagctatcacaataaaataatagaatggagaatttgtttttcctccctttctattttttttttttttttaccaagaacataatccaattgacaagagtaaatttgtttgatatatattatcatccaaggaacttgagatgaaattttttttcactgctaagtcaattcactactagccatgaggccccaaactgagagaggtataacaaatactgttgtctagatgttttcaaactgtgcattatgaccctttaacgaccactaaatatagtgagataaatttcattaaatgtcagagtatattacatgtagtaagattaagtattgttttctgtaacttatgttttagttatgtatgtatatatattatttgtttatatatgcattgagtcactgtatggaatgtaatatttactgaaagttatttcttattttaaaaagtttaaaaaccagaaatttaccttttgtcagttaatgccatgtttccttaaaaaagtatttaaaaaaatttgagtctatttttgattttcaaaattgactatggcaaaaatggttgctcagaaattgttattaccttagcttcttggagtttctgatacaaatttgtttgttcagatgatttaattacattagtagtttctaaaaggttttccgaggctctgtccaatgggtagttctgttcagcctgatacttagcacagtttcttcctcattattctttgtgtttaatgaattatataattgagggaatatgctgcagataaaaatcattagtcccttaattccagtgcactgctgagttatatatatatatatattttactgcttaggtattttgttcaattctagaaataaatattatttacgttggtggaaatgttcttccaactgagcttggcattgttggtgcagtttggctttgtattactggcaacttgaagcaagaggaccaggtacagcagctctttttcttgttcacagattgttcagccaaaccttcaacttagttcaaaagcatttttgtttaggagatattaaaaatagaaacttttccaaaatgatactgatatcattttattttctatgattttattgtccttaaaagaaggaaaaaaaattacctttaccatcaacagggcattcttttcatttttcattacataatacaagactttcttttatacccgttttatttacgtgcatcatcttcagagagctgtttttgccagggagccccaaatatgtcatgaaatgatgaataattttaatgcccagaggctttgtaccaggaaagataagtcctttgagaggatcagagagtatgatagataacaaaatcacttcaaacttcactgtttcacggcaggaatccagaagaaaggtcacccagacttctgattttactgcgcatttttaaatataattttcacattaatgttaattatagcttatattaatattaaagattgctttttaaaattaacaaggctatatttcttattccttttctatttcttttttatttcctttcctgaatggaagccaatcttctagtaggttataaactgtagtgtaatttgctaatgtagtctctaacacagtgtcataatttgtagatactcttttagtagtgtttataattcatgcaatattaaatatttagaaaggtcgtatctacaaaatgcaaacttataaagtagattgattaggtggtaattgatttattaaaaatttcatgaatggttaaccacatagatttgatttcctcatctacagttaagtgtgtttattaatcaacagttatcttgatagtagttctaaagagcagataaatataattaaagggctaagagccatgatcagttgataagaaataaatacagttgatcttcattatttgtggtttctgtaactgcaagtttgcctgctcttggaaaatttatttgtaatcccatctgtacttgaagccctttggtggtcactcgtggaccttcacagacatgcagagcagcaagatgtttgagtcacattgtgtgcatgtgtgtacccagctaaggtctaataaggccccactttgccttcttgtttaagcttttataaacactaagcaaatgcccttttcaccatctatgtaatgccatgttttggtgcttttccttgctaattttcctgtttaaaatggtccccaaatataaagctgcagtgctgtctagagttcctaagctcaagaaggttgtgatgtgccttatggaaaatatctgtgtgttagataagcttcattcatgcatgagttgtaatgccttttactgtgggttcaatgtcaatgaatcaacaatgtgtatcagttaagatctctttaaacagaaacacacataaaactaggttatatattgattagttgacagaaatgttgtgactaggggcttgcaggaaactaaccctgtatttcccccaggaacagtggtttagtatattgctcattcaatgttcatgatgattttatagaacataactactgcagataataagaatcacctgtattaagaagtccaaaatttattacagtgaaatgtaatggaaaaatgatataaattgaaagaatcaaattaaccttcacttatagaggaacacgtttctatatagagatgcaaccatccattaatggcattaataggataatatcattattttcaaatgtattttttctctactttttttcacttcaaagagagcatcataggacagtcaatgattaaagggaaataataagaattttacatgtaataatttgctgctttattcatgtataaaacaagcctatttttaaaaaacatttttacaaatctctatgaaaaatcttaattcttcatttgtatagtgaataaaagtgaacctaagtaaaatgttgaatttgtgtctgaattccctggtctctggattatatgagcctgattcatcataccgcgaaattaaattgcccttcttaaccaatatcctaaatctccactgaagagagttttttttaaaacattgtgaattatacatcatcattacgagaaatgttgtttaaagttagatgctggtggattgttccagttgaagaaaacagctgagtcccatctaactgaacccttctatttgcctgcaaggaatggaggtccagatccgctgtctactttgccaagattggagagcaagctattggtagtcagggcctgaaccaacacttcctgatccagtcaagtgcttctattcttccttgggctatccattctctgaaaccctattgtcccacatggtaaaataactgcctagtatgaaaggatttatttcatgtaatatttattcataacaaatgtatcaactttatttaatgcagaatttaaaacaaatgtttaataacaatttcctttaatgtaatttaataataacaatagtacacaacattcatgcagctttagagctcttgctctcaaacacaacatgtaatgttctgatacctagttttaaagtggtatattcaggtaggccaagagtagatttcatccactaaagaatgaatttgtttttcttgatttctccgttagatgatacatttggcatttccaatttacttccatcttttcaacctgttacacctccatcttcatatattccagtataccagttactgaggacattgacatcattcattactcctctcctctcacatcccactctctcagcagttcctgtctgctctactttcaaaatgtattcagaatctgatctcattgtacctttggtgtcaccaccctggtttgaaactctgttatcttttacctgacttttttttttttttgagatgatatctcactctgtcacccaggctggggtgcagtggtgcaatcttggctcactacaacctccacctcctgggttcaagcgattctcccaccttagcctctagagtggctgggattacatcacctgactttttacatgcatgtttctgtgtttctacctttgcttccttacagtgtattttcaacacgtcagtcacggatgtgttcttaaaacaagcagagcatatcaccctctcctcagaactctacagtgaattcccatctagctcagaggaagggccaaagcctttaataatggcatactccaaggctctgtataacccctcatactcacacccccgatactcacacctctgatctcatcttctactgccttctcccctgttcactcttctacagacacactgtttctcaaactggtcaagtaaagtcttgctataggatctttgtatttgcttttgtctatcttccatatggtcttccctgaggcatctccatggcttacactattcatttccttctggtctctccttaaaattcaccttatcagtgatgcttttcccaaataccctttctttcccttcttctggtactcacttccctcttaccctgctttattgtttttcagaacacttatcaatttcctatgtatatatttacatatttgcttaatattgatcagtcttctcatatttgcacataaactttgtgagctcaggcacgttattttgtttcatgctttattcttagtacctataatattttgcccagtgtaggaactcaataaatattcactggaagaataaggaatttatcaccaatgactatttattgagtgcctgctccctgtcttcaacattccatgaattaaagaagtatgtacatgtaactagaagataagtctgatcctgctgctacctcctgtatctgctccattgatcaccagacatctggctgactaggcaggtggtctcttccaactgattccatgtgcttggtcagaaagaagagaagactttgcttctatcaaggacatacacaaaacttcagaacaatgcaaggttggataactattattgtagctaaaaggatgttaaattttgtataaagttgaaagtcagctttctctgcaattcttatggtgcctatttgttgattataggttaccatgtgtctaaagtttggactttccatttattttctaattacaaaattatgggcttatcattcaccagagatgatttggtttaagacactgactcagcctaaaacaacccactgatacaccaatccatttattccttcaacgcagtttcttatgtatgccagaatatactagccacagtaaatacagagaccagaaatacaccaccagattttgcagactacagttccttttagggtactactgtgtttactgctcacgtgttgtctcacttgtatgaaagttcacataagaaggcaagttaagaacagaaagttacttaatatatataaagtcagagcaaaggaatatgcccaccgttcctgccaagtgagcaagaatgttcattgtaactgattaaggcatgtaagtacaacagcaaatacttattttccatttgtctatttttttgccaattagcaaaaatattatcttataccaagcatgttataaggtgattgaaaagattcaagtttgcttgcttattttttgtagaagttatattcaagacatctttccatggtacatcttggctgtggatggaaatttgacatactttttattttctttacctgttacatatcaaatcttaggatgtattacttccaaggcggttaaacttattcaagattgactgagtctcctattttccttaaatttactagaagtgaggctccaagaactacagaaaatagaaggaaagtctccattgagccatgaactgtgagcacctggcatttaagcatgaagagtagggcttctatggtagggactggagtaggcagcattccaggaaaggatctcagaggtcagaaacaatagattatcagttaaatacttctggaccaaagaagaccttgaaatcctggctcggtgatgtatacatatttaatacacaatgagaagctccttgagggtgagtgagagtgatagggctgaagaacaggagacagaagacaattcaaatgtccttacacagaagactgattatatagataatggtacattcatataacatgatatatttactaattaaaacataacacacacacacacacacacacacagtcactgcataacaatgtttagttaacaacagactgcctgcattgatgatggtcagataataccatatttttactgttatcttttctatgctcagataagcagatgctaaccattatgttaacagttgttgcttattcagtacagtaacatactgtgcaggtttgtggcctaggagaaatacactaccatataggctaggtgtgtagtaggctataccatctaggtctgtataagtacactttgatgtttgcacaacagtaccacctaacaacacttctcagcatgtatctctgtagttaagtgacacatgctataagtgtttgtgtctgtgtgggtgtgtgtgtgtgtgtgtgtatatacacatcatgatagatcattgatcatcattaatctgtagtcattattacttatttacaaaatactttatattttattttttataaaatacttatcacagaatactttactaatgagagaactagcaagatgccaaagccagttcaaaaaagtgtaggagtaacagaaatatgcatagtcactgaaaaaaagaatgctaggatgtaattgccataaaactaaactggttattgctttacaggcaacaagggtataacctttgagaatcattttcagcatcatcagttttcttaatccagaagttggcaaactttttttgtaaaggagtaaattttttaggctttgtgggccatgtaagttctctgttacgtatccttatgctcatggactatataaaaacactctcctatcccaagttggcccacagaccatggtttgcagactcctgattaaagcctaatcaatagcaaataaaacaaaataaagatacctattctagagaattagataatcctcaggtgagtcagttaaacagtgtttcatcatgtcattcaatggacatgtgttcttttggccatttgcaggttttgaatatggagatacatatttatatatttttgaggcagggtttcattgtcacccaggttggagcgcagtggtgcaaacatggctcactgtagccttgagctcctgagctcaaacaatcttccttcttcagcctcccatgtagctgaaaccaaaggcatgcaacaccacgtccagcttttaaaaaatgttttgtagagatggggcgtcactttgtggcccgggctggtctcgaactcctgggctcaagcgatacttctgccttagcctcccaaagcattgggatcgcaggcataagccactgtgcccagctatattatttttttcctaacaaagatgcctgctggagggagctggaggggaaacagtgagggagaatgtgaaggaatttgaagaggtagggccttgtgggtgggatagccacactaacctcttttctaggggctgtcctggtttactggtataaaaattaatcactctcttttcactctcagagtgtcccagtttggatgatacatgataaatgggtcacgttaagaagtttgctcctcaacataaaattaataggaagggttgacaaattttaaactagtcaagtgtgatataatcagatttgcattttgaaaggatgactgccttgttggtaatggatttgaggcaaagacacaggggatgttaaatggttgtttaccaggaaatttgtctttcaggttaaacaatttgttaaactttctcaatagcaagttaattttgaaaaaaaagaaaaatcagaaaagtatgttgtttgatttaatgagtttgtcagtggataaagactgttgatttagtagccccatatagatgaagacatttcgtagttcatttagttaaaacctatgacttgttagatttgtttgccacatagttatattgtgttcttgtgcttccctgggcgtggataatgagaagactgtaaaatgaaacatgctttatgggatatgccttagctgcaaagccaataatccagaatgcagaattacaaaattagtgagaggattttgtcttaatgactgtatgagtgctgagatcaccattccttgatttgttcacagttatatccccagcaaatagcattcaagaaaatttgctgagtgactgaaagaatgaaccctcccagaaccttatttcttataatactgtgctctgtcttcttaaaaatcttaggtacaactattcatgaagctactcatttatcccattggcttagaatctctgaatgaagactctagtcaagaatatagacgtaaatatattttccaagaatcttggaacatattttctattaatgtttttttgttcagggttgaaggacagtttgacaaaatagtttgcttaagaatagaggtggcaaaaccaattttcatcagaaaaagaattaatgtcatatgggtgtttttattgagaacatttaaaatgtatcttctttattcattttttacagtatttcatctggcatataagaactaggaagaaaacttaattaaaatgcatattcagaccaagtatgaagatatagtatctttatataatgagtgaataaaatcagagtaactattgattgttctctaaataattcagatgctataaatacaggacatatgcataaacacttaaaatcacaagccaagacaacgtagtgagacctcgtctctacaaaaacaaaaaattatccaggtgtggtggtgtgtgcctctagtaactggaaggctgagatgggaagatgacttgagcccaggagttggagtctgcagtgagccttgaccacaccactgcactccagcctgggtaacagagcaagactctgtctccaaaaaataaaaaatatgtaaaatcacaatcacactttaataagatttagaacctttggaaatataatagtaataaaataccaaaaattatatttcttaaatttggttcttaaaaatataatttacttaaaaatatcgctcatagaagtgtgtggtggcttacgcctgtaatcccagcactttgggaggccagggcaggcagatcacaaggtcaagagatcgagactatcctggctaacatggtgaaatcctgtctctactaaaaatacaaaaattagctgggcatgtaggtgcacgcctgtagtcccagctactcaggaggctgaggcaggagaattgcttgaacctgggaggcggaggttgcagtgagtcaagatcatgccagggcactccagcctggtgacagagtgagactctgtctcaaaaaaaaaaaaaaactcttgtaaaaaaataagaaagtttaccaagtttgaatcttaagcaatttgaataactgtttggttaatgcctagactgtgagaaagttgccaacttttcacacttttcattagttttctttttccctttaattgtacaataataagtctagtatcataatatttgcaaactgccccctgttctctaataatctctgttcatttattgttgtgctgactgcagtctgactctcgagtgagctgctttatctgcagcacctggaggtgttggctgttttcttgggcctctacacaccacagaaccaagggatggacagatgttttctcgctcttcactgcttttataagaccatagttaacacctcctccttcaatatcccctacctccatccttacccaaccctatctttgagaaacacatttttagattataacatcctacattcttagtgcagcagttttctatcattctcttggtgattcccatcatttgttgtattatatagtaactgacttactacgttctctcctttccacttctgccatcattcttcatggctttacttagccacatagattatgcatgccaaactccggcctctcagcacctatattctctctttcagcaatcttaccctctactccagcggtcaacagactttttctgtaaaggggtttgtattttcagttttctggacatgtctttgttgcagttattaaacaatgaaatcctagctttataccaacatggataatacgtaaacaaattgatgtggctatgttccaaaaaaaaatctgtatttacaaaaatgaatactctgaaaagctgcttagggacttaaaacagatgaggccatgagccatgtgaatatcggggaaataattctaggcagaggaaacatcaagtgcaaaggctctgagacaggagcttgcctggagttctccagaagcagcaaggatgccaatgaagttggagtgcaatgggccagggatgagtagtaggagaggttagggggataatgagggtggagcgagggaccttttaggccatgaatggaatttgggctcttactcagagacagtaagtggagagccattggaggattctgaacctaaggacaataatcagatttaagttttaacaggattgttctggctgctgtggtaaagacagtgagagggcagggtagaaacacagaaatgagataggaggctactggacttgccatagatcaggcttgtaacagtagaggagatgaaaagtggtcagattttctctatatatgtatgtatattccatctcaccctattatatttagaaggatttgctttcagattagattttgctttcacagaaagggtcaagaattaccttggggtttttatgagcaactggaaagatggaagaccatggatgaagcaggttttagggggacgatcacgagttctttgagcttgtttggtttgagatgtctatgagataagtgaaacaagcaaatgcaccacacgtttgagatgtctgacattcattataacttccttgatttcatgataaatagataattattctttactttagaaacatcattgacctaggctgaactaactgttctctcgaaggcttagataaaaatatattaggtgcctgatagatgcagactggtgcctgcagctatatttactagtattcttcattattcccatggcatctaattcatgagcaagttcataaataactcccatgtttttcccagattgtgagcctaagattacagaatgtatttttcatgtacttcttttgcatgtattatccaggagaaataaactgatattttaagtgctttcatcataaaaatagatatatagaggcaaatgttattggataatataatattatagtacaatatgtctacaagccagttatattgcatttcttaacatgtattaggattttaaactcacagatttcctgcttataggacatatcaactttggaaaaatgcaataaatgaattttcaaaaaaggaattgaaagatgagagcatttgggctaatgagtctctagggaaaatacagttgcaagtgttaagataatatggtagtaagttacaaagagaagatgatctaataagattttccatttactattctccaggggctagtgttataaaagcagctcatctgctcggttaattttttgaagagcatatttttggtttggcaagataaatgttctatgttttctctctagttattcattaaaaacaattccaaaataaaatgaagtatgttttaaactttaactcgagagtgttgaagagagaaaactcttacacttagagaatcatattcagctttgtattggtaattactgtattgtttatttcctatactatttattagccatattcatccaggaatgtagaaatgtaaaaacttagaaaggatcttataggatcttcttaaaggatcatctaatccagtgcttatcaagtattacttactgtgagctagagtataaaaaatgttttatatcatggcccagtgtatattttatatatatatatgtgtgtgtgtctgtgtgctgtgtgttgtgtgagtgtgtgtgtatgacccaagcaaaagtttcacaaagcaatagttacctttaatgtgaaatatacttcaccatgtttgattttattcttgttattttttatctcctttaaaaattgtttcttctagccaggaatggtggtgtttgtgtaatcccagctattctggaggctgaggtaggaggattgcttgaaccaggcattcaagaggccagcctcagcaacatagcaagaccccatttcaaattaagaacaaaaaaaattgttctgtttttccttacagaagtaacaactcttcatcagcaagggatgtgccttctcaggaatacctttgcttttcccatatattgtctgtcttcccttacttctcccataatcatcaaaatttctgataaggttcagagagtacagtaagatagaccacgacagatgtctctcttcttttttgatttttttttttttttaagacagggtatcactctgttgctcagtctggagtacagtggcgatttctcagctcaccacaacctccgctgccctggttcaagcgattctcctgcctcagcctcatgagtagctaggactacaggcatgggtgaccacacccagctaattttttgtaatagagacagggtctcaccatgttgcccaggctggtctcaaactcctgacctcaagtgatctgcctgcctcagcctcccaaaatactgggattacaggcgtaagtcaccgcacccagcccttttttaatattcctaatggctaaggatattgatgagagatcactgactaacttgcaatacatagtggaagatagaataacaaaaacataaggcaagaagaaaggaaagttggaatcaccaatcaaaattcataaaacaaatgatattaatgcaaaatttaaagagggaaggaagatttttctatataaatgactattgtttcaatactcttgaaatgagtatcaacttttccaagaaatgaaattacctttttagaaaacaaaataagcagaatggaattattcaattaaaatatacaacaggataatctcaaattatttttcaaagaaaacaaagaatgtttccagatattactaaatctattatttactttacccttaaatttatgtttttattaaaaatgagcaggacagagtattacatgaattacctatttacttttatattgttttagtcttctctgagcttctatatttagccattgatgacgtttttctttcaagcaaaagaactgattgttctttcatgctgtttgtagtgtcatgtgatagatgtggctgatacccatacagtcaacagttactgatcatatctcccactttctaatttcttcccaggttgaaattctcccaggtaataactattttgacccatcagaaacccagttggattatctaggcttctaattagtgctggcttataaaaggcataatgatttcttctagtcagtactgaatgctattatactaatctgatcctgtagatattgaagataatctaaacttggcttttaatcttgaatcaggagtggggtgaggatttgggaataaggatggagaccatagtcaccagagttgatatgctttgaccttcaggacttatcttgggatccagtaactttctttgtgtacttttagaatagtttttaaagtaatatggatggcattccctatgaagttttcatataataattacatttgattattttaaaaagttaattttcattcctattaagtgtaagcagtcaattgctttgaaatataatttaattttagttgatattaagtttacaaggtagattttttgtcattacaggaagaatatctgaaattttactataatttttcaatttctgatatagaaattaattttaacttttgagtgatgaataattacttatttggcatttataaatggggcatattgctaaatagtttttcaaaaatacatatcccttatgtaactttatgtgttcaaatagctaaaattagaacagattgtggcttctaagcctgaccacttcatttgtttgccttagccagctaatcaaactcccaattttttatgctcaaatgttaaagtttcatgttaaaacaagtaaaaaaagacaaagtataaatgctatgtaggactcttgaccttaataacaacataaaaattaatatgtatctatacctgtctatatttctattcagtgttttaaaaatgaacatctctatttcaaaaaaacagcatatattttttctaatgtactcaagttaatatattttatactgggaaaatgaaaatcaaatggtgtcattttattaactgtattacttgtgttataggaaatactttttaaaaaaccacatagagagatttggcttcacttttctagaagtgttagtttgattttgaacttagttttcagtgcttttgtgttttctatttgaaaagttttctctctagaagtgagcagctttgtcataaataaagccaggagaataatggttgagctgaaatttctctccagagagtgtaatttgactgttaaaatgttctaatactagtgtgtgtgtttttacatttttaatgtaatattgaaaaaagtgtatgtagatataaaattaatacatatatgtatatatttattatttttaatttacaaatgaacttaatgttggcttccctcttttggggtagacttggcgtgttagatggcctaacttggctagtgcttgttttagctatgaattataattaactactgatgggaatataaaaaggatctgacttacaagctgccatttttgcatcccagtatgtgaaccaaatccaactacctcaatctttgaaacacagcaaagctaaaaatgcaaattctgcctcattaataaccaggactattactcagagctgacaaacaatgattatgaggatataatacaatctgttctgtatgaattactctattagtatcatgataatattggcagcattgccctaccatgctcagttttagaatttttactaattctttcttactttctgaggtcagactcattctttttttctgctaaatttgcttatgatattgaaaaacgtatttgaggacaatgtggtcaatcacacatttcagattaagtcttttctgtttatttatctattgttaggtaacaatccccatcccagatttaatggcttaaaataacatcagtttattatttgtgataattctatgagttgactggattcagtcagttgggtgctctactgtagctgaggtcattcatgcagtttcgttcagctatgacctctgctagtaatagaatgtcagaattatctcttatcctcagaggtttctcttcatgtggcctcttgtcttccaatcgaacctgatcttttcttttagcacagcaagtggtttccaagattacagctccaatgtagaaaacatattaaggttttgcttgcatcacacatgctactcactcaaagcaaatcacatagccaagcccagaggtaatgtgggaggggactgcacaaggacatgaataatgatagacatagtccactggggtccaccaatgtaattgactgcctcctctccataataaattttagtgaagaggaacagatagtgagtttgggttgtatggcagagtaagaatcagtataatttgaaccaaataatattttatataaataatttcataaaattataattaacaaccttggttttattttgtgtggggggtactgttaagaaatggaggaggaaagaagtagtactgaaatagaaaacattgactttgtatcctgtcagccttttaggaaagatattaagtctcaataaaataatatattccttttcttttgacagaagtgtttctaacatgtgtcatcaaaatggataaggtgtacctaatcactgttgacacagtttctacttggagtttaattttcctactcttttccctcttctcccttgcccattcatttccacttcctctctctctctctcgctcgctctctctcgcacacacacacatacacacctttttgtccatgttatcataatgtccatgatgtgaaagttaatttttggaaatgaaaatgatttaaatttatgatattttgtatgttgggtaagctttcagattcttcaacttgctagcatttttggtacattaaatgttctatcagataaaatagctgagtcactggcaattctcatattcttaatttgaagtggaaaaataacaattttctggggctttaggaactgtatagagagacaaatgtggctttgtatcctagacatcatctagctacctctgtaccctcaaaattatagcatcacattttaaacctacagtcaaaatggttttctttttctgtggaaattgtctgttacgtacttgttactacttttctttctctagtcaccataataatttttttatttcttctcttttgaattttttttgaatattattttaccctgacaaaccagttcatatcccaccaggtatttggcaagtagtttgttcacagaaaggtttcagggagcccacgtagtattctcagtaagaacaaggtctttggaatcatccaactctacattttggtcctagccaggccaattacttgctgttaacctggaagtttcctccatacctctaagcctgtgaacattcatttgtaaaagcttatggcaaaatgtccttgtggtgcttgcatatattaaataatataactcttgcaaaaattatttgcattgtgcctgacagtaagaacataagttttattatatcttttaaccccttaagtgaaatgaggaattaaatagaaaacttctatcatatttaattaaaatttctcagatcatacaaggaccatggtctatttgaccccttctttatggagctaatatttagctagaaactgcaatggaataatgcaagaacacagaacaggaagagaaagcagcgatcctgcaatcattcaaatgtgataatacatgcaggagagaaaggaaaagaattaggccatgggtcagctaacctttggaactatttttagcctcagaagcacttttatcccccttataaattccatacttaaagttccagaatttaaaatttgatgagaactgttgtgctgtttcaggttgtgaaaattcatttattcatacacgtaattttacctttgagcaaacttcaaaaagaatgactgccaaaatgtattataacctgttttctcaaatgtttttctcattctcttttttaaaatttctctctaaaaacgtcatagggacaactgtaattaggctaattgcgtccactcatatgtgcagcttatggcaataacagagcagtcatagaaagaacgaggtgcagtatgcttcaaaatgcagcatctgcagtgctgtcaaggccagccatgccgtcagtcttgagctaacagctgtgatgaacagaatgttgtgttattcctttggtgtgaaaatgaattgacagttatttatagggaataattaatgtaacattttgtaaaagtaaacatgattttcaatccttgagaaactgttaaaaaggaaaaaaagaataggaaatgaaggatacttttgaccaacagaaaaggcttgaagagaaatagatgatgtctacaactaaaacactatcttccagaccgtttagacataccatcaactctgagaataatagttgaagagttaaacatttttaaaggaaacaaacccatcctcacagtaattgtgaacatgtggaatgtctctgtgaagactatagtatctacttttgttaatatagtaagtaaaaatcatgacaatttcttataattctgttttttcagttcattatttaaaataagagagtggaaggaagtagggtgggacataggaaggaaggaataaaggaaggaaggaaatatgtatatattaatcccaagtaaatatgatgctgaatatgtgatatgaataacacatttattcataatctcgcatggtcaaatggctggttagacatattagagattattttggaattgtgtgatgcaaaagaagtaaacttggctgaatgatttgtctcaaacccttatcacatgttagctggttaagtgcttttgtatcatgtgtttgattatcatgtttccatctgaacagtaactcctgacttgttcaaaaaataattgatttctgaatgatgatatttagtattaattagtattaataagtgaatggaaataattttaagaaaatgttattcccaggatagacagaaattattgctacttctccagttgtacctgaaatattctcctctgttcagctgtatacctcttcgatctggacacctgagatcccacctgcacctaaggcttttaccttcagacagtggaagaaagtaatggtgatttcctcctggtcagattgtagactttacttttcagtttaactttgataacatgggaacccatcttattttccagaataattgttatgagttctttaagaagccatgccattatttaagttcatttgaatacatactgtattatagctgctaagtgagatatctctgaaactgtgtcattcaagaagccagtgagctatcatccatggcccagctttctttattgtactaaatgatcattagaagatgcaccatcaaaccaaactctttatattcttcagcagcataagtttaagcaaggctagcaggcatctctgatattggcaacgtgaagaatacctttcacaccattaaagtgatggaagaattgcttatgtagccatcttcttattttatttatatacattgtgtgtgtgtgtgtgtgtgtgtgtgtgtgttatgtgtatatataacatatatatagctatctttggtgaaaatttccatcccaaaaccttctatagtaaatgctcaaaaacaatttgatgaaagaccatctactatgtgccagatctctgtgtgggatgcaagacttataaaatatggttcctgttgggcagtattggtgacgagactatatactgaagaagggaaaggtattaaaggtagtaaataaagataaaatatgctgcatgaatgacctcaagggtggcactgtgacaagtaagataagcgtggcagggcagcggggactgcagtgtgcttacatttcatgcactcaagagctaagtagagggtctgagactgaactgttggctgcattcccagtcacctacagtataggcctcctcctcatgttaataacaatagaaaattcatattttacaaactataatctatctagagagggattcagaaaatattttaataggaggccaggaatgagatccaaaggggatggaattagatgataaagcacagagattatgttaagtctatgagcctgggcattgaatgagtactacagtctccttgtataaataattttagtttgtgtgataacctgaatgttcttataaattcacattttccatgtggtggtcatcagtgcatgggaaacataacaggttgtagtagaaaatcattattattttgtggtgacttttgtaaaagcagttgtgtcctaaaactttgttgctttccctgccttcttttgctcccagtgaagatcaagccaccacttcaagtgatttggatacacaggaagaattcactggggctaccagaggttggaaggtgggaaaagggagaggagcagaaagaataactattgggtactaggcttggtacctgggggacaaaataatctgtacatcaacccccgtgacatgagtttacttatgtggcagacctgcacatgtacacctgaagctaaaataaaagtaaaaaataaaaataaataagcaaaaaaaaaaagaattcactctctatgaaggataactgggacaaggtgtggggcttatgaacaagtaaatagcagatacagcggtttgtagttctacatgtgtgatttagtttagagttatcagttaaagtctggctcattgaaaattttaaagtggcattaatttgagaaactagtaaattattttagcaaaagttcaagctgtacattttgggctaatgacttggtaaatggatttgggtgacctgagtaaataagtaacataacaaaaactgtgttttgccaggttggccagggagtgccacctagaacttcttggacaaaagggagaacacagggaaaccatttcctagacttggaatcattcctcttactgtctgttgtagtgaccaagcatgagttggtgaagacttggactaaggtgatagcaaagagagtggcaaggaagtgaaagaattgccagaacctggtaactttgagtatatggatatatattataatgatccttaacatttgtttagtattcacctcaaaatttgtggatttttatctcatttaatctcaaccattttataaagcataggtactaatatcattacaagttaagcagtttttttttaagatcacatagttaccagttttcagaaccagtacccaaaccttagttctatctgaactcaagctatgttgtaaaagatacggacgtatcaaaggctaaaataaaatgtaatgccaacatttctagctaggagacatatgtccatgtgaagtggggtttaacgttgatcgttggaataggtataacacaatttttcttctcttatttttttctagtgcgacttcatgatagcatatcagaagagggctttcactacttggtgtttgatttgtaagtatatactctgtattcattatttttgcaatctaattgaggaccgttttgaattaatgatttttctcactgtacagtccaaattactgactgctacaatattttttaatgttcaagtaacattcaactctaattcttttgaaaagaggatactactcagcattgttttatttacaatttaatttaaccttaatttgaattaaccttaacctaagtgaaatagttatttctctttgcattgtccgttgtgatgtcatgagtggttctcaattctaccttgtagcacaaaaatgtttgacataagcaaaattttccatttaatttttaagagtatgtataatttattatcttaaagtaaaaagaagactcaaggaagaaacttggattaccaaaattgatttaaactaatcaagacttttaaagtgaggcgctgtcagcaagaatgaagggaaaataatgactcttggcagggatatagtggcagggatatagtaaaacaggccacacatatggttggtaggagtttaataagaacatactttctggaaatcaatttggtgctactgtgctcatcaaagggaataaaaaatgtttgtatcatttgacttagtaattttactcctcagaacaaagtccatggaaagtataccctaaattcagttaaaattttatgctgaaagatgttcattgcatcatcctttataacgggggagaaaagaaaagaaagaaaccaacttaaggatccaattatagagaaatagctacataattatagtatattcatataatggactactgcctagcattttaatttgatgccacagagttttgggaaagatttaaaaaattatttcacatgatatgagtttgaaggtaggttaatactaggtttggttaattcagtacttcaatgatatcattaagaaaccacgttctttccatctgtctgtttttagtattatgtgggtttgtcttcatgtttgagttcccctatggtctgaaattgactaccacattttcagttatcacagtgacttccaaaggcagaaaaagggtaatccaaattctattgcataagtttttattcatggagaagtctttctcaagagcctctcagaagatatctgttcaagattccttaattagaactgcttctcaagcccacactaaaccaggtatttgttaagggaatgaaattacaactggcattgacaaataataatttagtctgtagatctggtgagggaactggcctcttaatcatgtgatacccagttcagaactaaattgtgattttgttattaagaaagaatgggagttttatctgttgggtagtgtcatgcgcatccatgtgaagagaccaccaaacaggctttgtgtgagcagtaacgctttttagtcacctgggtgcaggtggactgagtccaaaaaaggagtcagcaaagggagataggggtgggacagttttataggatttgggtgggtagtggaaaattacagtcaaaggggatttttctcttgcgggcggggacagggattacagggtgctcggtggggagcttctgatactcattgtccaggagaaggaatgtcacagggtcaattgatcggttacggtggggcaggaacaaatcacaatggtggaatgtcatcagtcaaggcaggacctggctattttcacctctcctgcggttcctcagttgctccagaccatcttaatgcgtacctgcaggcttgggctcagaggcctgacaggtaggcagccaagcatatctgccatatttagaatagagactaaagcgctacttctgcacaatcctactgcacaggctcctctccacagtcccagttcatccatgtcttgctcatgtggccgtagtttcatctggctctatgttgttctagtagtgcttcctcttcagtcctttctcagctcttgtttttactttttccattattttttcttcctttccaatgtttgagtcccttcttttatgatttttttttcttgagctttctttagccattcttttaggataggtatgctagcaacaaattgttagtattcctttttctgagcttgtctcgatttcccctttattcctgaatgatatttttgccagatatagaatccaggttgagagttctttcaatgttgtgccacttccttctggattccttgatttttgatgagacatctttgtcattctaattgtttttcccctaaagataaggtattagttctctctggctgctttaaaattttttggtttttgtttctttttctcgttgtctttggtttttaggtttgtctatgatgtatcttgcttggcttggattttttggagtttacttatttggagctcacttagcctcctgaatgggtccatctttgtttggcaaacctgggaaacttttggacattgtttctttgaatacctttttagccctaccttctttctcccttccttttggaactctgatgacatgagtgttggatcttttgttagagtctaagaggtccctgaggctctgtttgttgtagttttcccgtagtctgttgtctttctgttgtttagtttgggtaatttattattgttctgtcttcaagtctgattgtctaattctttcctctgttgtttttttttttttctgagacagagtctcactctgtcacccaggctggagtgcagtggtgcgattcaggcttgagtgcagtggcgcgatctctgctcactgcaaccgccgcctcctgggttcaagcgattctcctgcatcagcctcctgagtagctgggattacaggcgcgcgccaccatgccggctaatttttttgtatttttagtagagacggggtttcaccatgttggtcaggctggtctccaactcctgacctcgtgatctgcctgcctctgcctccctaagtgctgggattacaggcatgagccactgtgcctggcccatccattgagttttttatgtcagttatatttttcatttctgcagtttccttttcttctttatagcctctatttctttgccaagattcccttttgtttgtttgtttcaagtgtgttcataagtgctctctgaagcatttttttattatggctgattaaaaatccgtatcagataattctgacagcattgttatcttggtgttgctgcctgttgattatcttctcattcaaattgagattttcctggttcttgatatgatgagtgatttttggattatatcctgaacatttgggggtattattttataagactttggatttcactaactgttctttagcaggccttctctcataccagagtaagcaggtgccatcttattactgactgatgggggctgtagtccaggttccccccacagcctccaccgacatgcctgggtggtggttccttatggctaggtgaggttattggaacgcagggatttttattttttctatatttactgggagcaatacacctaccatattttttaagcagcagacatgttatttcttaatacatttaatttgtcagatctttgttttgcagatcaaggtatggtattgtaaactgagatatgtccttcatgctatgatgaatggtggaataaaaaacacttttgtgagttctcattacttaagtaataacattctgaagtgagtttgatcacagcttggtcagggaggaaacacttttttctgtccttttaggttcagtgcctggggcatgagaattaaacaagagagagattaacaagagacaaggcatataatttgtattaatatttatgtgcatgggagttcacagaaaagaagtgaaactcaaagaagcagttaggctcaggcttttatacccttaaaagaatttgggcttcaagagataatggagaattgacttatggaaaagtgactagtaaatatatgaaggagctaatggaagataagggctattttagtaagatctgtttctgcaaactcatctgctgtcgactccctgtcttctgtgatgagtcaatctttctcactggtgttggggaaagagagcatcttccttaaagggaaatttattccctgcttttaggcagataagggagggcagataattctctctatatctgttgattctcacttagctttagctcaaaataatccttatgccaaagtggcatatttgggcgtgatatattttgatctccttctgctgcaagaagcacttcagtgttaggtcaaaaccttctactatgccagttttccacagtcatcaaattatttatatctatattttaaaatttatagcttctgtattccttattaaattaagggcatgatgagaatcacacagtttattttttcttgtatcattttttagaaattcagcataatatttggtgaagaacataaagaaagcagttcacatggaaacagaataagatttttaactaaagtggattatgtctttagcaatggtatttgtttgggttattaatgtctttgaaaccaaagtgaagaaggtaaaagtttacatacaaaccatagtaatttgaaatatgctgcaacaggcaactgaacttctgcctctagaatgaagggctcaaattcttgcaattattctttagtatttaaagtttaagaggagcattatcagcagttatcctgaaaatgatctaccagtaaatgagattaataaactaaacacaatccaataaagcattagaaaaattgaaaaacaatggttaaaagtatgcattttcaatgactgaaaagagagcataacagatataagtgtctaatttctcaaaattacgtgatcattgcagcaataatctatgaaaaggaaaagtaagcagctttagaaaaatgcacattttaaatatagttaagaaatatacattgatatcttaaagatatcaatgaaatactctcatggaaaattagagccacttacccaatgagttccgagataaaataactacttgaattcccaaagaaggaatgttccttgtgttcctccttttgatgatagttttggcagtgtggtgcttgtacatatttcctgtggaatgttagctattcagaatctaatggaagttctatttttataggtgcattgagtcttcttctaatgaaatgatttttactttctaaaaaatcaaaacaaagaacatgagttctatgaaaaaattttcttctttttttttctttttaaattttattttattatagagatggggtcttgctatgttgcccaggctggtctcaaacttccggtctcaagctatcctccctcctcagcctccccaagtgctcaggtgtgagctaccatgcccagcctcttcttactgttttaaatatatatatatatatatatatatatataaaatagcaagaaatatatagaaagatatatataaagaaatataatagcaagaaacatatataataacaagaaatatatatatttcttgctattttaaatttatatatttttattcagttatctagccatttttaacaataaggcattagtagtctcttttgcacatagactcaggaatgaatgggaaaggcttttatgaaagcaaagtcatccccttcctgtatccatgtgttctcattgttcaattcccacctatgagtgagaatatgcggtgtttggttttttgttcttgcgatagtttactgagaatgatgatttccaattttatccatgtccctacaaaggacatgaactcatcaggaaggggaacatcacactctggggactgttgtggggtggggggaggggggaggggggagggatagctttaggagatatacctaatgctaaatgacgagttaatgggtgcagcacaccaacatggcacatgtatacatatgtaactaacctgcacattgtgcacatgtaccctaaaactgaaagtataataataaaataaaataaaataaaataacgcaaagtcatctttacagcaaataatgaactgccctgatttttttcaaataatcctttccagggtttgtgcctagcatggtttctaggcacacctcagcggctctggagaacaaggagggctaagtttatagagatgtgaatttaccgaaagataagagaagtggagctagattgtagtccccaagggagaggccttcaggcagagacttcagccttaagcagataaggcagatcacagatcaagttcatttctagggctaatggtaaataaggctttaacatgggcagtcacctgaacatatgtgttggcttgaaaaattgttttccctctacccgttttaggtttatcggctgggaccccgcaaattagactgacaggagaaagattaaggaaaaaacaaacaaacagacgtttattaaactgtgtataatacgttcacatggaagcactcagagatgagtaactcaaaagggtggttagaacttcagcttatatatcatcttaaaagaacaataaattcttagagaagagacaaaacaaaggaagaggactttgagtctataggaacagcaaattgtatgaaggtaaatagatgaggataattaatggcagataatggctggttgtagtaaagtttcttatgcggattcctctggtgcagtctccaggctcaggctctaggttgtcactaacttctgccttccctggagagagggcaggagagaaaactctacaaatttatgtcatgcttttaggcagacagagggaaagcaaagagctttatctgtatctgcttcttcacaattgccttcagcaaaaaataatttttacaagtggcatactttggagtgacatattttgttacccttcattaatgacatttatttcaggaactgtatgtcagagaaaatccgtattatgtgtttgttgagtgaatacttgttcaagagaccaaaaaaaaaattagtaattacagtacaatacaacgtttgccacgatattgttctgtgtagacagcttcaagcaaaaatggacttagtttagagatagcttagcccagttagaagtcactgaagtaaggtgttgggagaaataaaaaaaaaaagaactaaaatagtgtaatccctttgaaaatactttatagaacatagctgagtctacaaattttgtttcaagatcatcatttgtatttaagaaggaggctgggcacagtggtccacacctctaatcacaagtgctttgggaggctgagacaggagatcgcttaagcccaggagttcgagaccagcctgggcaacatagcaagactctttgtctacaaaaaagttttaaaaatcagtctgtggtgatggcacttgcatgtagtcctagctgctagggtggctgaggcggaaaatcacttgagcccagaagttccaggctgcagtgagctgtgatcacgccactgcactctaggtgacagagcaagaacctgacttaaaaaatgaaaaaaaaaaaaaaaaaaaaaaaaaaagaataaacagttaatctacataaaatgcattatattttaaatagcaaaccctgatgctataactatactaaatttcttgtttgtttttagaaaatggaattttgtttgaatcaaaacatctgggctattttaaaatgaaatttaatgttcattatagtgaaaaccaatgaatctagaattttagtatgtctcatgtgggaaaaatactggttttccagtacgtatactaacaattttagtggttttttttttcctcatgaaagggcatatccggatcgtgttccttttattgaaaaattaataaaacaattaatgattttgttatattttttaaggaagaacactttaaatgctcatgacattctgtccttttaatagaaagggatgctttgtcatatacttttgattctattctgagtggaaggcaaaatacacgattaacttctctctattatggtgctccacagtggcaaattaaatccttctacccacgtatcatgtttcctttatgttcgtgaaaactttcagtttgtgtgggataagatataaacttgtctcctaaagactctttagttacaacctacagaaggaggtaggttcttcgtgataaatactatttgatatcagaatttttttcagggataattgtcataaattccagagggcctatttctattttgtttctttgctttagtaatttttattctttgatgagaataaggatttcttcttaacatatctataccatcacattaattctgtggctcatgcttgtaacctcagcacttcaggaggccggggaaggaggattgcttaagcctaggacttaaagatcagcctgggcaacatagtgagacctcatctctacaaaaacatttttacaaagtagctggtgtggtggtatgcacctgtagtcccagctacttgagaggctgaggtgagaggatcacttgagcccggttcatcaaggctgcagtgagacaagattatgccactgcttcctagttgacagagcgagaccctgtctcaatttaaaataaaaatggtaattattattattattgccctttttaatacagatctggatttcttggtgttatatcacctcccatatttattataattcatcttcatgaagttagataaaatattgtggactataggattttttgaaactttgacaattctttttaaacttctaataaactttatattttagatcagttttaagtttacagcaaaaatgagtggaaatacagaaagtttccatatacccttatctctacaagtttaccacctcctacactatcaaaatccccatacaacattagtacattagttataatagtacattgtactactgtataaacctactttggtacatgattatcacctagagtccataatttatgctagggttcactcttggtgttttacattgtatgggtttttaaaaatgtgtgacgttctgtaaccacaattgtaggatcatacagaatagttgcattgccctaaaaatcttctgtcttctgcctgttctgtcctccttacccccaacttctggcaaccactaatcttttactgtctccatagctttaccttttccagaatatcatatagttagaatcatacagtatataaccttttagattgatttctttcacttagtaataaagtcagccctgggacaacatgggtttgaactgcacaggtccacttatacgtggattttcctccacctttgccattcctgagacagcaagaccaacttctcctcttcctcctcctcctcttcctcctcctcctcttcagtcttctcaatgtgaagatgatgaggataagacctttatgatgacccactttcacttaatgagtgtaaatttattatctcttccttaggattttcttagtaacattttcttctctctaacttactttattttaagaatacagtatataatacacgtaacatacaaaatatgtgttaatcaactctgttatccttcaggcttccagtcaacagtaggctattagtagttaaatttgtggggaatcaaaagttatacaagggttttcaactgttggggggttgatactctacccctcatgttgttcaagaatcaactgtacatatttagatttcttctatttattttttatggccttatagcttatttccttttgtcgttgaataatatttcattgtctggacgtaccagagtttattgacttacccaatgaaagacaccttgactgctttcaaattttggcaattatgaataaagctgctataaacatccatatataggtttttgcatggacataagttttcaactcatttgggtaaatacctaaatgtgctgctgatgaatcatgttgtaagtgtatatttagttttctaaaacactgccagtattcttaagtggctataccattttgcattcacaccagcaatgaatgagagttcctgttgctccatactgtctccatagctttacctttgtaagaattctcaccagcatttggtgttgtcagtgttcttgatattggcctttttaataggtgtgtagtgatattccattgttacaatttgaaatttcctaatgacatacaatgattaacatcatctcatatgctcgcttaccatctgcattcttctatggtgaggtatctcttcaggtttttcatccatttttttattagattgttcattttcatgttaagctttgagggtgatttgtatattcctagcacttcaagaggctgaggcaggcagatcacttgagtcaagaatttgagaccagcctggccaacatgatgaaaccccatctctactaaaaagacaaaaattagctgggcatggtggtgcatgcttgtaatcccagctacttgagaggcttgaacctaggaggcagaggttgcagtgagccaagatactgcaagccattatactccagcctgggtgacagagtgacactccatctcaaaacaaacaaatggacaaaaaagagttatttgtatattttggataacagaagctttatccggtgtgtgttttggatatattttctttcagtctgcagcttttcttatcctctcaacagtgtcatttgcagagtggaagtttttaagtttaagtttttaagcttatcaatttgtttctttcatggattatgtgtttggtcttatatctaaaaagtcatcagcatacccaagatcatctaaatattctcctttgttttctgggaagttttagagttttgtgttttacataaaacataggtgtgtgatctattttgagttagttttggggaaaggtgtaaggtctgtgtctgcattcatttttttttaatgtgagttttcagttgtttcagcaccatttattaaagaatgttttttccagtgtattgcctttgctcttttatcaaagatcagttgattgtacttatgagagtgtatttctatactcaaagatctgttctgtaccgttgatctctttgtttgttcttttgccaatagcacagtgtctgattgctgtagctttatggtaagtctcaatgttgagtagtgtcagtcttctatctttgttcttttccatcaatattctcttggctattctgggtcttttttcttttcatatgaactttaaaattggttagtatatatcaaaaaataacttgctgagattttgattgggatttcattgaatctgtagaaaagttgtgtgtgttctgactgcccccactgactggccattcccccattctttccctttcctcaggccttcctattccctgagacacaaagatattgaaattaaaccaataaataacttttcactggcctctaagtgctcaagtgaaaggaagagtcacacatctctcattttaaatcaaaacctagaaagaattaaggttagtgaggaagggatatcaaaagcagagatatgctgaaagctagacctgtgcgccagttagctgagttgtgaatgcaaaggaaaagttcttgaaggaaattgcaagtgctattccatttagcaaacagatgataagacagcaaaacagccttattgctaatatggagaaagctttattggtccatataggtgatcaaaccagttataacatttccttaagccaaagcctaatccagaacaaagccctaactttcttcaattgtttgaaggctgagaggggtgagaaagctgcagaagaatagaggaaagctagcagaggttgtttcttgaggtttaaggaaggaagccatgtccataacaaaaaagcgcagtgtgaagcagcaagagctgatggagaagctgcagtaacttatccagaagatctagctaagataagtgatgaaggtttgtgcactaaaaacagattttcaatgtagatggaacaatcttctattggaggaagatgccatctgggactttcatagcttgagacaagaagttttaaaggacagctttcaagaacaggttaactttctcatgagggattaatgcatatgatgactttaagaagacatgaatgctcattgaccattccaaaaattttaggacccggccaggcgcggtggctcatgcctgtaatcccagcactttgggaggccgagatgggcagatcaccaggtcaggagatggagaccatcctggctaacacggtgaaaccccgtctctactaaaaatacaacaaattagccagcctggtggtgagcacctgtaatgccagctactcaggaggctgaggcaggagaatggcgtgaacccgggaggctgagattgcagtgagctgagatcatgccactgcactccagcctaggcgacagagcgaggctccatctcaaaaaaaaaaaaaaaattctaggacccttaagatagatgctaaatctactctgcctgtactcaataaatataacaacaaagccgagacgacagcacatctgtttacatcatggtttactgaatattttaagcctggcattgagatctactgcctgggggggaagaaaaatgatttctttcaaatattactgcacaccgacaattgacctagttgcccaagagctctgacggagatgtacaaagagatgattgttgttttcatgcctacgaacccaacatccattctgcaacctctgggtcaatgagtcatattatcttttaagtattattattaacacattttgtaaggcgatagctgccttagatagtcattcctctgattgatctgagcaaagtaaattgacagccttctggaaaggatttaccattctagatgccatttaagaacattacttattcatggcaggaggtaaaaataacaacattaacaggagtttggaagaagttgattccatctctcatggatgattttgagatgtttgaagcttccagtggaagatataactgcagatgtgaaaatagcatgaagactataactggaagtgtaatctgcagatgtgactgcattgatgtaatctcagcataaaacttccatgaatgaggagttgcttcttatgaatgagcaaataaagtggtatcttgagatggaatctactcctagtgaaaatactgtgaacattgttgaatgacaacaaaggatttagaatattacataaagttaattgataacacagcagcagggtttgagaggattgactccaattttgaaagaagttctcctatgggtaaaatgctatcaaacagcatcacatgctacagagaaacttcctgaaaaaaagtcaatcaatatgcagcaaacttaattgttgccttattttaagaacctacgacagccaccctagctttcagcagccaccaccccatcagtcagcaccatcaacactgaggcgagaacctccaccagtaaaaaggttacagctcactaaagtcttagatgatcattagcgtatttagcagtaaagtattttaaaattatgatatgtcacattgtttttagagataacgctattgcacatttaatagaccatggtatagtgcaaacataacttcatatgcactgtgaaataaagctgtgactcattttattgtaatatttgctttattgtggtggtgtggaactgaacccacaatatctcctatactacttcatgggtagtatcggtatcttataataacaaaatgttagtcttctctcctgtcccttgtatcactgctgttatttatttcacttatacataagtacacacacacacacacacacacacacacacaagcatacataattgaataaattgttgctattattactttggacaaactgttacctattagatcaatttagaatatgaaaaatagtttttattgtcttcacttattccttctttgattctctttctggctgtagatctgagtttccaatctttgtaatttttcttctcctgaaaactttgttttaaacatttcttgcaagacaggtctacagtttctttttgtttgtctgagaaagtatttattttctcacatttgaaggataatctcacagaatatagaattctagggttttttggttttgttttcttcttaacactttgtttcattccacactcttcttcttgcctagtttctgagaatctttgtaaagattttttctttgttttttctttttctttgtttttctgatgtttgaatgtggtatgcctagggattgttttttagtatttatcataccttgtgttctctgagtttcctggatctgaggaaactgtcaaactgttattgctgtctcacaataattattcaggaagttatcagtcattattgcttcaaatgttgttactatttctttctctctttcttctccttccactattcccattacacaaattacacatatttacactttttgtcatcgtcccacaatctaagttgtcttggatattctttgctttcttttttatcagtctttttcttcctttgctcttcagttttagaagttttttctattgtcatatcttcaggcttagagattcttttctcagccctgtctagtctactaatgagcctatcaaagacattctccatttttctggtatagtgcttttgatggtcaagctagcatttctattggattctttcttagaatattcatctctctgtttacatcatccacctgttcttgcatggcatcttattttttccattaaagcccttcatatatgattcacagttttaaaaaatgtctggtctgatcattcccacatatttgtcatatttgactctggttctgaaactttttcagtctcttcaaactgtgtttttgccctttagtatgccttgttatttattgaaaggtgggcatgatgtactaggtgatatggtttggatctgtgtccccaccagatctcatgttgaattgtaatccccagtgttggaggtggggcctgctgggaggtgattcgatcatggggttggatttctcacgaatggtttagcaccatcctcttggtactgtcctcgtgataaggagtgagttctcctgagatctgttcatttaaatgtgtgtggccttcctccttctctctcttgttcctgctttcagcatgtgaagtgcctgttgctgctttgctttctgccatgagtaaaagctccctgaggtctccccagaagcaaatgctgccatacttcctgtgcagcctgaagaagagccagttaagcttgctataaattactcagtctcaggtttttctttatagcaatgtgagaatggactaatacactaggttaggaaaaaaaaaagcacaactctggtaaataagccttcaataataatagtggtaagttatggggaaagaggaagcattctgtagtcctatatttagatctcagtcttttcataagcctgtacctctagactgtgatctacactggtgcttaagggtacagctgggtagaattggggatttctatttccctaggtttgttagactctgataaaaccccagcaggttgggctctactaaagtagttgttcctgagggcagaccttgttaagacaaacagcattctctgccatatttcaaagttgtttcttttctcctccttcttccagaagcagaaagagatttttcctctggtattcactgtgaagctctgatacaactcttggaagtaaaactcacagaagtgtgaggatccccttaagattaggtccccctaaagtttttatctttcagacttgtccacactgatccttcagcaattcatcagttaaaagtttatgttttcctacctcatgatggttcagaggaggtttctgctcgtggatttctgctctgataaattgtgacactctatcctaacctgtcttactctccaattttaggggcagcagtttgcactgtaaactcacttctatggcagatctaagaagagtgttaatttgtcagtttgttcagtattttacttgttctaattacagagtgatggacttttaagctccttacacaccataccggaaaccaaaagtcctcataatgctttatttaaaatgttaaatttaggctgggcacagtggcttatacctgtaatcccagcactttgggaggccagggtaggcagatcacttgaggccaggagttggagaccagcctggccaagatggcgaaacccaatctctattaaaaatacaaaaatttgccaggcatggtggcacacacctgtaatcccagctacttgggaggctgaggcaggagaatcactggaacccgggaggcagaggctgcagtaaactgagatcatgccactgcactccagcctgggtagagcaagagactctgtcttaaataaataaataaataaaatgtcaaattttataaaaatccagttataaactactaaatggtttggatttgaaaatacaagcaaggcataataattcattagctggaggtcagaaatcaagactagaaatttacatttttaagacatgtttaagattattagtttgatctgtttcttatatattataggttgccgagacggataataaaagcagtttgatatttctcagaaaaaaaaatctgaaactttaaaaaaaatcatactccattggaatttgatgttgaggcattaaagagatttactacctcttttgtttaactagattttgaaagcacaattttctcaaaaagttaattaaatgtaaaatcatggatgcttattaaattggtgccttcttaagtaaattcttttcagcttctgggtcagatggttctccttgaaagaggctagaattgctgtattcagtattaattgccattttggagacaatatctgtggactgtcagtgacattctgctatgaaagagaatctggaaaagttacaatttaaaacatgttaggctaagtttagcagtcagcttcttcagtatgtgatgatattttctgccatgcactcatccatttcatctcccagcctggactttgcagacaggaagcccaactcccacttaatccctgcttacttttcacttctacttgagacacccaaacttggcaggttctgctgtcggcttgcagttaaccacaaccaccaacccccctcagctttggtactttagacattctctgtaaatagatttgctattataatacattcattcaatgaatacttattaagtactaattatatgcaaagaactttgctaagtactagaggtaaacccatgaataagacatatctgcctacaaagagcttacaacctagtagagacaagaaaccataaactgtggtgagccctaagacaaggtgagctcccagaaggaaatggtgtctaatgagctggggaatgggaagacacagaagactctacattgagtagaatttacttagtcacagattctagctcctccctgcaatgccaagaagaacaacatgtgcaaaggcccagaggggacagacgtggaaaattgtagaaatgtagaggttagtgtggatgagctattacatttaagggtgaaaggagagcacggtaaggctctgagaactgaagaaaccagctgggagcaatttccaaagcaacttccagttttatcatccttgcattaaaatgtgatcctgattttttaaaatagagttaaggggagtgacctgatgagatacacatttagagaaatcattctagctacaagttggagaacattggcatcctagtgagagatgctagtttttggaactgagcaatgcagtgggagcgaataaaagtggaaagtttagagagtaattaaaggggtaaaagtaatagatatgatgattaattggatctgaacctcttctattgaagccttctatttagaacatttcatttctaaataactacaataatctgattagagaaaagaagattttatctctcatgatggtttgactagctgatagctgtgtcattgacaacagttaatgcaatgacattgtgttaatagacatttagcagactcagaaataggtacttattccctttttttttttgaattttgactacgtgaataaaataagtaaaacttctaaaataggaaagataatggcaataggtcccaggaagctatgtgacttgacaaacaagcagattttgagagaagaccttccttccctttactaactaaagcaaggatgtaaacagcactaaaacataccaggcactcaacaaacatctgttgaattgttgacttattagttgtttaatgttgacttattatttcacattttaaataagtcaaaaagtagaagcaattattgagcatacatcagctgaaatttaatatattcattcttgatgtatacatgtattttacctaatatacagtcatattgtgtgatatgtgtcagttctgtgaggtagtgagggcaaagatctaactgagtagagttattctgtcccagttattttaagtaagatgttacttttgttttaaagaatatatgaaagagaaatattaattagatttttcataaatgcttttgaagtttataagttttgaattacaaattagtaatctaaaattaaccagaacttttattggagcctcaaaaaaagctttcaaagtagaactggaagaaaattataatttatgatcttgttcatctttcttctttgctgttctcgtgtagtgatagacgtgttaatgaaaagttttatgcataggaaattgactatcttgaatcatgattatccattgactttcactgtaatttcttatatttcttgttaaaagggaggatggggaatcagattttagaattttctttaaaggagttctgtcattctcctaaataacatacttttttcttctgtgtctgatatatttccatttaattgcctgatgtttctcttagcaagaaattaaaccaatatactatcaagttaacctgtctgtcttccctatcagatagatctctatctatatttgttttctcagtgtcttgctcagtttctggaactagaaaatgctcaataaatattcattgagccaaagtgaatgtttaagattctacattcatttatccattcacttattcattcaacagatacatttagtgtttttttatgtagctggtacagtgctggtccctgaagcccaaaatgagtaggattttgtgcctctcttcaagatattttaagtcttttgaatattcatttaaccttattaacatgcatatattcaaaatatcatagaggtaatttggccataccatagaggtaatttccttccacccttttgtatcttctttgcgggttcttcctcatctcccagacatttaaacgtaggagtacaagggcttggtccttgggcatcatgcattctctgcttatacttgcttcttaagaatctcatccagtatcatggctttaaattattccatctataagctaatgatatccaaatttacaactgctactcagacctctacccaaactccagacttgcgcattctgttgcctactcactatctctacttgcatgtctaattggcatctcaaatttaagatatctaaaacagttctcctcatctctgtaaggtcaaagttactcctcttagtggcaactccgtctttttcaggctcacagtccaaaaaccttagagtaattattgactcattgcgcccttctcttacttaccatatttgactcatcagcaactcctattagattcaaaatacattcagaaactgaatatatttcactccgctccagccatactgccttactcatagcctggtgcatgctaggcatatctcaacttcaagacatttgcacttcttgaatctaatatattcagaacttgaatctgtcagaacttgaatatatcttgaatctccacagcacccccttggccaaaaccattatcatcgcttgctggatcactgtaaaagtgtcccaactagttttcctctttctaccctcaccttcatatagtcttctctcaacacagtagccagagagttcctatcaaattccaagagcatgccactcctctgctcaaaacactccattgccacattgcctactgctctccttctgacccactcagccccagccacactgcctacctcacagcctgggacatgctaggcatattgcagctcaaggtatttgcacttcctctttccttggccctgagtgttcctctcccagaaacctgcatggtctccccagctctcctctcagagcttggctcacagaggccttccctgcccaccaatctaaaagttgatctgctttcttcaccaacttttcttaattccttccttggctttttttttttttcttttttgacaccactattaaactaccatgaattaatttatctggttaattttctatattaccaactatgacgtaagctccattagtgcagggacttttttctcttttgatcactattatccccagtgtctagagcacataacagatgttcaataaatacttttgcagaagagcacatgagaaaacttctgggaagaatatagcattgttttgcaaagggtttaaagagttgtaagtgaatgttttaggttttctttcatctacttgctactttggttacataatggtgcctcagtgccaactattgcctaagtaatagttaattagtatgctcagaatcatagaaattgatttttggtcagtactaaaactagagatttggtttagccaagtatctgcttttgagcaaaatgagacatcatgatacgttttaagaaatgaaaatagttatgcctgtatggtctaaatagaggcagtgttgtctcacatggtatttatgatgtacttaaattgaaatatgatttttctttattattatgatgcttaatgatttgaagtatcagtatgtaccatttaccttgtctttttcttagaaacatttggctacttatttttagccagcaagtaaagtaggatattcaattacccggggagcctgatactaatggctataattatttaagcaattgaagtctttcctgtcattttctttctcaaacccacaaggtgccaagactgaaacatgcaacgtatatacatggattaatatattttctcagtggttgcattcttcaatggagtctctggaaagaaagactcttttgtttgcttttttaatctcttattttggaatctgaaaactattcaaccctttccagaaatgttgacccaaatggggcattttcatgggcagaaagaaatattttctgcctgctcttgcttgaacaaagaaacctactgatctggatgacatcatcatcatatttggcttcttttcctagtattattgatgatacagactttttcgaagggtatgcttagctgataattgtgaaacccaaaacacttggggactatgactagcgtgtactgatgatagacagcctcatgccataggaattgcaatatttagacctttaaaatttaggcccagagtttggaaaaactttataactgactgttactaatagtctggagaaggaagaacactttccatatacacttagatttaaagcattgtttctgtaactttgtgtttcaatattaactatttctcaatgaaactatttctcaaagcaacctcaatccttcagttctctttagttgttcagataatctcttcctaaagaaagcaaaaaataattaagaataaagaccctgctcttccttttgagtgttacggtgtgaaagagagttttagagactgggatgttgtctctgctgaaaaacctaactatgtgaataagacctaagagtaaaaagccatagtcacaaatgaaatttgcctcaggcgcatgttactgaattgcctttatcagcatgtgaaattacttgaaagtcattttgattttgtaaaagaatgtctggccttaataagagtgaacatttgttaagcacttaccatgaactcctccttctcaaactgacaagcatatacacattgtctcattgacagtaactccataaggtatatagtattattctaattcttctttacagatgaaattgagggaggagagtttatttgctttacctaaggtcacagagtaagtggctgtgctaggatttaaacttagatttgcctgacactgaaaatagtgctatgaacaactgtaaaatattgctttatatttactctttagcagaacttagatgatggggtattatgtgcttgcatttagttttgaatggtttgtttttatctctttccttaaaacaaaagttaacaagagactttctgaagtcttattttttattcaaactgttttttgtatcccttccttgttccatgaccctgttcttttacctgcatgccctgaacatggagctaacggaccaccaattttgtctctttattactataaccagcgaatcttcatagatagaggcttttctctaagcttctggatgttataagctctcaatcagtagtactggagtgggtttgtttcttaaataaagagataaagcctaggtttgtgagagctggttctatttggaccaaagcatgatcagaaggtgttttagtaacagaattgagctgagcctcacaacctaggttgttctattgagaaaagaagtgtgaacaaaacctttgtagctagaatcacatggattgatttgggggtgttttgctgaaaagtggttgacaataacatgtaaaaattagtgcattcttcaggactctttatattgcaaggggcagcaatccaaaatagctttggccaaaaagttaacttatttcctcaaataattgagaaaaatctgtgagttgacctggtttcaaatgttgctcaatggtggcccaaattcagctggtctcaggtcctcttttctactttattgccaggcacatttatccaatatggtgacctccagcagttccaggcttacatcattcttacagcaacaagtgttattgcaaagatagccttttgccagttaattccaacaactctatgaaaattgagttgtatagttcatccttgaaccaattactctcaccaagggaattacatgctagcttgtggagctggaaacaggtggttgtcaaaccagtacaggacacatggaccaagagtaggagagtagtttactaaagcaaaaaaagtgaaacaaaaaacaaattaaaaaaccgcataggtccactacagtcagacagaaagaagaggcagccaggattcaagccaggagcaaaatttcctttgaaggaaaggaaacaatgtggccaaaagtgggtagtctaggtgaatagcaacaaggcatatacatgccaattaaagctcttttcttaaacacaattacttccagtttaatactggatgcaatacttaagttatctttacaaaactggaactgcatttttaaaaagtgcttttattttttggcacaaagttctatatactaatctatactatactatatactgtactatatactatctatactatatgatatactaatctatatatacactaacctatactatatatatactaatctatactatatactaatctatactatactgtatactaatctacactgtaagattgcatatttaattcagtcattatcagagaaactgagttttcctctgaccatatgcctttctgattcaaaaggttaaaaaggataaagatgtataaagtagcacacacaattttatgaaatcagataacatctgtgaattaccctgtgtatacaaaatacatgtgtatacaaatatgtgtgtgcatatatacacacatgtatatgtgtgtatgtatgtatgtttgtgtccgtgcacacacatgaggctggggaaggacaacgagtgaagtctagggaaaaaaatcactttagaggttcaactgcaaatctgaaattcctcacgttgattatatgaaatattgtcttttttgttaattaattaatcaattactcttgcctgaatttgaaattcaaatgatacctggtcttattttacctatagataatttaatgcacagagataaatatgttaacctgttttgtctcctctcctctagtggaaaaattgtggagactattaattaaggaattgaacacattatgtttctctaccagctactaaaaataagctgagaagtctctagttacatttggcccaaagtgagatgatgagaaaggacagcaagctggtgtgggacccggataaacagcaggggagagtgactcagccctctggttcccagcttcagcagggatctgtgaatatgagtgagcccttcagtttttaatgggtctttaggcagaaatacgtaaagaaccagaaaactttttttttcttaagataaaagataggcatcattaatatcttttatttttgttgcttagctattgtgttcttttggaaaccaccacaatttaactgcaagaccaacatttcctcattatatgtagcctgctgggtctgccccagctatctttttctcccttatctaaggggtgagcataaaacctgaactaagcttgtgaggtacaaccccttctctggaatttgtaacctgagccaaataacttacggactgaaaatagaagtgaactgactggtggagagacacatctgttcccaccacctgaaaccaggaagcctctctggttcatgattgctgagcctgcttcctcaggcctaccttttgttttgtgagctaccccaaagccttccaagaaacctctcttcttcctgcataaaccaagaaggcctggctctcctgtgttttctctcctcatcatcggggtgaagagagaagctcaggaacatctccagctcccatgcttcacattctacaactcacacagcctttgggctttgaaaccgtttggactcacttaattatcccttttttatttttgcttatggtaatcaccccaagagctctcacactttgaggtcaatctccatctcccacattctactccccataggttcttgtacaacctaatcctaatgctgaaaacatgagatcccagaattcacgtccactcagtgcagtgactcttggcccacattctgtagataagaaacaccttttactgacaatggaaagactgctagaaataacttgagatacccaggcatagtcttatattatgttggggttttataatgtaaatgcaagaatcagatttctccataccccagccaatgattaagctttatggaagactggtttaggtttttctgatctgtaaaggcagactaaaggctgcagtacatggtggccttcactcaggcatttcaatctgtctgcactgaacactgagacactagtaccttagtccacaatgggaataaaatgcacatgcaggtgatgttaatctacatgaaagatgctgaattccataacagaaaaaaaaattacatgtgtgtgtaatatgaaagaattaaataacttcagtaagtacattctatctgtacccttgtcttttataagggtaactgtatataagttaaactagaaattttatttttaaggggtcccatttcaaaccataagtgctttaaacagcaattatcagctaaattttcctgctggcagcattactagagatatgttgtttctgggcaaagttatccagaggaatcctgctccctcgtattttggaggagttgagtttcatagcatgtgataattacccatttttaccagttgagtccaagttgcaactcataaggctgctacagtgtatttctaagtattgtttaaattggaactttaaccttttatcctgggaaatgattggttttgtttttaatctcttcttagtggattctgttattgcagagagcggtatcagtagagattgatatttttgtaggttagcttcagtataccacatgaaatacatccaatgctcataaatgaggcttttattcaaattcttaatcaacttgcattttttgtgccctatgaagggtatttgctaaataatgcacattggaattcaaaaccctggaaaattcttgtttaaaaccagtggtacatctcagcaaactgggtggagactgagggcaacactcaagataaaatttagcatggcagcaatttaaaattagaagcccttgatgaaagatgagacctgttttaggccacttggtgagccccaccttttaaaggcaggatttgactccactgaagagctgagcagtcacgggaggacagactgtctctgccccaatagggaatgcctatcttccgatttggtgtgtgacggtgttaaataaagctgtgacctttgtttatctcccaagcatttccacccctccactggcagaatgccatgggagagtgtccatttatcggcaagctgtggtctaaattcagatactgtctaaagcttataacaataagtgtctactgtatatactgtacagagatgcttcacctgagcccttatacattacatgtttcatgaagttctagcttaaagaagtccctttaatatttatttaaataacagcctgaaataggccatgagtaaaaatactcaggtctcagtatcaatatatataatgtttctgttacctcttaaaggcaaattttttaaaaaggaaagttcctcagtaagagcagcttatcagctcgcttctttaaggtaaaaggagggatacttaaggtgtacatttttcagaatttttagatatgagttaatgatagaaacatactttgacttgatcacatgatggttacacgacgatatgtgtttgtcgaaactcagaactatacaccaaaaagagtggattttgctatatgtaaattgtacctcaataaattcaggttaaagagacagctctgctaaatagaaacgtgtgtcctagatttaaatgcttttatttgtcttatggtttatatataaatttccttcctacccctatcctattcatggagaataaatcctacgcacaccctatgtgggtgggccaccctacatgtcacatgattctgacctagacaatttattggatcaaatgtaaacatctaactggtcaacctggatgtgaaaccaagacagaccaaaattctaaagtcttggagatttgcggccagagtcaaaatatgctctccaaaagccatggttaagtgagagttatgaggagctgcaaaaatgagttatgcaaaagaagccaatcagaaggaaggagaattgagcaggcagacagagaatcattgagccagcgtccctttctcgtcatggaaagggagatgagcatagtaccttgatgatattctagtttcccagaggcctagctgaacttataattgaattatctgactttcccctacagatctacttttacttaatatagctggtgtgagttctagttttcatgaaaagacaggaaaattacccaatgacatttaatgttcttaatcccaaatcacaggcaaatatcaatgttttgctagcaccaccactttaattcctaaagtagaaggagtagaaggctgtagtagtgggaaggaagaacataatcttacggaagtctgggttatttctgtgagctcagttttcacctgaaaatttcagaccttttaaagaaaaaaaaaatcaaataccttctaaggactaagttaacacatagcctggtctttttcttttcttttcttttctttcttttttttttttttttatgagaaagttttgctctcattggccaggctggagtgcaatgggaagatcttggctcaccgcaacctccgcctcccgggttcaagtgaatctcctgcctcagcctcccacgtagctgggattagaggcatgtgccaccacacttggctaattttgtatttttagtagagacacgctttctccatgttggtcaggctggtctcgaactcctgacctcaggtgatccacccgcctcggcctcccaaagtgctgggattacaggtgtgagccaccgcacccagccagtctttctttttttcttccttctcagttatttaggtatagaaaaggtcaaatagaataacaattattgattctacctccttatattaataaaattattctgtttgtgagaaaattattttacctctactttcacactgcatttttatttttgtttttatttttagtgctggggcacatgtgcaggatgtgcaagtttgttacataggtggacgtgtaccatagtggtttgctgcacctatcaacccatcacctaggtattaagcccagcatgcattagctattttttctaatattctccctccccccaccctaccccacattccatttctgatgactgatatatttaaaaaaacagaaaggtcacttcttctgaatactatagtatagcttttaaaaataattatagccaacttgaattaagtgcttaaatatgtggtattcattgcactcagagccctgaatacattatttcatttaatcctgataatcttatgaagtagttgccattattatcatgattttacagataataagccttcatgagttaagatagatacctgtagctctatggtagtaagtttttacacctgaatttgataccaaacagacctacttctgagtctgatctcttaatcacaacaaagagtatatgcaacaagaagtatgtatgttttacagctaaggaagtaatcataaggtaattgttggattttagttagttttctgaatatcttttctaactagagagacagttatatctacggttaagaaaatgtggtacatcttactgaatcagtactaaatcaatactaaatgtgtaacattatcattgtgctatatttaaaaggttgatatattgtagcactttaatgaatacaatatgaaaaaccatttctgtttatgttcatgtgagagtataaactatgtatttgagaacactcagcaactgtggcataacagaatatcccaaaagttaatgaaccaactgaggagtgttaagttattcatgcacatcaaacatgtcattttctcttgcctttttaattggttaagtatgtcagagtttgaaagagcttcattaataaggtcatggtatttggttttaaaatagaataaaataaatgagggattacacttttgtttagaaaaaatgagatagtatctttcattgtaaaatctgggacctaggaggaaaggaaaccacatagttatgtaagtagccatgcaggccaaatttggccttacatgtgggtaggacatggaactgttggttgaagaaaaactcttctgtactgtcaactggaagtcttgggatgggaaacctgtatttggaaagctgactttttcaaacagtggctgtattttcagtaaatatttcaagaattctttttctggtttttaataaagttctctgttttaaaatgtcaggctctttcaagcatgctgggttagtctgttttgcattgctgtaaaggaatatctgaggccggataatttataaagaaaaaaggtttattttggctcatagttttgtagactgtacaagaagcatagtgctggcatctgcttctggtgagggattcaggaagcttccaatcatagtggaaggtgaagggagagcaggcagtgtcacatggcaagagagggagcaagagagaggggaagaagtaccagggtcttttaacaatcagctattttatgaactaatagagtgagaactcagtcactgttgtggcagggcagtgggcagagggcaccaagccatttatgagggatccacccccatgacccaaacacctcccactatgccccatctacagcagtaggggtcatatttcaacatgagatttgatgagaacaaatatccaaaccatatcacatgctaaggggaaacatgcttaaggaaaagtaaaaggaagagcatcatgttactttgagaattggtgttgtaattccagagagaaggagcagccaaacctggatgagaagcaacaattttagcaaagactcaactataatatagcacctgtctagccatttctgcttacagaaaaattcctctgcatagcttagtctccaaaaacattcagtggaatatagtttttaaactggccttttgttatatccgtgttaggagagcagataatgtaagtgattggtacatataactcaggctgtctcctgatttgtagtttgcctttttccatttattctataaagttaagagacagtctttggtttttgaagaaaggagtttttattttgtagcatattttttaattgtttgtcattcttcagatatactcagttttatggaagaatttgattgtgtagcaatggtagcagacagtagctcaatgctattttctgccaaaggacaggacatgcctctgcaaattgctcttcactgcattagatgtggatttttttactcttaaccttctctgttaaaatcttacgatgacttttaaaatttgcaagtgtttaggggaagaaatgagaagaaagagctttggctacatctatgtattgttaaagttatctctttagctctgtgaaaaactgcttatttacaaacttgagtaaaatttctggtttaagatatcatatttaaactgtaacataaaatccaatggcacactttcccccatacctaccaaacgagcaaaactagctgaaacattttcattttgaactgatatgaacccaatagggaatgagggataacttaaagcaatacacttgaaaaacttgtctccagtataaaaaacaaacaattccgagatggaacagagtgagtggcacagtgtggcttggtcattaacctactctgtaattctagagctatacaactgagttgacccaatcctgacaattctcacaaataaccaaatatgtagagagacattcttagtgagtcctttttctttttctcttctggccaacaagaattagaaacagagtcccaggatacttgaataaagggggaaatgtgaacaaaggggctgactatgacaggattgaatggacatttcattgctgggaaaatgatccgaaatattaagatactgttccttgggaacagaatatctttcttcaatgaagtgggttgaaccctggtacaaagcatctaatttaaacgacttttagagtggagctcaagtattctgacaaaaacacaataccaatactcagccagattctgcaaccatcttcctcctgtcagtctttcaagctatagaaggatggtaggactgtgaaactcctagcattccatatgtggctcatagtggtggaaaagcatatgatgttatttatggaagggaaagacttaaatcaggtgcactctttcataacaaatacagagtcttgtctgaaatgtccaaacacatggaacatggggaaaaatatgccatggcacaacatttatgcaaataattatacaagcttattagatctaaaaaaaaaaatagtatacgaagagcccaaaggaaaaaactgtaacacaaatgagccaaagaaaatctcacagttgtgtcacattaaagaaccactcactaaggacacatattcaataaagagtgagctcaaagcctagaaaataaaaggtatatcgtatgtgtgagaaaacaaatcgagggccaagctaacatcattattgaactagtaacagacaaaatacaaggtatttgataaacagtactgattatgtaattagtgacagtgagaagacttatgatcagtatagtgtatgtggatgaaggagggggagaatggagagttttagagaatctaatgtctatggaacagagctaaagctaattcaacataagggtaattggtgttcctgaatagagaacccaaaatatggaacaacatatgtaactcaagagaacttttacaaaatgaagaaagattgaatctgtatatcgaaagaacacaacatattccaggaaattttgaatcagaacatgaatctgagagatgttctagttaagctgataaacttttaagattatggaaagaattctttacgcatccaggcagcaagatgctatctaatgaaaaccacagcagtaaaaattctcaaatgtgaaaaccaaaaccccaaagtaaagaattcattggactcttcctggggggaggggaaggagaactaacaaaaaacaaaatacaaatcaatgaaagtaaataatttattaatgaaaaacctgtggtaaaacgattggctatgagcatttaatcctctttgaaatgaaatgaatactaaacaattctgggaattaggaaaaccaagagaatgtgaatgtataaatctaggcagtttcacaattataattaacaaaaatagggaaatgagggaggggaattagaagggtgcatgagaatgctaatgtcttcatcttttgttgaaggcaggatgtcagttggtaccgtctaaattaaaacatgtagttaacaaattattctagcctcttaattttttttcaaaattctcttttaaaaaaaatttaaagtgatcttctgagaaatacatctgcagttaaaaagtatttttaaggttcactttgttttttctattaattttaaattgagttaaacttaatgctcagtaaattaagattaataatcatacgagtttgtttttttaatgtgtatgtttctatcgtctgtatacccttctgtgtacttgtgtgtgggcacatgcacacacacacactcttctagattactgtctgatttgatcttctaatattgatgattatttctgttttggatttaagatagctttttcttctttttgctttcatttttatactattcttcattgttttaagtctctatactgagaatatcttattttcattaaagtaattctgactgtttaaaaaggtgaggggttggtaaaggagattagaagcaaacgtgccaataagttaatgggactaaacatcggagatctgtgaatgtagattttcagtctattatgtgttttttaatgtcaaaaataaaaaatattttcaggggccaggcgtggcagctcatttctgtagtcccatctattcaggaggctgaggtgagaggattgcttgagacaaggagtttgaggatgcagtgagctatgggatcttgtcactgcactccagcctgggtgacaagagggagaacctctgtctaaatatatatattaaaagagcttaataagtgatgaccgagtattttctaactttagctagaagatacttataaaaaatatgtgaggcttctcttttaaaaaatagcaatatagtttatgcttcaaattcctacttactaggaagtcagtaagcaaaaaaaaactttacataactaaaatatttgccaacaaatatattcactgaggctcatgcactttattccacaaagactctcaggcccttcatcagaacacatcgctttcatgcattttaacaggttttataatctaatgtccaagcatttaggcaattagaaactggaaattaaaggggagaaatacagaccaaaaaagacaaagacatagatacactgattgcaataacaagaagaataaagagctgactgactgagggtttaaatgaagcacagcaaagaaattagagctacaaaaacattgtggtttgacaggacttggtgaggggccaaatatttctactaacctctgtagttcttaagcaccaaaaactgcataacacagaattgtataatcataattatgatccggggtctttaagaaaattatattttgcatatttaagaattcagagaaatttaaagtatattttgttgtagccatcaaaattaattaaataaagttttggagctcaaaggagcttttgttattttgaaaaataatttaagaaaatagccctgtccctaatgataccaagtgaatgaggtgtttctttaattgttttacattttgttgcataaaacactgcaatttatcatacagacacataatattagttcttctattgtctttctatccatggagtggatggtaatcttcaaataaataattacccttctttttaagttccttaagacagcaaatgagtagaataaaccccctcacttctgtagtttaacagcctacattctccagaggggaaaagtgattacatttactacctgagttttgtggagctataaatattactgtagaaagcctaattggctgttaaaacttgaagaagtgagtgcacagatgctgtgttcattttttttcttcaactgatttcaccatatgctgctgacaaaggaagacttaccctggtaaaactgggcttataagacctcctggagttctcaaattcagcagtgacagtgtctgtctgctgcctatgggattaatgttttcatttatgtgttctctagccatttggaacacatatgtaacatttaacagagtctgagagttggcaaatatgcctagcatttttccactgacgtcaacagagaaaaatgttgttctcaataagatctgtccagtgaagcactttagtcaaaatctaactaagagctgaggcttatcttgcttcacagcttccttataatgtagacatatggttgaaaagaacatttaatgattgcatggcattaaaagtgaaaaagaagtatctcagtttgtaaaccaaaactcaaacttggaaataagctttgcctaaatgcagtgaggaatcaggcttttgggttctaatactagcccttttccttcgtgactgatgaccttggaaagattatcccactattctgtgctaaaatagattatttcaacagtcctttctgagctctaaaacctcataatttatttagatgctatttatggaatcaaatatatttttaatcagagaaatgccctgattgcactgcattgaacaataaccatggcagcaatgtgaagaatatatttgtagaaaggagaggtgaattgggagattgattaggaggctgtctagtaatttatgtgagacacggtgaagcactgaactctgtgggatagggaatgaagaagaggggatcaggtccaggagtattttggagacagaatgtggcaaaaggtggtaaaccactggatgccacagtacggaactgaaagtggagctaaggatttagcgtgattggtgcacgggtaggagttgtgatataagaatgtagattaaaatgaatatattttgcgtaccctgaaatgccttcagaatgtccatgagacatctactgaagatagttaaaaggtaagagagtaataggtggagagagaatgagggtagacagggatattgatgagagactctcacttatgggcagatgagaagaagccagtgaagaagtagatagtaaaaacacaggcaaaaggtgggggagtcagggagaactgaagagtaaagctctgaagagcaggaacaaactaagatcggaaatgaagcctttgatcttcaaggaggaagccttctttcttttaggtaggagggaaggaggaaatagtaagtgagaatttacatcagttcaaggtgtgcactggaaaatgtatggaagtagttttataaagcctctttatttgttatctggaggcttctggttgccttattatacaatgcctgaaggttatacttggattcattattcaattaactgttgcacccacgtttttggtatttccttgcctcttcacctgcagattctgtcaacagacctagtgtgctttattggaatatccagagtaggccatgtgggctgagtttagtcgaagaaatggttgatgattttttaaaaactttcatgtcatgttcgttcccaaaaggagagcatcagtactaaaatgctcaggaaaatcaaaacataattgtagcttctgaataagttaatttttaaaagattacctcaaacaacaaacaacccagctcttgatataaaatctggtgacttagagattgtatgtgtgtgtatgtgcatgtatgtgtgtacacacaaaacacatgttttgttgtttggagtttttctttccatttttattttaggtttgggggtacatttgaaggtttgttacatagataaacacgtgtcactgggattcgttgtacacgctattacatcactaatgtattaagtccagtcctcaatagttatttttcttctccgcttcctcctcccaccctccttcctcaagtagaccccagtatctgttgtttccttctttgtgttcataagttcatatcttttagctctcacttataagtgagaatatgtggtgttgagttttctgttcctgtgttagtttgctaaggatggtaacctccagccccatccatgttcccacaaaagacatgatcttgtccttttttatggctgcataatatttcgtggtgtatatgtaccacattttctttatccagtctgtcattgatgggcatttaggttgattccatgtatttgcttttgctgggtcgaatggtagttctgcttttagctctttgagaaaacaccatactgctttccacaatgattgaactaatttacactgccaccaacaacgcataagggtttctctttctccccaatctccccagcatctgttattttttgactttttaataatagccattctgactggtgtgagatggtatctcattgtggttttgatttgcatttctctattgatcagtgatattgagctttttttcatataattgttggctgcatgtatgtcttcttttgagaagtgtctgttcatgtcctttgtgtttggtttttttttttaaataaaaatttcattccagtgtaccaaattaaaattgccaccagtaaatactttaagcatcctttcctgtgtatgagattaggccctttttaccatattttttaaatcttataaatagtctcagagggcttttaatgtaaaataatgattgaaggtcaatcaatccttgtcagctaatgatatgtttctaggtacttttccctttcctcaacatttttatcaacacaattcttatgtaaatgagttctatttaaacagtttagtctggtttagtaaggtatcctgtagaaaggaagaatgtgtcaactctggaagtttagcacaaccctattcttttaaaataacaaatagtgaaacacttcctttttttttttatgaaaactgttttcatgttgcagggttttacccatcttcaagtaaaataatctttcaggaattaggcccaacatgtctctctacataaacaagattgatgttggctcttgaagtttttcgagagtatgttgtttgagttaattgaatttattgtctccaaattggttttcacacttctctagtgcagtctgtattctgttaattaaatttatgaaactcgtgtctcacattgaaagaatataatacagatagataactagactcccagatagacagctagttatagacaaattttttagcctcctcagtagctgggattacaggtgcttaccaccatgcccagctaatttttttattttttagtagagatggggttttgccatgttggccaggctaggcttgaacacctgacctcaggtgatccacccgcctcggcctcccaaagtgctgggattacaggcgtgagccaccgcgcccagccgagtttgacttttttaaactgcacattataagttagatcatgcagtatttatctttctgtgcctggcttttttcttttaacataatatcctctagggccatccatgtttttacaaataacaagattcccttctttttaaaggctgaatagtattccattgtctttatatgccatattatctttatccacacatctgttgatggacacttaggttgatttcttggctattgttaatgctgcagtgagtatgggagtgaagacatctcttcaacgtattgattttatatcctttgaatatataccccatagtggaattactggattatatggtagttctattttttaaattattgaggcactgtcacactattttccataatggctgtagtaatttacattcccaccagtagtgtaccagggttcccttttctccacatcctcaccacttatcttttgtgttttagatagtagttgttctaacaagtgtgaagtgatattttattgtagccttaatttgcattttcctgatgattagttatgttgaacattttttcatacacctgttggccatttgtatgtctgctgttgacaaatgtctattcaggtcctttgtccattttttaatcaggttatttgttttcttactgttgagttgtttgtttcttatatattttgcgtattaacctattatcagatgtatggtttgcaaatatattctctcattctctaggttgtctcttcactctgttgattgtttccttttttgagcagaagcttttaagtttcatgtaatctcatctatttttgcttttgttgtctgatcttttgggtgtcatatttaaaaattcattgctcagacctatgtcaaggagctttctccccgtgttttcttctagtagttttacagttttaaatcttacatttaagtctttaatctattttgagttgatttttatatgtagtgtaatatgaatgtctaatttcattcttctgcatgtgaatatccagtttttctggcaccacttactgaagagactctctttttcctccttatgtattcttggcatctttgttgaaaattagttgaccataaatgtatgtatttgtttctaggctctcagttctcttctattggtctgtgaatctgacaatatgccagtaactctgctgttttgattactatacctttgtaatagaatttgaaatcagatagtgtgatgctttcagctttgttctctttgctcaagattgctctagctgtttgaggttccatacacattttagtatttcatggttgcatacaaattttagtattgttttttctatttctgtgaaaaaaaatactgttagaattttggtagggattgcatagaatcagtagatcactttcattagtatgaacttaattaaacaacattaattcttccaatccatgaacagaggatatatttccatttatttgtgttgtcttcaatttcttttatcaatgttttatagaattcaatgtacatatctttcatctctttgctcaaatttattcctttttgtagttattgtgaattagattgttttctggatttttttcatatactctgttgttagtatattgaaatactactgatttttgtatgctgattttgtatcctgcaactttactaaatttgtttattagcagaactatattcttaatcatctcgattatattcaccataaagagtaaaacaagaataaacttgcttcactgtaaaatacttataatctaaaggaatcgactcatatgtttatatttgctacaaatggatttttctaaattacaacaacataaaagccaatttaatgtttttgtagagatattattcttaagagggtagaattgcatgaattctgacctttggggaagatcttgtatgataatggtttagattaaatattggccaattctctcaaattcttgtgtgagatatttagaagttaattacttaaaaatctggtaacaggtatattgttttgttttatattctctatttaaaagaaactttgaatgcatttttaattaacctctatagatatatacaagttgtacatggtcctttcagccattttcctacattgtaccagaattattagaacaaaactggatatcccatgcaaaatttaaaagttggacccttaccttacaccatatgcaaaacttaaaatggatcaaagacctaaatgtaagagctaaagctatgaaactcttagaagaacatgtaggagaaaaactttcatgacattggatttgccaacaatttttttggatatgacacaaaagcacaagcaacaaaagaaaaaatagatacattgaacctcatcaaaattaaaaaccttttatgcatcaaaggacacaatcaagagagtaaaaatatgggctaggcacagtggctcaggcctctaatcacagcactttgggaggcagaggtgggagaatcacttgaggtcaggagtttgagaccagcctgggaaacatagcaagaccctgtctctacaaaaagaaaaattaatgaaaagataacctatagaataggagaaaatatttgcaaattatacatctagtaaggggttaatatccggaatatataaagaacttctgtaacttaacaacaacaaaaaagcaattaaaaaatgagtaaaaggcttgaataaacatttcttcaaagaagatatacaaatgaccaataagcccatagaaagacactcaacattactcatcattagagaaatacacatcaaaccaccgtgaaatagtacttcacacccactaaagtgactattataaaaacaaaacaaacaaacaaacaaaagatggaaagtaacaagtgttggccaggatatagagaagttggaactcatgtaggttgctggtgggaatgtaaaatggcacagcagctgtgtaaaaaagttttgtgattccttgcacagttaaacatagaattaccgtatgatctagcaatttaacttctcagtatataccaaaaagaattgaaagcagggactcaaacagatacttaacaatgtttatagcagcattattcaaaatagccaaaaggtggaaacaacacaaatgtccatcaacagataaatgcataaacaaattgtagcctgtacatacgatgcaatattacacagcttaaaaatgtaatgaaattctgacacatgccacaacatggatgaaccttgaaaacattaggctaagagaaataagctagacccaaaagcacaaatattgaatggttccacttatatgaaataattagaataggcaaattcatagggaaagacagtagagtgacagttaccaggtgctggaggagagggggaatggatagttttggggtacagagttctgtttggaatgaccaggagttctgaaaaggtcacacaacattatggttaatgccactgaattgtgcccttaagaattttttaaggagtaaatttcatcgtgtgtgtattttgccacaattttaaaaacatcacttttccataaaaaaataactagagacccctgaacatacactgtggacagattttattaataaatcttatggtttaagtatcaagctattgttaattacttctcctaagtaaataaacctaatacctggtaaaatgatgtctagttatgtggttgcagtatattaaccaaggaggactcgttgttttgaagcaataataattataactaatgtttattgggtacctagtgtgtacctgacactgttatgttcttcaactattttagctctttaattttacatcaatactattagatacttgttttagccattttatagattaggacactgaagttcagagaagttaagttattcttctgagtcacacagctaaatagctaagtatcaaagacagttgttctaacataaggtgactaacttccatgcttgtcattttaaccaatttcaaatttcatccatatttgctttgagatacctgaaaaatcagactattttatatagttttataagaattataaagcttagaaatgtaaaattttatgtggggatctaagatttccccctgtataacaggatcatagatgtcagatcaaaagatctcagctggccgggtgcagtggctcacacctgtaatccctgcactttgggaggctgcggcaggcagatcagctgaggtcaggagatcgagagcagcctgggcaacatggtgaaaccccgtctctactgaaaatacaaaaattagccaggcttggtggcgggtgcctgtaatcccagctactgggtaggctgaggcaggagaattgcttgaacccaggaggcagaggttacagtgagccaagattgcaccactgtgctacagcctgggtgacagagcgagactccatctcaaaaaaaaaaaaaaaaaggaaaagaaaagaaaaaaaagatctcagttgttatgtttggggtctgaacatgtataatgttcacggcttgactctagtctgcttttttggttgtttgatctcagtgttagtgcatctgattttttttaagtaattcagtcagtagacgtttattgcatgcctgctatatgcatatactctgccaagtcctggaatacagtaatggacaagacagaactgacattgtagtagttgaaggaggaggggatggataatgagtaaatgaccaaagaaacccagcaaatcattttagttctagtgctatgaagaaaacagggtgatatttggtgcgtaactaggggctgatggctgatttagagggtgatcgggaatggttgctatgatgtttcaggagaagaacctaaatgttgagaagatctgtgagtagatattccactcagtgtgaacaatgggtacagccctgagaaaatgtggcttcaatgaggagcagaacaaaggccagtgtggcatgaaacatcccaagtcctagggtgcaaggatatgaaataatacatgagataggtgtgggccagagctcaaaggccttgtaggccagaaagaggaatttagatattatgctgtgtgttctagaaaggtgttggaagatttaaagatcggaaatatgaaataatccgatttcattatacaaagctctctcttgctgcagtgtggcaagggattataggagggcagaatggaagtggaggaaaatggatattggaggagtcaaagaaaaaaaatgacaatgatttgggcataggtgagagcagtagaggagaaaacttatgtttcatcttcaaaaggtaaattggacttttaaaaatgactgaactctacacatatattgcaaaagtacaaagaattgaacattcagagctttaggaagatacatggtttttaaaagaaggggattcctgctctttgaactggaccagtattactaagctgattcacagtcagaaaacagtctcttttgctactttccattgtgaaaaagggagagacgtttcttctcttcagccttccccctttagcatgaaactctcctattcttagtggcaactgaagataatattgaaaagaaaaaataataacttcacagaataaataatagaaagtaaaacattttacaatgatgaaaatatgtagaaattctgattgttattttagaatatcaaataacaccacaaaatcttccaaaagtgcatctaaactctgaactcattaatagcctctactaattttttttctattctgtaggaaagcagactgttgagttcagaaaaggccaggaaagtgaatttatcctagttttctgtcttttctccatgtttcaacattcccaaaagtgatttaaacctcaaattaaggtgattctgtcatctgggtggcaaagattatgatctatggcatcttatcttgcacacgtgtgttcaattattcgttttttttgtgtgacttcttttttttttttttttgagacagagtctcactgtgtctcccaggctggagtgcagtggcatgatctcggctcactgcaacctctgcctcccggggtcgagcgattctcctacctcaacctcctgagtagctgggattaccggcatgcaccaccacgcccagctgatttttgtatttttggtagagacggggtttcaccatgtgggccaggctgttcttgaactcctggcctcaactgatccacccgccttggcctcccaaagtgctgggattacaggcgtgagccaccatggccagccttttttttgacttctgcgtgaaagtaactcttctaagcatttggcagccaaaatagagaggtattgtacagccctttgaataagccctctttaatttgttgtaatgggtaaatttataggatcatggccacccagcttcacttctaatcaccaaccccctaccttgcctgttctctttcacaaaccaatacactgtggtgctggctgaaaacatttctaatcatagacttatctgcagctggtgactatttgtggtctgacaggagattgaccacatcctgtggttaaatgttattattttttctgaagactctttgaactgacttaactgctttcatttgatgtttcaactgacttatctgtagtaatagccaagcatgtatgctttgaaaatttgaattgatatcctttatgtatcacatggatatctgttatatccgttgatgtcctattacattttgtattttctgagtattttttaaaatttaggggccatcatattcctcatctaatataggctctaatacatggacacttggtatatacttgttaaaagaataaatatgcaaatgactagaagaataggagttttaaatcctccttttaaaggaaaatgttaataataaaaaatacccgtagttccacttcccttttttaactgatttcatattgcatcttccctttcgcatactgttcaattcaattaatgttgattgagctgctaatatgtctcaggcaatgtgttaggctcatgttaggttcaagggataccaaaaataagtaagacatggtccttgcctttccttatcttgaggtttagtaggagatatgggtatataagcagatggtctcggtgtgaaatttaaatcaaacaagcacagtatgctgtgaaagcacagtgggtggatttcagagaagtatttctggaggaaacttgggctctttcttgaagaatgtataagctcatggaaaattaaatcaagattgcctagctaggcgttaccagcaaggaattacattaaaaatgcttggtgaaataggcaactaaccaaagttcaaggtaattggtgtggaattaaaaagggagagagctcagtaagagtgtgccacgttatggaggtccatgcatgtcatggtaaaggcctgaaactatgtactctaggccaatcagtgttagctttccaaggaggaggtcactgataccttgaaactgagctttaagtatgcgtatgcaaatgaacctagtaaaattgcttcagtataaaaactcttaatatagggaacattttataaatggaaaagtagacatttaatagtcacaaatgagagtttaaaagaaactagttatctccatcaagagtctctatttcatagattctctaaggattttttaaattctaggttagcttccttcaacactatcagtctgtaatatttttcactaagttccctcttccccttttctgaagcttcctaccattaaaatttgcttaagtgaaacataaatctcgacatgaagtatatttgggtgggataggatactgtgccgaagttgtttatttgtactgttcttaacacaatagttgagtacagatacactccagacttgaataatgtggctaaatagatagtctccaggtgatcaactaaaaataattgtattctgtcatcacttctcccattgatcccaagaagtgcctccaagaaaattacctttccttctccagtattagaaatctgtgggatagcaccatccaccaaactacccattgaaccactatcttagagttggaaacactgaaacatcctcatttccttcttagggtccagcaaaatggttcagtaccttggcaacacgcccttccctatagaaccagagggagggagtggggaaagaaaatataggaagaaccaaaagtgaggattctatgagagacaaagtgaaagaaagctctcaatgaaagaaaacccacacattaaatggctttcagtacccagatctagagtgcctggtttgcattgtagtaacttaacatttgtcagtaatgatgcctacaaatactgtgtttattatgtgtgtaagaatgcattttattttgtttttttgtttttttgagatggagttttgcttttgtcattcaggctggagtgcaatggcgtgatctcggctcactgcaacctccacctaccaggttcaagcaattgtcctgcctcagcctcctgagcagctgagattacaggcacccaccaccaggcccagctaacttttgtatttttagtagagacagggtttcaccatgttggctagcctggcctcgaactcctgagtgtatctacctgccttggcctcccaaaagagctgggattacaggtgtgagccactgtgcccggccagaatgcattttatttttaagtccacagctaaagattatcttgttgtattgttgaatagtgacaaagctactactaagtgtgaataaagagtttgtaattttgcaggcattcattaaattaaataaagccatatatgcctataaacctaataatcttctttaaaaaacaatttattgaaccaaactattaaaccaagtttcagtaaattagttgcctaacacttgcacataaaaagcaacaaatgttttttgattcaatgaacaattgattattaaaatcaagcacatttgtcttactgaactgttagaattattaaaaatggaagcaatgtaaggctgtatagatctttgtaggctgcagttaagtataaatctgttgctccttctttcgtatgttagcctgaaaaagaaaaaagcatgcacttagaaatcacatggggaaattttataatttagatgatttgacagatgataagctgtctcaaatccctttaagaagatagtgtagtataagtaacacacaaatacatgaataagtgaataatttttaaattgacaataatttgaatgatctagacttacctcaatctctgtattctaaataggcattgtgcttagaaaatgagtataaataagattttagataattacttaacacagtaatttgcatgtggcatgcctctgcttggctgtttcttaatggagctctggcagaatttataatttgtaaaggagtcaaataagactttatcaccttttacttaaaagaaatgtgttttcatttccttagaaaaatattccataatttagaaatatggctattcagactagactcttttcagattaaattgaattatgcagctttacagtgatgctttttcttttaattcattgaacattttatatccagtaaaaagtcagctaaaattactagagcaaatcaggcttttctttaatgcttactaagtgggcgtgtatgcttgtgtttacacgtgtatgcaggcacacatacaataaaccatttggtaatattccagagacccaactatattgccagtaaaaaataagaaatctgttgtctgatgatatgtgtagtacatggcaacagaacacttaagctgaagcatgaagaacttgtgagcatgaatgttaaacctagaaacaattactaagtcacttcttagctactgacaaaatcaaaaggttgggaataaaaccggcaataactcttgatctttttttaaaaaatggtattactatctcagacatcccttcagaaagcatcgtttctgttaagcctgtgtagagattaatctggcattatctttttaaaaatgtctagattgacttaagcctttattcagataaatgggaaaattttatgtaactagaaatgagctactagttttcattgtaaaacacagtcactagagtataccaaaaagaatgttgagcacatttgggaaaaggtagcttttgtaagcctttttatttgtttttaagagacagggtctagccctgtctcccaggctgaagtgcagtggtgtgatcgtagctcactacaacctctaccctctgggctctagcaatccttctccctaagcctcttgagtagctgagattacaggcatgcccaggcatgtccagctaatttttaaattttttatagatacggggtctcactatgttgcccagactgaattcctgggctcaagtgatcctcctgccttggcctcccaaaatgctgaggttacaagcctgagccaccacacctatcttgtaagtccctgtagtaataaaatatatcctgaatattgtgaggaatgagaggaaagttagagatcaaataaggggaaattgagattcctgtttccaactcttttgttccttttttctctcctctttgcagttgaactcctgtttcttcctaggtgttcatgtctcacatttcttcctggccaactcttcctcatttatgtagggtcctccttggatagcacctcctctatgaaagtttctctgacccacagaaggaattcattattctctcctctcttttcccttagcctttatgagactattttttcctcttcattttttgcttatcctttgtatggagtaacttcctgaatctatatagcagtggtgtggagccctctaggaagcataggaaataggggaaatagcaagaattcttcataaactgcaataagtgacaagatgcagcaagactcccagccttcctggctggcatggggcactgattggtgtaatgttccagtgtggatgttactgtgtattcatcagtgagtctacacagatagagtccacatgtgtcccagttgtgctaattcttcttcctttcatcatgctaaaaaggtaagtattgggtgaaacttttttacttacaagtatacatatttcctctgtaaatgggacaattcctgagtctaggatttgctaggtcttaaggattatggctttaaaaatagacctatgctttaaagcatgttccacaggaacataattttttatttatgtttctattttctccacgagactagatgcttgatagagcttacaacttgattctttatattcttgtccattagcatgggcaaagctcacacatattatgaataaagttgagtaatatttgtagaattagtagataaacgacactgcttaatgacaaagtttaactctccatgaagctatttgtattttcaggaaaaaaaaaaaaatgctgtgagaacaaatgagtcgctcactggagaacttggtaggggatgtcctggtatccgcaaaacaagaaggaccatttaaatagctttcagccgactgtagcctgagcccttcctttgtaagcatctacacactcacagggatcaacagtaacagtatctcctctccagcagaggatctgttggtcttctgagtattgaagactgataaatgatagaatctcttcttgtctgacatctttgaaacccccaatgttccagaacctggaaaacctgttgtcgtataggggcgtatcaacaaatcagtggcttcactcatctgtcacctctatttcaggattatttctgaagtattgatgattagaaatatgttagaatctgaactttggggtataaattcacccattatctacagtagctttcctgctttcataacatgatctacacattttgtggctaaataaatgctcatttttctgatgaccaaagctaacttttagatgaattactgatacacagaaacgatttcatcccaattaacgtgtgaaacacaatttaactgtgatgatgttttcagtcaaaggcagttgccttggcattaacagtgaaatcttacatgcacaggaaggttcagcctaaccctggtaggattcctaggctgtttcagtacatgtgacgttaataatatgtagcttatcaggtaatgatgctcagttagtaacattcttcagtgagccaatggcagatatttttaaaagtgattataatttttctctaaggattacccaagcataataaataacaaaatatgagcaaaaaatgtgataatacaagggatttttaaatggcaatgattttaacatatagataaataaaaataatcatgtccatattatagtgtttgaaacttagtctagtgaatgacaagagatagcataggtattgagattttaatttatctgataggcttaccgaattccaatagttaatacataattcctctgtgtattcaaattgtttctaattagatggacttctctattcttttaaaatatattttgtaaatattcttgttatctttagaatgtctgtggtgcttgcaaaaccatatacagcgatttctttcatttgtttttttttaatgcacagtagagtatataggtcagataacgtttgaaatgcatgacatgttagtaatcttccatttacctctttaaattaatattcgattttagtatttatttatttttgagacagggtctcgctctgtcatctaggctggagtgcagtggtacgatcatggctctctgcagcctcagcctcgcaggctcaagcgatcctcccacttcagcttcctgggtagctgggactacaggttcataccaccccacctggcaggctctcactatgttacctaggctgtttttgaactcctaggctcaagcagtcctcccatctcagcctcccaaagtgcagggagtataggcgtgagccaccacacccggcaaaatcagtattttataagtgaaattacatatatatatacacacatgacatagtagtgtatgtgtgtgtatatgtatgtattacagttgttcctcactatccacagaagattgaatcgaggaccctctcagataacaaaatctgcagatactgaagtccctgatataaaatggcataatactgtatttgcctataacctatgcacatcctcctgtatacttatttatttttgaatactatatttttgatcctcagttggttgaatctgccattgtcaaatcctcatatacagagggccaactgcatatataatttaatgatagcaaattactaaaaatatcgaggccataataaaaattattgatagcaaattactaaaaatattggggccaataaaaattaatgacttcaagaattaaaaacagttactatacatatatgaaaattaactcttaaaaatgtgacttggttattcagttagcttggatagatgaagcagaaagttaaatggtgattatgaaaactgaacttttgtatatgtggtttaactacattgtgagttacgtgagtgtgttatttctccttttgtctcactactttaatgggagattattgttgcccaactctgggtctagtatgtaaccaactcttttcagccagattcctcacctccaaaagagtgtcttgcatctttgggtctgggcccaggttcaactccaagaactgtacatctcagggaccaaaggttatgcttggcagggaagcctaatgccccatcagggcactcactaatctatctgagtagactattagtgtttttctatttttaaaatgtgttttatatatgcacaggtactctggtatcagctgttgtgttttccaaagagttgagtgcattattatatcaactcatccatgctcataatatacgtatatgtgcccaggggaattttggggagctaagggtaggactggtgcaaaactatgcagttacaaattataggcttctgaagaggtaatctgactcagtaaaccagcctcaaatcaaaaaagataagtactatggtaagacataagagctaatctgcaaaacacagcttgcacagccctgaattcattattaagatttccataaagacatagaaaggatgctataaatgactgtcacctcacagacactgcagaaagaccacttactttcaaatttgacattctccttctccatgagtgttcttgggaattcccggaagagagacaagcatgtgaaaaggccctagggcaggaaggagcttactatgcttgaggaactggaggaaggccatcacaactagagcaagaaagagagggcctcaattggaagataggtgggatacaaattaagcggagacatgaaggtcatatcaggagttggcctgaaaaatcagtgtacagccattgaagagcttcatgcagacatgtgacaaaattggatgtacatttaaagctattgtgtggagagttgatatgggggctggggggcaagataggaaatggggcccattaggagttattgcagtggtacatgtgagagatagcagagacttaggctggtgacattgtagtggagatagaagtcttgattcaagtcctgttttggagatataatcagcaagatttagttagagatctgtacctacataatagaaaaagtggttgggcctcttcaccctgaggtactagctcaaataacaggtcaaaccagaaaatcatgaagtggtgcttatagtttcattcccccatttaattatttaatcacttattcactcagaaaacatttattaagctcttcctgtgagccaggcattgtgtaaggtgctgaagagacaatgtcccattatcggtcatgtgctctgcctgacagacccttacaccagtggttggcttgatttactttatatcttagaacatggtgctaaggagacccacatttttcattgtatccccatagactttgttcatttagacacatggttcccttcaggggtctttggggagcccctggggtaactagaaatggatggacttggcacactggttggcacgctgacaaggtagttctgccgcacctagaacagggcctggtgctgacagtcttgccttatacaggacatctgcacactcgtaatatagaatcatccagccaagacacccagtaacactcctactaatgagccctgatcagcttcacactgaccagtgactactctcctgccctcaccagtactcaaactgtctgactttaatcaatgattaaagggcacataagtgggaattctttatgtctgtattcttcccagtctttctgcatgatcctttggggtattccgagccccttgtcttacccttctctgctccccaaattgtgtccaaggggcaagctagtagggcagcacagacaagaaaaagctagtccttttcctttcttttgtgtgtgttcttgggaaatgaccttaatctccattactttcatttccttgtctataaaacagaaatagcactagtatctacttcatagggttgctgtgttgcaatctctagagcacttagaacagcacttagtcttggcacattttcttagtcttttgggctgcttaacagaataccatagcttgggtggcttgaacaacagacatttctcacagtcctgaaggctggaagtctgatatcagcgtatcagcgtgccagcgtagtctggttctggcaagggctctttcctggattgcaggctactgactttttcttatatctctacacggagaaaagagaggagagagctctctggagtccctttggtaacgaccccaaatgagggctccaccctcatgacctcattacctcccacaggccccacctcctaatatcagcactttgggagttaggattttaacctattaattggggagggggcacagatatccaggtagttgcacacacaataagcacccaatgaatatttattgttattgttattgttcaacaagtggaagacagtgtgttggatgaccatgcaggtgacgcggatgaatctgtcaccattacaacttctgccttcatcactaaatgaagagataccaattgcttaaatgcaaggcagcaggagatatgtttttttacaaataaaaatctgattgtggtgattcttcgcttaactgcttaatgaacctctgttaccactgctcaaacgcttggatttcaggtctggcaatctcatctcactaggtttgttcttcagctttaagttaatttcccaggggaaattactcctttttccagagttagtcccagtcctaccttagcaagattgcctcctacttgtgcattaactgggtgccgctcttggttcctgtttcccatcagctccaacctgaagttcctggctttcccccaccacctcgagcactgcttttaatctccaagtcagtgctattccttgggttaatgtggcaccattttattttttaaatcccagtctttgactctacttgctgctcagcctcatggtcaaagatctattactgatgaaattttacaaatgttgtattctggatgaaattaattttgaccatttctgatgggaattgcaaattgtacactagaaacagaagaacaatttattatacagggtaataatacagtgtgaatcaacatcactataaataacaacaataacaaatatttatctttctgatacatatctcatttttttcatgttctagagttatctttttttttccttgtgagccctaatgttctggagatttcataaatggtaattaatgcttcaaatttataattgatatccttcatatcatagtagaactctgacatcaatttattcacaaaatctctaattagttaattaacaatttattcatgagactgatttaatttgggcattatatgaaatttcacaaagcacagtaaaaattttcaaaaatatctaataactatggcttaattttgtgttctattaaaaaataatgtgagtataaaaatatgttaaagttagaaaattcagtagcttctcttcaagacattgaattctattataactgatattttttccttttcagacatttatcatacatatagaagaaatgataaaatggtttcatttgtgtaaagatatttttaaataatgggacgaatgaatactaggagagagaatgttgtcagacacagttaactacataatctaaaactcaacatgaaactctacacccctcaaatttgtctaaagctattatgatttattgaaaactaccagaatgctagtccccctgactttttaaatattctcctttaaatacgaaccccttaggaaataaaatctattgccatgtatagctaaactttggtatttgtatgattttttttaagctcatgtaaagttcagatttacagtaaatgaaatggatagcatgattctctaactgggttaattcatttaatcattacttcaagagtcattaattaagcaaatatgtattaatgctaggttagatgctaacataacaaagatcagtaagttgagagcccagtgatccaggatctggtatttttcataggccaaataacatgtttaaggagcctataaatagcagcaattttattaatgtcagtagactttaatcaatgtttattaaacattttaacaatccaaaattgtctgtaatgtatgtaggttttctaggtacttatagtcaaaaacaaggataactacgagtatatattatatctataatacatcagtcacattcaaaggaagaaatctcacaaaattgttatcgtcactatacaggcaacagtagacttgttgaaagtgttttttgtctaactattttgcattgtaatttatgtaaggtacattgtgtgattgccttattatagattctaatcggaataaatagctatgctattaaatggaattacgtacatgtaaccatggtttttagaacatgcctatatgaagatttatatgataatcttaggtaaacattttatatgtgaaaataatagaattggaaataatgacggacgttaaaggactttgaggtatccagaatgcaattaagagaggcagaagttgcataaatgttcagacatgtttataatttttagcatcccatcttttccttttggaaaggagaataagggagagaatactaactggtgatctctaaaacatgctatcctttgatgatgtttcagaacttaataaagcaaaaaagcaaacaagtgaacaaaaagaaaaactaatttagcatccttttatctcactctatagtattcatacatgaagctctatacctttacttgatgcttttccaaatgactcatgccttctaaactggaaagactggcagtgtcattattggaaaatctgcactgtggagtggttgagggcatgagctgtggagtggatggcctgcctgtgtcactaaacgctgtgtgatcttgggcaagttacttaacttctctgggcctccattttctcatcaataaactgggaggggaattgctcggcgggcaattgtgaggatttataagttaatataaagcttagtacactgtgtggtttattgtaagaactcagcaaatgttagctcttacaaggttaaaccccaaagatgaaatgtccttttaaaatcaagccagatcatagcagaggaagaaatggttgataaatgagaaaatgatctacctcgctaataaccaagaaattcatattaacttttccacaattgaataggtgttctgtatttattaataataactattattagtaatgatttgggtctgtgagcaccttcacaattttcagggtgcaaccattttggaaggtgatttgccctgtctgctctacaaaattttaaatgtgggtactctttcacccagtaattttacttgtaagaatttctctttcagagataccctctaatatgcacatacacgtgtgtgcacgcatgtatgtacgcatatgcatatctctattaattgctatgttacgttaaattaggggaaaatgcttctgatatgacatggtgcccataatttcatgtaaaatgacaaatacaattaacttaattatttacatatagcacgtgatcccacttttgtgggaaaagcatctatttttatgtgtgtgttttcaaggggaaaaatacatgtttaaggatgcacacatgcaaaaatagcaaaaggatacatggaaactcatactcaatagctatgatgtgtatcatctccttttgttcagaaagtgtttctaaactgtgccaaaattttgtcagatatcattaatatttgaaaaattgaaatgaaaaccattttctgcgaaagatattgcctactatatttatggcatacagaaaattgtgacctcatgtgtctaatgatagacaaataaaaaagataaaaatgtttagtgtagtatagatttgacttacgaacactgtctcatgttttaaaaagttttgattttttttaaatcatctaagaaaaacagctatatgaacacatttgcaaatctattgatgcttatttttttttgcttctttttaaaagtgattatgttttttatcttcccagagttactggaggtgaactgtttgaagacatagtggcaagagaatactacagtgaagctgatgccaggtaagtgacttgccctgggcaagatacaagactcaacattcaaataatactttttcagcatatttctttacaaatgcatgtttgtacaaacaaatgttttaaggatctccgggatgattcttagagaaaaaaaactccatgaatctggtctatatttttatctagcatctgtagttagattacatattttatcaaaaacaacaaggaaaaacaaaccaaaacaccccacctaattggaatgacttctgctaaagcaatatattttttagtgaaagtcagagatcaaagattgaaatcctctaatccctagatagattctaggttgcccagtggtagccagtagtcacatgtggctattgcaatttcaattaattaaaattaaattaaattaaaaatttatttctcagttggtctaaccatgtagttggtctagccaactgcctagtagccacaagtgtctagtagctaccaattggccagaccagatatagaacattttcatcatcacagaaagttctactgaacaatgaatatctaatcagaaaacagaaacagcctgaaaaaagtctcagtggtctctttaaggaactattattagctaattaactctttggaaatttcattaaaacccttgaacccctgagttgaaatatatttattcaggcatttaagagagttcaagagtaatttttcaatcttgttaattggcaaaatctttacaaaagtttaaaaaaggctaagttttttgtctaatttgcaacttcctaggctatccaaggcaacacttttggagtggagtaacattaaccacttgcttagatgttactggattgcatggtgtaaattttcctgtgtacttttatatattctgtagctgtcatttatttttaaaaatctgatcaagagtgattggctcattattagcaatgtaaatgagatgtttgggagcagagattgactctgctcccattctccaatgccatcagagcttcccaaggcttgctaatcccattgtagcctgaccctcaacagatgtccagctgatattaaggttcccagcccctccttgccctcagaggcacacttctaagtttctaatttttcttcttggtttaatgcactgtttatggcactttgtgaatctatctgtacatgactacgctctaattttttaatggaatttttatggccaaagtcaaatagaaaattctgtgtaatttatactatgatgagtgaatcatcacttgctcagtttaccccaaatccccacattagggtcctgaaaggggccatggggaacctctggaagtagctatttggccacttgccaagaaacagtaatacttttaatcaaggtactaaactagggaatttcattaatgttacccttcaaagttatgttaagcaggctgttacttggtttgaaaaatactggttgaaattaaaatagagactatttttactgctaaagagctctaagatattttttatgaaagctctccgataaaatcaaagagaaggaacattcccttctaaatacataaagaggctatttctcagtcagatgtggtggcccactcctataatcccagaactttgggaggccaaggtgggaggattgcttgagcccaggagttcgagaccagcctgggcaacatggtgaaaccctgtctctgctgaaaatacaaaacttagccaggtgtggcagcatgcacctgtagtcccagataatcaggaggctgaggcaggagaatcacttgaacctgggaggtggaggctgcagagatcatgccactgcactccagcctgggcgacagagtgagaccctgtctcaaaagaggctatttgattgtcaaaaaattgtaaaaattttttactagttctcaaaaatttaagaattgaatccattctcactagtaaaaaaaatggtgaagtccatttagtatgtgttattgtttacttctttatcttctgttattcccaagattcaataatttatgcttgttgtttgagaacaggaagagaaatattcttaaagagtagtgcaaagtgaacattattgtaaaagaaaaaagattcctatggtttaaaaataatgaccaatactcaaataaacaatgtagtcaacagcaatgaatgtgagacgcttttagtggtattgttaataaaagagctagaaaatcatagtcatgatcaatttttaaaatatttacattgtaataaatcagatggtgattacttttttaaattcaagatttttctttagaataatattattttatacattaagtggttgaaaatgtccttattaaaatgtttgcttcatctttcaatgaataaatgtagttcaggatgtacttgcatttgaattgcacagtgaacttatacaaaattcatcagtgtgatgtgttctgcattattatatgtcagatgacagttcacaggaccttataggtgccaaacaaggatttctcctctctaattagcagtcccatttgatatcagtgaacccttaataagaatagcataaaatgtgcattttgatatagtatgaagcaaaagtttttcttcactgaagtgtatggaagtgggtttaataattaccaatgctccaggggattgtaaatttgtatttatttattctttgaaagctccctagctcttccccaaagtattcttacactaaagaggggtttattttattcatgagtttactttaaattctccctttattgttggagacttgcatttgttttcctgttatatactttacaaaaagcaacgcttctaaggcgaaatggtaaatgtgtccctccattttttttgacccttgtttcacctgccacttcatctgtgtttaccctcttgtttcaacacctgtttaattgtgacctcagattttaaacagtttagatgtgtataagaaatacctggaaattttatatctctgaagaattttcccagaacattatgggaattctttataaatttttctttctaaatatggagattttaccttcttatacatattatttaatttgtacacttacaatgaaaacaacacaactcaaattgttttgtctgaacatgtcacaaagtctatgttggatgtcatttttgttagaaccaaaattagctttattcagctttatttgattccaacgtaaagctaaaaaaagtgaagaaatataatttttgtttgtttgtttgtttcattgggactttcattttatttcatattcaatgtgattatgtgcctttaaaatgttctcccttccattctgcccttgtatctttgcagtcattgtatacagcagattctagaaagtgttaatcattgtcacctaaatggcatagttcacagggacctgaaggtcagtatatggagtccataaatctgaatcaaagcagttttatttttttttctggggaaagggcagagggtgggtatttaaaatggttcccttgcctttcccaacttgtttctaaaatgagtaaatgatgaaatgataatgcatgatgcctcttccagtttgctcatctacaggctaaatatacatcatagcaaaaagggaagaatactaaagaatacaacctgctaagtttccaagcagtaaactacctaccaaaagggattgaggagcaggctttcttgaattgcccagcatttgcctggagataaacttggcctgtgatgtatgtccgcctgtagattttaaacaccacttctgttctgagaccatgggttgctgtagcagaacaactggttacgcattgctccatttgagtctgatgaacccttaggcaagagatattaattgccagctaaattaaagcacaagaagttaatgatttatcaaaaattcattaggtatcttaatttaaccttagtggtgccctgactgttaatgtgacagcttttagaacaatactggaaaaatgggagagaaaagggaaacaatttatgtgacggggtggaggcggaacaccacagctataaagattatatttgtgttccactttatttcctggaagaatttataaccaggaaatgatctcttgaatgacataaagtgttttcaaaatggatttttctagaacaaatggacccacattctggctcacatctggtaagatctgattgttctgaggtagtagtcactctacttgagcaatatgtttacatgactgaaggtggtacaatacaaccccagttgtctgctagctctgcactttaacccagtctctctgagggtatacagacagtgagtgtaagcttggaactaacacacgccccctggtgtttgcatgcagtcattgcattcagcagatcctggaggctgtgctacactgccatcagatgggcgtggtccatcgggacctgaaggtgagtaatgcggttgaagaagataaaccaccacacagttcctaatgactgttcagctgcaattatgcctgtaaaggcaaaaatatgagcaataaagttgtgtggacttattccagcacgttactcaggaactttccctcaccacagtctctcttatttcatctctaacacacacttgagacatataaatcttgatttatccagatagaaataacttcccaacattaacaataaataggatgctatatttctttccttgtaaggatggatatagcattaatgtgactttcagtagggtttgatgatcttcactctaaatttgttctgtgtacattgatcaaacattttatattcatgtgatatatacccaatattatgtaaatacttagtaaaattataaagtgtgtagagataaagttattaggtgaagttttagcctaaacgattatgtgctaaagaacctcattttgaattctgacattctctttcccttaacattagtcctaggaattctgaggacactgaggcctcttagttttttatttatttatattcctaaagaccaagataatagtgtcttctaaaactacagatgtaaagaaagcaaaacaaatttaatcatcaaataatatttatgtagcaaatatatatggatatccctatatacatattctcatttgaatgcctactgatacccttaagacttcactcagcttctgatacccttgaggacagagaatttttagatcatttagaaatgaaatagctcacaaggggagtactttttcattaattttccgtctccatttcccagcactctagttttacctgtggaatttcagaaaaatagtgaagcctagaaatcgaaaagaaaaactactggatgagtaaaatagtaaatgtgagcactgtatatagttttgattctttcaaactcagcattttctaggcattaggacaaaggtgacaaaggataatttagaatgtctaaaactatgtgtgtttagtgagaggacctagacttatttctcacgtgcagacttttctggttataaaaaaaattataaatccatatttccagtcacttaatgttctagaagactatatctctaaaccaattacatgaagatgtgatttataagcaaaacattgccttagttttctgcaatcttttgatttcatttaattctgagagttttaaatatcaaaagcaaaggtatggttaagggcattttcttctgaagagccaagatcggactgtatatctgctaacacttaccaaatgtacccattagtataaagcaaaagcagtgtgtttctttgaaaattcatgtattttacagtcacctcaaaaattctttactggccatttacagacagagccccttttgttacctctcagaacccacagcactactttccttttaagtgaacatatatgaacatgcacatcatttgtgcaattttttttcagacacttctataaatttattatttgaaacattttactccatgttatataaccataagtggactttaaaagccaagtattaaaaaatgtgaatcctcttccataactttaaagatattttttgtggaatcgtaatacaggacttctctaaacatctggaatcaggtgagcacttcaaagactggaactttaataggacatgggctgtgaagaaaaatatattctctgacgtatgagctaacgtcactaattaaaaacttaagcagatgatttttagggaggcttactagcaaaagaaataacttgctgcattccccaccagatttctttaaggcagggaaagtacttttgctctccattcttattctgattctgggaaaggacagaaatgagcttttgagagagcttgttataatttttttagttgttgtcttagtttgtgtcaaattgctgacttggatggatttcagttgagtctggttctcagtgcttgcttcagtaggccatttcataaacacactgagagagttcaaaacacgtgcattagaggcagttgatgaacctcttgaacgtgccaaatccctgcctttgttttgtgccttttatacccatgatgtatactctgataaatatattgcttgtgatagcatgtttaccaatatagtaaagttaaaaagatcaagtgctgaaattttttattaccaggccttaaacaaaaacttgcctttactattcctatgctatttatttttgtgtccatatactaattaatatgttaattgatgtgcgatagaaatgtttgatgcacatagtttaatttgtccacatcagtgagaaaaagaaacacaggaaatgtcatgtttatcatgatcaacagcacctataaggatataagtgctgtacaatttgtatataagccctctggaaccatagctgtttaacgtaatgcgatactccacagtacctaacgtaggggcttatacctggccaatacctgcagcatattccttcaatttagaaatgaatgaaggtcaaccaaaagtacatctataatataaaaggcagcattcagtaaaatagcttattaagtgttcattaatatttgaataacataaagaagataagtatatcttcagaataaagatcactatttagttgaataactgctgctcactggggctcattagacagtgggaaattatgaggacctataatcaagactgaggtacaacaggcaatttcaggatgtccctgaaacaagcaataggagaagagtcagggtggtgggatatcagcatcaagaaggtacatccatcggcaccaggcagaacctagtggatacatggaccacagccttttgtctgaggtgtgtccagtggcaggccaattaatgtagatctagataatattaggaggatctagtggtggtgataaacagtacagtacagttcagggataggactgcagtctttgggagcgtttggatcaagtcagggtcttaataagcaaaatggtaaaagatgccatttatcaagcagttaccatgtaccctgtgctgtcttatcatacaaatcttcagaacaactttatgaggaaggtgctctgatcatcctcatagtatgtaaacgaaaatttagcaaccacaaatgaaagaacttaagatcactcaactagtaaaatatgattggtgcctaagaaatttgattccaagtctgcatgcttaataactactacttctcaatttagttggttggatgaattaaaagcctgtaaagagaccaaagaatgagtcaaaacgataggaaaataattttgctagcaacatccacaataatttgtggaaatggttctaagtttagtgaatcaaaaggttaaaatagtcctgcctatgggtcttccagagataaacaaaatctgtgtcattgggaataaagaaaataagatataatgtagagtagggggcagtacaatctggtagtagacaggtgtatgaagtaaaactttttcatttagaaaatcagtaaggtagcattgaccacagcctttggaaaacgagacaaagaagaataaaatgcatttgccacatttaattagtaattgccacatgaagacaattagtattgggtgcttaaggcgggtggatcatgaggtcaggagatcgagaccatcccggctaacatggtgaaaccccgtcactactaaaaatacaaaaaattagcggggcgtggtggcgggcgcctatagtcccagctactcgggaggctgaggcaggagaatggcatgaacccaggaggcggagcttgcagtgagcagagatcgccccactgcattccagcctgggcaacagagcgagactctgtctcaaaaataaataaataaataaataaataaataaataaataaacttgatagatagatagattctttatgaagagctgagtgctgtaactcagtgttggatatttgtgaattggtggtttaaagttcaaatacaaaaagagaagaatgaatattcatcaaacattccttcaggaaccacgaaggcatcattttaaatgtgagcatacattactgagcaaaacaagaacagaccttgtgtgcatgaaaccctgctggccattgaattaaggatcatgtaaaaatatgtatgtaggcccggtgcagtggcttatgcctgtaatccaatcactttgggagactgaggcaagaggattgcttgaggccaggagttcaataccagcctgcgcaacatagcaagaccccccatccctacaaaaaaaaaaaaaaatcaatatatatacatatgtgaaaagcatattgatgatgttcttcccagaaaggaggaagtacctcagacaagtactgcattcagaaaaatattaggtcaaagtgaggttgcagtaacaaatgacaatttttaatgtcacaagaaataaaggaatgtcagatcagatatattttctcatttaagaacctggagaatacaatttctatgacttagttgacagaataagtaaaggagatagttataaagctatgctttttcaaataactgtgtttgaaacaaggtagtaagatttctgcagttcaaatgtacccgaaatggttactaaactatttcatgaacaacaatctggataggaggctttatacacacaactgaatcttttagcaacaaattaacaccctgtgaattgcctcggcagagaatgctgcctttactattagcccctattcagaagaacattacttaatggaaatgtcattggacggatggatagatgaatatgagagagagagaaagagagagattttaatgaagagaatttggagatgtgatgggaactttaaggctgtttcataggaataaattaaatttatgaccaaagtagaaaggaattagttttcagggaaggggggagatgagaagtacttagtaaattttttttttttttttgagacggaatctcgctctgttgcccaggctggagggcagtggcgcgatctcagctcactgcaagctccgcctccctggttcatgccattctcctgcctcagcctcccgagtagctgggactacaggcgcccgccaccatgcccgattaattttttgtatttttagtagaaacagggtttcactgtgttagccaggatggtgttgatctcctgacctcgtgatccgcccgtctcggcctcccaaagtgctgggattacacgcacgagccacagcgcccggccagtaaattcttgttaaccatgggtagtagatatatcaacctgtgaaatttatattttggataattataaaatcacaagtattatacttttctcagagctatgtttagataaaagtttaaggaacacatcatctgtgtatgtatatttagatatttttgaaacaaagtatgtatttgataaatttaataattcatttagccattccagtatttctttgttgagtgcctagtgtttgtcaggcagtggagaagctgtgggtaattggcactctcccactgcagttagttacactctggttctttcagtctacccagcagtgtgtgctgataatgtggaagtaaatgaataaacaggaatggaatacagaaggattcttatgaacttgctcatatatgcatagcaatagaaagagtacttcctaattgcaaacttatagcacatacatctgctagaaactccttgtgctaagtacatgaattcaggcattaattccacacaaaaataaaagctaaaatcccttgtaccatgtatacaaatgagacaagtgagcttgacattcaagcttttcaattcatgcaaaactaaaaaaaaaagaaatagtttatattggggagcttcatttgcaccttctttggcaaaagataagtgacagaaaacatgccaagcagaggatggttttctgttaaaagagtgagattctccaatagaggaaagaaattttaaaagacaaatttttagtccttaaaaaataatatccaaaggaatttaagaattaaataatatgggataataaaattagtaatttgctctttttataatattcaaaaatttaaaaacaagtaaaacacacatgattttacatatatattcctaatggttgagtcttttagatggcacatcttctagatgtgcacaaataaaagcctgatatggttaatgctaaaggctattgcctttgccaaatcaatttattaataaagattatgataattggtaaagcaaggttaaaactatgtttttttcataagttttggatatgggtagtaaatatttttgagtacttcaaattcttctaaaaacatctgctgaatggactaccttttaaaaataactttttatacaattggtggagcttctttagtatcacgtctttaaaaggaaggaattagaaaatctagcttcaggtctcagcttcatctttttgggcctccctacctcatgtagaaacggaaaggtttgagttattttatctcccaagtctcttccagttctgaaagtgattccatcaacctgcctatgtactttgagtcatttgaacagtttcaagaaaactttgaatcatattgaaagaaattgccattgtattcatatgaaagtacagaacaaaacttggaaacagttgctgctcattacagctgatatgctataaatggttgttgacactgagaccagatgtcatggaaaatcctgcatcattaggaagcagtgggggtggggaaggaacctatgtgtaagaatgtctgtgcactctatttaaaaaccaacctagaaagggattgcattataagaatctaaagatcctctcaatatataaagagtaacataatagattgcattaagttggcatcattaaaaaagacattcctcaagttacaaatattaaatgttctgcacattgaaatgaccagctgcactggaatgtagtagctaatcactaatgtgtatgttgtcaccacagaggacagagctcctatgataaaatccagtgtgattttattgtttcatagaaactgttgtgagatataatttagtacccttataatgttcatttgagagattaaggaactaattaattagctccaggcatttgtgagttgcccaagtccatataggtaataacagttagggccaggacatgaacccaggtcttcgcattctttctagatcatcaccctgcctgtttctcttacaatgctgtggtccatagtcagctagctacattagaagacctgggtttctgatctcacctgtctgattcgtgttagaaaatagaaaatcaaaatagtggaatagtagcaaataattgtgtagtggtgctcctgtctaaggaggtaatcattaattaggtgagaaatactaccctttcagcttgggtaaactatatttgcaaattatcttcctttctgtaggcattcagaatttaaccttgtcaacaaaattttgtagtacaatatatttttaacttggaagctatatgagtggtagtaattcaggaaaattagaataaatgtgcttgccctgattaaaatgttgctttagaaagtcttagtgattaagcctcccacacaatcacagaacatgataggaggattattcaaactaatatataccaaacagttatatagaaatcaaacttgtgtgattatttttaatgtttcattggagctgccctttaaagcaatcttgtgatgaaatattaaaaagtgaataatcccttaaactcatcatcctaaattttttagttttcattatataatttcattttagagcctaaattttagtaatcatcctaatttttacattttcgttatataattctgtattttaggtttgcctaaagatatacataaacatgaaatcatgttagtctcttaattgttacatctacacagtcaccttcaaataaccctgccttttcttctacataactgcagctgaacagtcttcatgagtataaggtgcaactctggtccagatggatttactattttctggatgactcacaaaggccctacagtgaggtcttcgttagttatgagtatttgccccagtcattcagaggatatgcatgataaaactctaagatgttccatttcttctgaatcggcagatacttggtgcttgaggcacaatgcacacaagccctgcccaacagctttttcatttagtgataagagtgaaaacacactcaattttttaaaaggttatttaccagttacgctgacagttgctcaacaaacttatcacctgacttcaaacacctaaaatgtgatttctaaagtgattggaactctttttttgaatgagtctgtggttaacaaattaggacagatgtgtattaacagaaatctctgacatgccagtgcttttgaaagtgaagaaagaattagaatcaaccattgcttacagtttgatgagctttttccaagttaattattccatgagttaatagttggaacttaacttcttgatcagattaggaaatgcatgaatgtggtagaccataaattttcattgcaaaaataaaatgtcaaattaaaataatttaacatgtgtagatactatagtatattgataaagttccaaataatttcaagtgttaggttttactaaaagtcatttcagcataaaagtcttttatattcttgagatatctttatcccatactccaaattaaattacgtatttagtgttgaggtggttaaaaatccctatcagccccacaaaattagaaaagttttctcacatttaccggtcgtcataatagcgatgaatctgatggcagtgagcaacaatagcctgaagaagtctggtacttgattaaaacttactcgccaacactctaatttcttgtagatttaacctaatttcttccaagttctggttatgggtctttgctaatttgcatggctggcttaattaataaattagatactggtttaggctgtgtttacacaaggtcaaaactaccaacagaattgacaaattcagtgggaaaaatttagccaatttgatttttaaagcatgacattacttgtttattaacatataaacaaaatgaatttgattgactgaatttttagattttcagacaatcgttttggcatttgtagagtccattgtttcccaacttttttcagtctgagacacacctctaaatttgctgggttttgtccccaaaccactctcccatatacattctaacccaatatatttatcgagtttggggttgtatatccttaactgtatatattaatcagtctccttttcctgaccatcttcatttcttaaaatccacaaaggcgattcatggaaattgaagactgttccctggtgcttattttcaaagtactgatgtgtcttgatgcattggttgggaaacagtggtatagacacagccttattccaagactgagttatcagcccttgcataatgataagtacccaagaaaataaaaatatatctttctcatagtactctgagatggaaaaataaatatataagtaatgctctgaatcacgctttgaagaaatgtaaattatgttttaaaagctggcttataaagaaaaaaaaaagctgactataacatttggcaaatagtagtatactctttctgcctttaagaataaacagattcttaaagacagcaattttaatacataattcagagtaagtctccaaaatttgtaccaaaattgtttggaaacattgaggaatcaaaatcactacatttgggtccaaactcttgaagttaactaggatttaatttgcacagtttcatttgccaaatgtctgtagattggtccaactcttgttattattttgccaagtttccttctgctgaaaatgtctgctctgttaggcttctaagtcaatgtccgtggccaagtctgaatcctgagcagtccttggaaacatgtgagcaggtcaagacaggtgctctcattcatttgatccctccccaagtgtattctctcttctacccagtatctctctaggacagttatgcatctgtctgaagcctgcacacatgataatatttaatcattttctaactgtattttccctgggatttaggaatggcagtctccaggaaagatgacagtgcatgaattttttccccctaatcctgtaaaatgttgttagttttgaatagtcgcttaaaataggttctcacttcagtctctttttttttctttctaaataaagcctgagaatttgcttttagctagcaaatccaagggagcagctgtgaaattggcagactttggcttagccatagaagttcaaggggaccagcaggcgtggtttggtgagtagggccccctccttcatgctacctatagtcttctggcttctgaattctggctcctaatcccacttcctagtgaaaataaaatggaaaacttcatcctaataacaatttgactaatttttagatattgtgcctttataagcatttaattttgttgacataaaaggttatataatctagaaataattcaagggaaaatattaatgggagaacaagaagacatacacttttttcttcaaaggatgattgagaaagtacattatttagtaagcattaattagaggattacaacattcaaagagtactttttttatttgaaagaaagttgattgtttgcatacaacctcatatgatgccaaaaactgctgtgtaaatagtagatgctcaagaaacacaggatatttcacatataatactttatgatttatgatttaaagattgtttaaaaattatgaagcatctatttatgtgtatatttcaccttagttattttgtatgtcttcaacatgccagtttcctctcaaaaattctgataatttagaaatttttatatgatgaaatttctgcttctttacaattaaggaagaaattaactctaaataaatttaaattatagtatttctaaccagacttatgttttgtttcaatattcagtctgaataaattatttactcattaattttcatatgcctctctctgccattttccaatatccaacccacttcccatgtatagttccaaaaatataacctctccccaagcctgtcttgtcttctgactttcggtgtgttgaggttagataattgttttaatgcccttcatttctgatttattttcctctgagcaacaacaacaaatagaggactaaaaacatgctatttctttgttttatatgcaaatacttttctgagtccctaatgtacacatctcccaagatgtacatatggctcccaggattcaccacatctcccttttctgccccagctgttactgggagtggagggtgtgccaagcctccctggcagcctaatgcaggacctcagttcctgctgcctgtcctttttcagtagtacctgacagttattcttggttgaagtctctctcatgtttaatattatcttttacattatctttttaccctccaatcctagatgaatttaatacctccaaacttgtcattctgtttataatattttaactttttaataagcttgtacccattaactgcaaactgaacgaaggtagggcctagattaggtctgtaaattagagattcagatgatctctgtatcctggaaaagagtacaattaacacagaaagaatatattgtaacaggagttaagggttgaacaggaagtagtggggctatcacagagatgggcaaagcaaatactagagatacataaattaagtaggaagtcctgaccctggaggagctaaggcttttgtatctataactatttaccattcagggtggaagtatcttaacataggaatgtatgaggtgctgtgggaacacaagacaggaagtacaaaaacctgcctctggagagaggttcaataattgccttaacacttatggttgcctaaaggatgaatgggactttgctcactgtcatgcaagaagattaaggcattccagacagagggatctgcacatggaaaggctcagaggcatgaaactattttttctattacagtaaaacaagaagtttgataaagctaaagtatactcgagtgagtagtagttaatgaggcaggaaatgattttatgtttttttgaaggatttggatttcaccttagagattttgggatctggtgaaacatttttagaagagagggacataactgggtgtatgttgtttaataatgattccagtagaagtatagaagatgatttaagcatagttaatctgcaagcaaggacccagttagactaaaacaatcgttcaaattatgcatgatgatagcgttgactagggagggtgtaggagcaagcaagttccaaataacatacagatcagacaggaaatatgaactctaagggaatctgtttaggaaacatgaaagtcccagacattgggttcaaagacaggactcgagtcctgtgtagagcaaagcaggaccccacttcatgagagacttggggtatgaggcaggatacaaaaatgggaacttaggcccagggatataattgccagaaattggtaaagatgatgataggatatcaggaataagacaagcctttgttatcaggtctgaggctcaaattagcatcagcagctatgtttgatgattacaagaatgttggaatcaagctccttaaatctcgtctgtttttgagcttaatgttttatctcctctgctatgacacatatagtttgagagcagggctatgtgtagtggaaaaaattttactttatgaatcagaatatatgaatttatatcttggctctgattcttaacagctgtatgatattgagcaagtcactttaaatctgtgaggtcactatcctctttgtaaatgggataataaacacttcttcacaggactgttataagattgagtgaaatagtccatagaaacttgattgagctataaaggatgttcaataagttttcaaaattgtcttggtgtgaaacaatgacataattctttgcatattcagtgagagttgtttagtgaatcagtgagtagaggactgaatatcaggtcagtaaaagcaatagcatccaaataaaagtacatagattttcaaattgttactgatttctaaaaacaagctggtcccaaagaagcagtgacagctcagcaataaaatttccacttcatcagcatggtgctatcagcaattaagttattgttaaggtacctgttagagtaataacttttaaaagaagcaacatcttaagttctaaggcaattcagtatttcagaagtacagaaaaacagagtgtctaaacttgggagaatatacttcttttttctctttctttttcttttctcaagttcaagcgaatcttcatggtaatctgagaaaaaaggagatgtggtgttctacgtttctttcagatgagctgccagatatattttaagtattaggagtaaaggcatgttttaataatgaatgacctgttttgatgtttattcattatgatctgccattatagtcccatatatttttactgattaattttatctttcaaaatgtaatatcagtgtttatggaggaaaagctttgttattttaattttgataaagagcaggactctttcttcattatgtggaataccagagcttcaggcttttacataattttattttaataaatatacgaggtccattacaaataagaaaaaacatagtatgtatacgaaacaacataatagataatacaaagcattatggaagctgtttattgttttttttttaattatcatttttcaagtcccaacttgtttgttttttcccatatttacttttcattttctagtctggtctgttggaatactagccaaaactggtagaagtaaacaccctgtcactatacttgataagatggctagaaaatttaccaaaaagaaatattcaaatatattctgtttctcttatggaactggacatgttatttgcaatacatttctagcattttgttgctgctagaaaaaaaaaagataactaccaagatcttggttcatggaagaattattttgctttgttgctgttatgtctcttttttatgatattaaggttctttttatgccaatgtgttacaatggatacatttccaacagtcagtaattctcttttctctttgtgttatctattttgattttcttattggtttttcaaagtaagaaacatatgctatccctaaaaaaggcaagctctcattactttttctattgatggcatgtagtatgataatcctagattcttgcaagtttaatttcccacagagaaggtcttctctattttaccccccatatgtctgtatttatgaggtcacattgtaccgtacattctttcctaacgtccatgcatttagatatatgcttcaatattcttggggtaaggaccccattgactgctcaaatgatggttgtaactaaataagaatgagcatgctggtattctcttagaattttagtctccagaagaggtttgtaataatttatattttaaatgatcttttcatttcttcctcacatagtaacttacttccctatcttagggaagcttaggagaggtattgttaacatttcgtacttctggccatgtattctaagttattgaaatcatacattattaaagtttactgatttagacagaagagtacagattgtatataaaagagtcattgaaattcagggtgagaagggaccaccgagaactgtaggtaactaaggagagctctaagatggaaataacttagagccactctctgttagaaaagaggtagagaaaaaatattgaggattcaaggaacagaaaaagtagtatcaagggtgacactgagaaggccatttttaaaagaccttaaagagattagtcaggtcaagggctcagaaggagaatgaaatcatgttgaatgaatgaagtgtagccggatgataaaggatctgaaagtgcacactaagaacattggatgtaatctggacattagcatcgatttctcactggagtctcattgcctgtcaactctagagaagttggagaaggatggtgagagtggaggggacagaagtgctggcaaactctttaaaacaattgtgtccatctctaccttggaattcacagagtgcatatcactccttgaggaaatcttcaagctttaggcagtggaaccaccattattgctcagtaattctctgtacctcacaactaccaaccaaatatttatttcaagtcgagtttgaggtacagatggattacccagggtccatttgaagcttaaattgcaacatacaggtcttttcttggaatcccttctcattgtctatccaatcttcccccaaaacaaacagaaaaagaagaatggtaatagaaaagaaaaaagattaagtgcaaagtttttttcctcattttcttttttgttcagagaagtaactgtgttgtatatattgtcttttaatacctctttgcatgttgtttgtacttaataagtataaatttgtcacagaaatggggaaaaagtttctttcttggacactttgcatttcaataagtatacagtgtgtttcatcagtgatctgtggttggagaaattccattatatatacttttaaaaagttttttttagtttatttgtgcttttaaagaaaacttccaaatgaggatagttatttttagtatgtttcaagtaaacatttttatttaaaaaactgttattttcagaaataaatattttactctagattctagctataaattgtttctaagtgtaacttattgaattctataccaatatgtataatatgaagttttctttccccatctagtttttcttaccacatcccttcttaagtcgaatgtctagttgatacttgttcagtagtgattcatctgaatattcctgcatcttctctttagttgccagttacaagtacatactgattatttaacagtacacagtgagctctgtgatatattttcgacttatatcttctcctggtgagttcttctccatatttcttttcaggtgtagttttaactcccatatacataaaggacaataagaattgctaaccaaaagtggccttaagtgtacacagtgactttgcagcatagtagattggccttcatatctggaaaaaaagatgtattttttttcaaatgagttacagggcagggcatactagtgttgatatttctataaagagaaagtctacactatttattgctctgagaaccttgttgtgttttgaaaaacatataatcagataaagaagcccccgatatttttctttcttagtttcccatttcatattgttttgtcaaatcaactgtgactcattaacatctcttttccctaggttttgctggcacacctggatatctttctccagaagttttacgtaaagatccttatggaaagccagtggatatgtgggcatgtggtaagcaattatattttgaagcaaattttgtgataagctagtgtcttagtccatttggtctgctataacaatctgtcatagaccaagtgggttaaataacaaaaatgtatttcttatttatttatttattttgatacagtgtcttgctctgtcgcccaggctggagtgcagtggtacaatcccggctcactgcaacctctgcctcccaggtttaagcaattctcctgcctcagcctcctgagttgctgggattacaggcacgtgcaaccatgcatggctaatttctgtatttttagtagagacagggtttcaccatgatggccaggctggtcttgaactcctgcctcaggtgatccacctgcctcagcctctcaaagtgctgggattacaggtgtgagccagcatgcctggccacaaaaatttatttctcacagttgtgaaggctgggaaattcaaaatcaaggtgccaggagattcggtgtctggtgagggcctgcttttagttttatagagagttatcctctctttgtgtcttcacatggcagaaacagagagggggctcccagggtctcttttataagagcattaatcccattcatgaggcctccatcctaccaaagacctcactttccttccttccatcatattaggagttaggattttaacacatgcattttatgagggacacaaatattgtctataacaaccacaatttttataatttaaaatacaagttgaacatccctaatcaaaaaatctgaaatttaaaatgcttccaaaatccaaaacgttttgagtgccaacgttgattgccacatgtggaaaattctgcacctgacctcatgtgatgggttgcagtcagacacagtccaaactttatcttatgctaaaaattatttaaaatatttcataaaattaccttcaggctatgtgtttagatgtgtataaaacataaatgaatttcatgtttagacatgggtctcatccccaagatatcttattatgtatgtataaatactacaaaatctgaaaaaatccaaaatctgaaacatttctggtccttagcattttggataagggatactcaccctgtaatatcttttaaatttgaagttgatattctctagtgatcgacttacagtagaagttctcaaacctcagtctacagcaagattacatggacagctgtttaaatgacagattgctgtgtttctgattcagtatatccaggatagaaacttttacctttttaacaaactctcaggtgatgctaatgctgccattttctggaacactttgataacagggatgtggagcattgctcctagtggttatgtatttatgctgctatcttctcaatggatccagccagtccttccaataagtattatgtttgcccatgatacttggcagagtttaagagtgaactagtaaatattggaaaataatgaaattgaccatcccgaggggacagaagtctgatttaggcctctatcagccaactcaaatcaaaaacagtatcctatgcaggcccaaagacatataatggggaggattttcacccacagtttttataatggaatttttatgtttcaacatatattttgaatacaggaaagactgaaagaatgctgcaacattaccctactaagattatcaacataatcacctaaattcctgatactatgtcattgctaccagcctacaagtagatacctaactatcatagtttggctttagtgtgctgcagacagatttcagtgcctttggtgtttgtcagcaagcttggaaaagttgatttaaaaaactttacttgattctgaaaataattttttagacttgttttagtttaaaaagttaataaattcatcatcactactttatagtgataggctgttcctcactatatttcttgtcagctttacctctttggtaacaacttgatgtttgatcttaaactgattgaatcttgggctttcagagttacctccgtgcctgggaaggcagtggtaaaatagggcactatatttatagtttcaacccctggggttcagtctttacgttttacctactaacccagtctctttaatatatctgagttggtttctttacctgtaaaataggaatatgttaccctcattgaattgtaggagggtcaaatgcagtgcactttaaaggaagacaattgacaattgctacttaattaatgggtaaggtcttaggaatgccccaagctctgtcttcctgctacctacctgagagtatcttctaagcatgaactctaaggcatgaactctaaaatgccttgaattagagcattgtcacaaaatatctttgttcaaatctaaatgttaatggaagatatctcagatattttccttgcaataaatcagctcccagcatacatagatctgtttctgctgatgaatttaaaaagcaacagagtggcctgagactcaggcagacacagacaggttttgtgaaggatacaatcatattttttaaagtatttttaaaacatgataaagctatatttttgtaaagatagggggttgtagctaaaacgctgcatttggaccttgaacactagagggatagtgtggcatacaatagtcagtaaccaagggaagcaggactcagcataagggacatttcatactctttctttgcctgcttcatcaaaggccttttccagcctcttctgcctttgtgtttatctctccttgttttcctagtttccttcctattttctactttttttcttcatccctcctgtctacttcataggtaagaggcagtatgtatagtggttaagagaacacacttagcttctcagttcacttgctgtatgacatggcacaaattctttagtccctgtgtctcagttccctcttagaaatggagatcatcaaagttcttgcctcatgggactgcagagaggattttttaaatacagtaagtgatagttatcattgctattattatacaaagtctttatttataaatgaagtttctagataactgatatatgcattatagtaggcttaaaaaacaaagtgtattatataactcagcattattggcgtgattatcagtagaatgccctcatctgatgacctgaataccaaattctctctctccctctctctgctttctttctttacttttaaattattttcccttgttttattttgtaaaaggtgttattatggacagatttcacagcttctgaatcatattttactctgccaaagaatttaaataaattattcatttgttcttatatcgaaaacattttttcatgtttcaaatgtgtcaccataaaaaatgatagacaagtgaggtgatagataggtgagttagctctatttaattatgccacattgtatatctgtaaatatcaaaacatcatattataccccataaatgtattcaatcataatttgtcaatccaaaaaaattaagaattttttgaaaatttaaaacctttttttataatgtataagttttattggtgttgaagaatatcagatccactaaaaagaaacccaaaaagctaatagtttatgctagggattcttctctggctgtgcagaaaaatcaatgatgaagcatatacaggcaaacctcagagatattatgggtttaatttctggtctcacaatagaacaaatatcaaaataaagtgagtcacacaaattgtttggtttcccagcacatatagaagttatgtttacagtgtactatagtctattaagtatacgatagcattatgtctaaatgcacataccttacctaaaaaatactttaaaatagccaggcccagtgactcatgcctgtaatctttgcattatgggaggccaacccaggaggatcttgagtccaagagtttgagaccagcctgggcaacataggatgacccatctctacaaaaagaaaaaagaaaaaaaaaaactgtattgctaaaatatcatcatcatcatctgagtcttcagcaagttgcaatatttttgctgaagagtcttgcctcagtgttgatggctgttgacttatcaggatagttgttgctaaaggttggggaagctgtgataatttctgaaaataagacaacaatgaagtttgccacatcagttaactcttcctttcatgaaatattgcagtactcaccaaaatgtgacacagagacacaaagtgaacccaagttgttaggaaaatggcaccacagactttctcaatgcagggttatcataaaccttcagtgtgtaaaaaatgcaatatctgcaaagtacagtaaaaaaaaaaaaaaaaaagcacagtaaaaccacatatgcctttctatcaaaatgcccagatcctgcatgggcctctgctttagtggatctgtggtaaacacaggcaactgcatttttaataacctatgatgtattatcagagtttggattcactgtcttagactcacaaaacacactatgttcaattttaatattactttggaatatttgattttatgtggattgtctgagtacatttctgtaatacagttcatatatctaaccttttaaaataatggaatatcttataatagtgagatttcatatctgtgaaatgtgagagaacttataagttagaagctctaactttcttgtctggaagagggaaaaaggataggtagagagtagtttccatctttgttttctaaactatataacattttgttaggtgttaagcaaatattagatagatactacgtacacatgtgcatacatgcatgcacacacacacacacacacacacacacacacatatcaagaatgactccttagaaacttatagccatagggcatctcatagatttttaaccccaattttgccacctttcaccttgctatattgtatcctttcttcacataatattatgcaaacagccaaattcctttgtgatgagccttgccccagttggagcatgtatgtgccaccaatttccatttctttagagactgtgtggacgctttgtctagaaatgcacttgagatcacacagctatgaaaatgtcttaagtgttctaatatcacatgttgaggggaaatgactcccactagaacattataatgtattcttttgttacatatcttggtcattgttgtgggatttggaattgttttaccattttattatatatcaccttactcgtgtgacatgaaagtgacattaattcactttatttgtaaggtgatgtacccttaaactcatcatcattgtaatcaccaccacagtaatggacacactatttggttgcttttaggttgtggcttatcctgagggaaactcttttttagccattcattagcactgtctcttgccaattaagtagtgacttattttcaagagtagacactgggttgagtggtaaaaaattacactactcagaaaacaaaagaaatgcaaaacaagccatttagcagaaaggcagctagccttctatatgaattaagctctgaaccctcattacagcagagcagagtgaagcagggcattggtataatgactaaaacaagcctgtacattatttttattagaatcatgcaattatctgcacacaggaaatctcgaattccaacattaccttgcttttgtgatcgcacacagagtatggtctgacctgtactctctctttggaagcaactattccattactggaaagcaaataataaacattaatgaagcaagaacatagccttgtgttctgccattaacagcagtaaattgatttttatgacttaattgtatgtataactgcttccataatttcctaatgggatgaggaaatgtttgtggatgtcactggatcacaaatttctaacagagcttcttctacaatttggcctaaaaataaataaataaatgcaagcctataacataggtctctcccgcaccctatgtacatatgtgttgtcttgctacttttctgccttacttaggtatcactctcaacagttatgagtgataataaattagtggctgtcacaaatgtaccttgacttcggacaaaccttgggaattttatggaatatgtttcttcttttcttgtgtggtgaatttaggttcagcaatgatgtgttttctggggtttaaccttttcatatttcagctggtgtaagtcattatcagttactttagtcattttgaaatcccaagcctactggatattctgttgctattaccagttctgaggttaccttacacttggccaatcacagataggcctccagattagaagccttctgccttcatccattcttacccacatctccaacagtcttcagttcatggagccttactcccaatcatagtctttaccaatattctcttactctgaacttacacactgtcttaaatttctctacatttactatgtctggtttccctaacttggtgtttttcaaactctgaaacacaaaccacatggttcattcagagtgacctaaagtgcaccctcctgagatctacctcaggaccattgaatcagattctctggggccacaggatgcagcaatcccacttctggttatatatccaaaagaattgaaagaagcaccttgaagaaatatgtgtacacctatgatcatagtaacactattcacaacaaccaggaggtggaagtaacccaaatgtccattgacagataaatagcttaaacaaaatgtggtttatacgtataattgtatattatacaaccttaaaaaagaaggaaattctgtcccgtgctacaacatggatgaaccccaaggacattatgctaagcaaaataagccagttacaaaagcacaaatattattatgattctactcacatgaagtattaaaacagtcactttcatagaaacagaaaatagaaaggtgattaccaagaactagagagaaaggggaaattagtgtttcatgtatatagagtttcagtgttgaaaaatgaaaacaaactggagatctgtttcatgacagtgtaaatgtacttagtactacaaaactgttcacttaaaaattgtgcatctggctggacatggtggctgatgcctgtaatcccagcactgtgggaggccaaggtgggagaatcacttgagcccagaagtttgagaccagcttaggtaacatatagtgtgaccctacctctacaaaaacagaaaaaattagccgggcatggtagcacacacccgtagtcctagctactctgctcgagaggctgagcccgggaagatcatttgagtcagggaagttgaggctgcagtgagccatgttcatgccactgcacttcagcctgggtgaaaaagagtgagaccctgtctttaaaaaacaaaacaaaacaaaaaaacaacaaaaaaaaagatctgttttatgtactaattatttatttatttgtttgtttgtttatttatttatttatttatttatttcgagacagggtctggctctgttgcccaagctggggtgcagtggcaccatcttagctcactgcaacctccacctcccaggcagaagttatccttctgccttagcctcccctgtagtggggactacaggtgcacaccaccacaccctgctaattttttactttttgtagagacagggttttgccatgttgcccaggctggtctcaaactcctgagctcaagcagtctgcccacttcggcctcccaaagtgctgggattgaaagtgtgtgggacctttttttatgtacaatttaaagtcactgtgcgggaccttttttatgtacaatttaatgtcatgtgtttaaatttaatgttaggtatttttagcataatttaaaaaaaaaaagattcactgaggtgaggctcaggaatttgcactttaacaagcgcaccaggtgatgttgatgcaacaccaaagctaagcaatactaccacagctaatttcagattcctttaggagagcagtttttaggattattacaggatatgtcagaggttgcaaacaggtgaagtcttagttcaggctgctataacaaagtcacatagactgcgtggcttataaacaacgaaatttctttctcatagttctggaagctggaagtctgtgatcagggtgccaccatagtcaggtcaggttttggtgagggccctcttcagggttacagactgccaactttttgttgtatcctcacatggtagttaagagagctagctagctagctgccgtcttcttaaaagggtgctgttcctgttcatgagggacccatcctcatggactaaatatctcccaaaggccccaccacaccaaataccatcacattgggatttggatgtcaacatatgaattttgagagccgtacaaacattctctccattgcaggcagtctgctgtcttagtcagacatgcggacattttattcttatgagtgttgatgttaattatttatctttataatttattagcaagtaatttctataaaaactatcagtttcttgcttctctaaaataatcaaaagaacaggtgatgcaatgcttttgctcttttatagtaattgtacctgtcagacacatgaacacagctgccgccctggtgaccaccccaccccatacacagtacaggtgcaggccttcatccctgcctgctgccaaaaggcctgtcagtttgccactcctactacatggcatagatagtttccatcctctgaaacatgccttcctatcttgctggcattgatcttctagctctttgttctgcccttcattggccatttaggtcagagtgttagttgagcactttctctacttgaaatgtatgatgattttccattaatcatactacaacaaggtaagagagagccatacttatcactcatgtaattaattgtgtacttccaagttccacatgcattttgcttataagtttataatgtacccctttatttacttagaatattcagtaactgtcttagattcttccattaacttcctactatcttctcagagttctccaacattccttcttcatctctccttttgtaagaacagcatttagaatgtttaattattaacaagattataggtttaacaacttttttaacattaacttttattaaaatcaattttgaatgttctcgatgatatagtctttctacctaattgtaatcagtgcttctcaaaagtcttattaaccggacatctctagcatctcccaagcacaaatatatacataagataaggaaaactagttttaatatctacctgtatatggaaccaactctatcaaaaatagttttaactgtttgtcatggaacatgtgaaacataaaatggagagaatactataataaactgatggctaatcttatttcatctatttcctccctttcatttcccactccaatattatcttaaccaaattgaaacattgtatcaatacatctataaatattttaaagtatatctctaaaagaaaaggactctaaatatgacagtaatattagttttaaaattttaataattattgcttagtaacatcaaaatatctagtcattttcctatttatcctctcctgtcataatcttgtttggtctcttaggtctcttagtcattcttaatttgtaatttttgctccattctctcttctgtctccttatttcttgatttatttttcaaagaaaactgtagctccaagacagcacatgtaagtgctcaatcttggtctctagatactatttaccattaaaaggaaccagaactttctgtaatagcagctgatttcaagtttagaacaggaaaaaagcaagatgatccaggagcatcttgtcataccacaaagaaaaactattaaggaccacagagtttatattaacagatgcaggaaccactttgaggaggctggcactagccaaagatggggcaattgagaatcaataagaaaaataacataatagattgaaatacatcaagtaagtttaaatccaggaattgataatgataatcaaaattcaacagaagtcctaacctttgggggatgttggggagccaatgcgttattttaaaaactggctagtaaagaggaaaataaataaataatagcctatctttcctatatgaactgtatcttaggccaaccaagtggataaggagcaagattttcttagtctaaagaaagcatgatataattagagtatcatcattttgtttgtttgtttgtgagtctcactctgttgcccaggctggaatgcagtgatgtgatcatggttcactgtggcctcgaactcctgggctcaagtgatcttcccacctcagcctcccaagtggctgggactagctgtgcattccaccacacctggctaagtttttctatttttggaagagacagggtcttgctatgttggctaggctaatcttgaactcctgggctcaagtgatcctcctacatcagcctcccaaagtgctgggattataggtgtgagccaccatgcccagccatcattattttgcaaccccagtaaaattatgtaggcagtaatcataaaaggctgctagtgtcatgagagatacccaacatttggaggtcacatcatcacccctcaagtggtctcgcaaaaaaaagacttcttcattgacttttaatgattttagtactttaggtatatgggcaaagaaaaagagctagtgattttttcctttcttttttctctgacatagaaaaaaggtaaaatttaggtttattaaaaagataaattgggcttactcatgaggcaagaactcaattagaacaacaaacacttttattttattttattttatttttatttttgaggcagagtcacaagactctgtcacctaggctggtagaattcagtggcacgaccttggctcactgcaacctccacctcctgagttgaagcgattctcctgcctcagcctcccgagtagctgagactaaaggcatgtgccaccatgcccggttaatttttttgtatttttagtagagacagggtttcaccatgttggccaggctggtcgtgatcacctgacctcaggtgatttgcccgttttggcctcccaaagtgcttggattacaggtgtgagccaccacgcccggcctagaacaacaaacacttttaaaataagcatttgtttagaggacctagctaaaggaaaaagtagctgcaaggaacatttaagataggaccaaatggacatctttgctagtatgtcaaggtctctcagttagacaacacaaagttttaaattttatattatcattcctactaaagttcatagataaagaaaaagtggctgcagggaatgtttagagcatcattatgtctgtcctgcttgtggttgaaacagttacttaatctctcagcctgtttcttcatctataatataatgcagataataacaatatctacctcatagcattatacaaggattaaatgagataatgcattaaagcacacataactctgaataaatgttatctacaataaaatttattagtattacattatccttatgccatgagtctcatacttgttctatacattcagaaaatagaactacaaaatagcataactcagaaaggttttagatgcttgtttaataatcaagttgaagtaaacttacaaaacggtgtttatttaaataggcactgacaatttcacatcaggctagtcaatagcacctataatatgttttttttttaagtctttgggcctaaaagtgttttttttaatcttcacatttatgctattattttatttaaagtacatgtttttgtaaacactcctccatcaaacagctaaattgtgggcatctattacatattgcctgcttttctcatggaatgagccctctgtgagcttcctcttcccagagaagcaccacatcaactgtcaactgcagacataattcataaggacaaacagcctatgttgagaatgctaaatgtctcagttgagccactatttcataattctataacagcctaattccagatgtgtattaggaaaatgttcatattcaatggaaactatcactattacaaagcaaattttcttcttaacctcctggaaccttatatagctgagggctaaaactactcaggtacagctttttttctacttgcctcctgagaacacaaagagaaacactcatcatcatcattactatcatcattttcattagatgtatggaaaaattatttttatgtcatgaaggtgaggtaccaatatactgtggttttcttcatggtcttttttttttccttaagaatgttgtttaaaattttttatccttgtattgattcacatgacttaaaaaatctgcttatgaactgtatcttcctgaagcaggctataaaattctaagatgattaaaccattgcttaaaaaccatttcagctgctacagtgtctattgtataaagatgtccagactgctggacaggagcagggatagatctcctaggtacagagaccaagagaccaccttggataagggaaaaaataagtctcagggtacacctggcaaagtgtcacctgtcttactcttcttctcaggtttcctaggcttaaggaaacatagcaagaaaaaagcaaacaggagaggtcagaggaatgactgccttcctccaggataatgagctaggaaagaaaccaaaggccttaagcaaggcaataaaatacgtgaaaagtggcaggagagatatttgatgacagagaagaccactgtatcaaaacaatctcagacatttagactgcagatatgatttcagggaaatttacaaactgtgaatacagaatttttttaattttaaaagtgaaattagattttggttaatttataaataattatgtttgtgaaaaattttagcaaattttattacagccatgtgtttattgttgttattactttgaattttctgtggaatttctcccttctctccctttttcctctcccataatatatattcttctgtagtcttgttggtttagttgtttgactgagaaggcttgaagtatttgaagactaagattactgaaaagaaaagggttttgtctctatggggtacccacatttgcagggactatggttatttagaacgtggatttataaccaggacaccatcactcaacaaaatgtcccaatgaccatcaaaacaagtatgaggaaataaaaaacatgcttagtttttaaacttcaacctcacagtgactaaaatcatagtctctatatagataagaatgcagtaagaccctctatagacaagagttcaggggggccaaagaatgttgccctaaatgaatgttgccctgccatgcctctttagaattctttgatgcatgcattgactgacacattgtcagagttctggagcataggaggagaagcattcaccctccagagactgctctagactagatcataacacatctttctgaagttttcctacaatccagttttctctgttttaacaactacggcttaatatcattgtggatcagccacatttaatttactgttgtctatatgacttaaattgtgttaacattatattctcctccaggtgtcattctctatattctacttgtggggtatccacccttctgggatgaagaccaacacagactctatcagcagatcaaggctggagcttatgatgtatgtaataactatttatatcactttagatgaaggtttgtcttttgcctgttgaccaagagccagatcttttcatttttcttttaaccataatttttaccactttctcatattatttccctctctcttaaggaaagggagaaagaaatgcagcatttgtatccagtttacgtttccttttaactcactgtctcctaagattgaaagaaaagccatgtgaagtctctgaggaagaactttgtcaaaatatttggaccttagtgcattttaaaaacataaaaattaaaatatttctgctatagaaatgattattgcctgtttagttgaattatattctcaaatatctatcacataattttatattatataccaacaatattttgctgtgatcacatatcaaatagaacattatcccactataccagtttctgggttttgttttttgtttttgtactgtttgggatactatgcaagctttcatttgaagaatgagtttcacaattgaaaaatttgaaaatcataattctaataatatatttaatttataattagaatatttgaaagtagatatatatatatacattcataaattaagttcagaatctgaagaggaaggctttatctactttctctttatggcttaactttgtgtttatgatataatttgctctcctttgatacatattcttgtaaatatgatttaccactttctcaggtttcccctcatacagccctatggaaatccatgtgcagggtctgggcatgctttccatgtgttattaagtagagtaactacagagtagcaatattgggttcaccttttgtgcacaagttgaaagctcaatgtgaaagtgagaggagaagatataaaatgtctttattatattctataatgtctcgtgaactcttcaatgcatttctgataaaaattttctatttagatggatgtgtgtgtcagcaagaattaaaaatgtatattctttgaatttcaaagcattgcattattcctagactagtaattggaacaaattattatttacatggcaatagctagcacattcaccatctttacagactagaaccagcccctctctgggcagacgtagccctgaaaatgcactgcttggtatacctagaggaatgctttcatgaaaattagagaactgaggaaaatgttcacctttcttcatgctgaacctaccgctcatttgctatcagaagacctgtacaacattaagaaacagcctcgtgtgtttctttaacagctcctaatagttagcaagcttttacaactgccaaagataagcttcaggaattaaaaaatggcaattgtttagctggcaaaaattacagatattagagtcaatatcatttttctcatgctttattatgccagtgagtcacaagttccccattttaaaactactaaaaatggactaatttaattccatgacacagtggcaatggctttatttttcaagattgtccatacaaattcatgaattgggaaaataacctgatattctatcattttgcaactaatgtggtgtaaatttcccttcatcgttgaaggacagtatttctactaaatatgctaatcatataaaagtaagttaagtaattatcactacaaaaaatcatgtaaagaaaggagaagtagctttcttatatagtcttaatataaaaaagtattagtaatgggaagttataagatttgattactttcatatactttggtgaaatttgtaattgggcagattaaacttcttgaagggttaaaatgaaatcttgctgaagctcctgtagtctcagattcttctcactacagcactccaagtagccctgattaataggtcagttttggcacaggaattgaagctgttttattacctctgctattactgcttatgagttgtgaaagtatataatacctcattttgaaccttggcataatatcatgatgacattggtacatgtagcaacctgtttgcttttattaagttttgcaaataattatgagaaagattgtataaaatttcattttcagatcaaagcagagatactttgagaagaatagaagattcttaagttctttttttctgaattttaaaatgtatttaccatatgtgatatgcagctcagtacatatgttggtcccttatcagatactctttaatatatatagttgtctacatagagggggagaatagatctaaatggttttatttattttagatacaacttaacttatataaaaagtaaatttatgaagaaattcactacttgagggaatgattcatgtagttgactcttccctgtttgatcgagtgtgtctattttttaaactttttataaatttatatttttgaagtttccatcaccagaatgggacacggtgactcctgaagccaaagacctcatcaataaaatgcttactatcaaccctgccaaacgcatcacagcctcagaggcactgaagcacccatggatctgtgtaagtaaaacttctccaaaacttcaagaactaaaatgaaaaataagctctcctttaatatattgtttatggatttaaaatagctttgcaaaaaaagatgaaactcagaatgaatgaatttttgactcgaggtgtttaagaaaattaattttatgatggtgaaaaaatgcaattttcagtagcaaagtctgaattgcatagattcttaaataaatattgcttgcagtaacaaaaggaatgagtattctccatatcaattattaacaatactcatgaacaaggttaagaaaataacaccaaaattaaatgtgtcccagaagaaaagatttaacaaagttcaattatttatcattaggcaactttagaaacaagtatgaagtttggcagctgacagtagagtttcagtggcgtaaaataatggtcatagtagtctgaatatattttagaaatattaagaagaatagtgtgaaatttgagggggatctggagacttcagtaaatttccaaatgtgtcaaatgctaaggtgataaatgtggcactaagtaaatgaaaggcagctcaatcaaaatgtgattgaagacattaaaataaagataatttgagaaattattaatattcatttctatactttctggtttggttttgttttgttttgagacagagtcttgctcttgtcacccaggctggagtgcaatggcacgatcttggctcactgcaacctccacctcccaggttcaagcaattctcctgtctcagcctcccgagtagctgggattacaggtgcccaccaccacgcccggctaatttttgtatttttagtagagatgcggtttcgccatgttggccaggctggtctcaaactcctgacctcgtgatccacccgccttggccttccaaagtgctggaattacaggcgtgacccaccgcgcccggcccatttctatactttctatacgtcagtgttgcatcttggtcacaagtagtcttggcaaaactaaaattttatttttaggtaactttggcaattgaatacttagaagttgatcctgcaggtgcagcaccattaataaatatttgatgaagtcagggacattattatacttagtgtgttttaaatattctcaattaagttactttttctcctcttcttctagcaacgttctactgttgcttccatgatgcacagacaggagactgtagactgcttgaagaaatttaatgctagaagaaaactaaaggtaagaaattttacatttttatggggaggtagatttgacagactaagaagtgaaatactgtgtgaggaaaataacttctagcaaaggctttcaattatgtagacctcaatactctcattattctttttggggctcttgggaaatggaatatacaccagaatcaaaactatggtgaaaagctggaatcatcctggcaacacatgctgtggatccttccttcagtggaaaacagctgtgcaatttgataatcagaatctggcccgcacactagggccgtcccagcatcatgagagacaaaggcctttgactctcaggaaaccaaaaaacaaaaacaaacaataaaaaatcccctaactgaaagtagggccaggaaaagatttgttatcaaagactctatatttgttaggtccagaatttgcataggcaacactgacttttgtgttctaatttttttcacagggtgccatcttgacaactatgctggctacaaggaatttctcaggtacatgcattgggaactctgcttcttatcccttggtcttctttttaagtagtctctgtttttttgtctctggaattttaaaaatctaataattagaaaaacttcattgttcaggggtggcaaatgtgtggcacagattccttctacacctatggctgccattagcagtctacctgggtgctgtctgctgccgagcctccgtgactgaacccctcacaagactgcttctggcagcagtggccaccagtcagtgctggtgcaggactagcctcatctgtcaagtgctggggtgcgcacgagttgtggaaataaatactccctcatttacgatctcagcgtttcaaacctagaatttattactgatatttcataaagtaataactttgaataagttatttttggtctcattttcatagggaatcctagtatgcaagatttttaaaagaagaccattattggccgggcgtggtggctcacgcctgtaatcccagcactttgggaggccgaggcaggtggatcacaaggtcaagagatcaagatcatcctggccaacatggtgaaaccccgtctctactaaaaatacaaaaattagctgagtgtggtggcgcgtgcctgttgtcccagctacttgggaggctgaggcaggagaatcacttgaaccagggaggtggaggttgtagtgagcagagatcacgccactgcactccagcctggcgacagagcgagactccgtctcaaaaaacaaaaaaaagggaagaccattattgaggaacccagttctcttagacctaagttcattcaaaagtatagtattttcttggtgtactataaaagtgattacaactgtcaaaggtatctaactcaagaatttacagagcaccttgcactcagtactatcagagcataataaatgtccctcaaaatgattccatggtaaaaataagtttgttaaataataggcttaaagaagccaagccatttctttattgtaagcgtcactctctaaaagtggagataaagtatatattactccaagaaattacttgagttttgcaacctccttctttgatagattgtctcaaaggaccaggttcccaaaagtcaaatcttgttcaatgctaagcagtcttatgtagggggaaggactggagcagcaattaagccgcacttggtaacctttggccctttagacttggaacacttgtcagccaaaaatactaccagtttagtttggatacagtttacataacagtgatctgcagcatcaaactgtccagctattttttcaattctttattttgttttctgctacatacttagcctgggtgttatagtgttatcaggtaataatccatcatatcattattaaatgctcttcaaccaatatctagttattatttacaactgcattaagtggtcacctttctccccacctttgcatttcattacaaataatgggaaaccataagaggcctttcaaaggctgttaaaaaatagcaacaacagtagtacaatgaataatgctacgaattgagggactgtgttggccagttgtatgtattttgtccaattcatttagtgtaataataccttgttgctgcctttgtcaagttacctgtttcataaaccattgattaatatagttgacatttatatgggtgagttcaatgccatatcattaaatattaattcatatatatgatattcaaataaatttcactgtggcccagtaattagtgaatcattaaaaggtagagtgatttatatagcataaattgttaatggcaaactaacccaaactttaaaaaatcttcacatttaaaactgtacattttgttaaagaagtgttaaatacactcttgggcataaattgggcctttattaatgtatgtacccatatatagaagctttttgtttacctcacagtttccttttcatcatcatgtaaactaaaaactcatgactaatatgtgaattttatattgtttctgattgtcttagcatgaaaaagcaatttttttaatccatcacttcaaaatcaactgaagaatattagacccagttacaacatcttgtacttgatactgcattttagagtattttattcatcctatttcattgccaaacatgctctttaaagtaatttgtccataagtatatggttataaagttgttgtttttattttttcttttctccctttatgtggaatgtatttcttgtgaggtaaggtgaatagtaaccaaaagggacatttttgcatctcccaggccaaatccctgcttaccctgaatcatcatcttctctttgcttgctattgcaatttcaattattctgagtttgctttctaacctattaactgccacaggattgatttaatactgctttttagctccaggcaaacaatataatggctaaggcaactatttcttacaatctcaattaataataaattaatagctgtgttgctaaagattaatgaagttaacatttttgtatcttttaagtaaatttaaaaatataccaatatgatattgaaataatggcccaaatcaatgaatgtcaggaaattacatgttcatgcagttctattctagctaggtatttccactttcgaagccaaattctattctgatatacttaaataagtatatgtaattaatattaaatgaaagcataagtgtgtatcatgtcctgcatatttgtgaatgttctacacttggtgtactaattgtcattgacagttatattatctcttcactgtgtatctacacattccttagtagatttttctgaaagggtgacttcaccttttcatatactcaagaagtttagtaacagaaggaatgttaaaagctcccttccaaaaaaaatgaagtttcatataagacccatatgctttaagatttctctaatttcgttgaagattttattctggttttatgttgtctcaaattttatgatttttactttttcattgtaaaggcttttgtttatgaagcctttgtattctgattttaatgtataaaagaatacataatgccattttttagagatcatgtgctaaacattttaaaaatttgctctaagccaataatatgccattttatttaaatagtaatattttttgtaaaaccaaattgtctgacttcaagaatgtaatgaagatgttatttagccagagcaaattttacaaatgaattttcaacctctggaaagcagggcttaaatggcagaactgacatggtcaccatatgtggtgtgaatgaacatgtaatacaatctgtcagtcagctgatgtccaaagactgaattcaactttctggattacaaaaggatagtccagttaaagttccagtatccttttcacaaccaacagtgaaataaagtccaataaacacaactggcaaagtattcaattgtatgcaacgaactactctttagttctaaatttgctgtggcaaaccaagaaaagtgatactgtatttcaatgtcctgtaagctcgcgttcatcagtgtgactttgataacttgccatatgttggccagaactcagcaaaggtggtagaaggagacaataacctgactgctttgttgtctggctgtgggtttctatggataactcactaaactgattttactctcattttacagcagccaagagtttgttgaagaaaccagatggagtaaaggtaagttaaacagatgcccctaatccatttctgactttcagatgctggataatctttaaatgttatatataattcctaagtctttgcaagttctattttttattgtttctgataaaggttgcaggttgaaatatgaaatgatttaatatacaaagatgactaacatttatatcaagaaaagctgtatttctcctgttggattatatatgaaatagtcatgaaaaaataatgttgttatacaatatagagttcctatagaaataattaaatgtcttaatctctctgatttactacagttccaaactaccatggtgacctaaaagtctgtaaaaaccaaatgcttttccaaataattatgctgcatacgtgaaggccactgaaatatatagcctgaaaaatactcacatttgggtatggaaaatagaatgtcaaatgtctaaattaatctgcttgggcagtttttataaaggtcttaattattccttgtttctgtcataaggtgttgagatatattcaagatgaatgatctgaacaaatattagaaaaatcttgcaagaaaaataacagcaggatatttttactttctggctttctaaacaaaataatacagtttctttcctactgattgtattttgtttcaaggggatttactcttgttggaatgtaatcttatggtacataatgatgtttgttatcttttcagagtaccacctaaatgttttatttctttaatccttttctttctcttccaaggacagatgcatacattcttcatcaacacttcaacgttcttgggaattaattaattttctaacatttgaatttgacccaaagtcaggtggtcagttcatattgaaaacatagaaaatcatttgtcactttaaatgttcatgctcagtcatttctttaccacctgtctgtgtgcaacttggaaatttctggagcactgatgactgtgcatttgtgatttcctttaggatgccatttccatttaccaattgctttcctcagcctgcaattgtgtcttcattctgattagtttattccatttagattttaagaatgatagttgatgactgcctttttcccaatgttacaatagtagaaatgtggtatcttacattttccaaacattttcttctcctgggctttcctgtaccgttcagtgatggagagctcacagttcctattgagatatttattttcattactatccttacatagaacgcatttccagaactttttccttccattcaacttatagctcctctttaaaaacaaaattattctatactccatgctttgatactctaaattcaaccggtcatatttttttttcttttcctttctctttgactggtcaattcagaaaaggaagtccagttcgagtgttcagatgatggtgaggatctatctgccagatttctcctcctgtgaaaattcacacttaggaataaaagtcttatttacctaagatagtgtaagtaagtggagagggtgtaggaccattacaggtcagtgttagtcaactatcaaaacacggtacttctcttacatattacattgttttttctctgaaattgaatttgttatacatgtagatagtatattaagaggtttgctcttttacaaagtcaattttctctttgaaaataaaaagaccatgacagaatgaatgtctgtatagtgatcagtaaaaacaaacaaacaaaaaactatatgttttttttaatgttctttatggttgctaaaataggagtgatttataggacaccataatacattcaccatggagtttataaaggtgtgaaagtgatcttacaatgtaccaatcctagttaagtacctttaaaggaaatgtttattaaccttcaaacaataaatttaacacctgagaaataggaatatcttgcccatgcctcataagagtaattcagtgcatcatacaattatctgatttgattgattcatgattttttaaaaaagaaaaacaccttgcttctattaacataaaataattatatcacacaaaagtgccagagtttttgtatttttaaaagacatctatgggccaggagcggtgtctcacacctgtaatcccagcagtttgagaggttgagacagacggatcacctgagatcaggagttcgagaccagcctggccaacacggtaaaaccccatctctactaaaaaaaaaaacaaacaaacaaaaaacagaaattagccaagtgtggtggccgtacctgtaatcccagctactggggaggctgaggcgggagaatcacttgaacccagaaggcagaggtttcagtgagccgagatcgcgccatggcactccagcctgggcaacaagagcgaaactccatctcaaagaaaaaaaaaaaagacatttgtggttgaacctatacttatatttgactctttgaaaagaacgtcttcttgccttttgcttagaaattatcctattatttttcaataaattaatattataaataactgcaaaagattttccataggaaaaaaatcatttagttagtctttacattaacaaaaaagctttaactgcatattaaacatgaccaaaagtgtggttgaggcacatattcatttaactcatgtttcccatacctaacaataaagaatggctcacccagacagaatggccttcatctggaagagatgatggtgtgtgtatgctgtgtatctgtgtgtgaatgtgtgtaggtgtgtgtgtgtgggggggggaacatgtgcacttgtacagataagtttgtgtgcacaggtgtgcaagtgggacattttcactaaaataaagcagttcttggcaaccacatcctagaaaaaagtcaagtatcatatcccaaaatagaaataaaagtatctcagaatatttctttcatttgcattcactgataaaaactaaatatagcatattaaatacatgtggtgctttaaccataagtgcccctgttcatttgacaggaagccggctatgttttgcctagcatgtttcccgaataggaaattattcgtgtgtgcatccctccccttttctcacgtaccctgtactaacataaatactgaattttgatccctctttaatagactttttacctcttatctctttggctcttgcacaaatatcatgttaaattctgtgcactttgatttaaaggaaaaaaaaggttttaactatctgcagaatatagattgatgacaacatttatagaattttccagtaaaggaaagtttagaagttttctcatccttttctgtgggtcaagcagcacagtgtcacaacttattgtaaaaataacgataccagtaatcagacaaaagggaatgaaaagaaaggaaaaatattacatatttaaattaatttatgttactttctatcttcctctcaatactagttttgacaggatatatagttatcagatatagacttccagaaaacccgaacaattaaactggtgtcaccacttgaaatgctcatttgatactcatttattttatatagtatatgtttctctttacatcattatctatatttatattaaaatcatggaggtatattcctttagaaaataataaataaaatacctagataatatagtataagaaaatgaacgttaccttacatttttgtttgagaaccgtaatgtaagttgtcatgcatgagtttaaaagaatgttgattgattattatttttcagtccttgattcttagtgccccgactcagttgtagtttctgattgccacttgtctacaaagagtcttctctgtggaccgttagaacacttattgaccctctgagttgcttttaccacgcagcttccacagtggtaatgatatattctttaaagtcaaatccagttatgttaaagcaagggaatgatattaccaaatatattctgcagtgatagcagtagcacattgacagaaaatgtagtattttcctcttacacaactgtaaaaattaaagtccttttacattcaacataaaaagtttgatttccccactaataattgaagatgtaatttttagaggagatctacacttgtcatttttaaaagctattgtgacaccagcgttttctcagaagatctaaattttcattggataatttaattgctcctaagcaaagtaatgctggatccccagagaaagatgtatgtgtgtgtgtgacttcaggctcaagaataaaatgagggaagaaagaaatatatttataactgtgaacaattggaagcttggaaacagaatccaacttgaacagtatgagaatggttatattaatttcatactctgaaacctgattggagctccactgaagcagctctttgtttgctaaggtggcatagcaacagcagacacgtctgttttctcattgcaccatcacggacatggtccagcctgtgtgtgaccatcggagactagcgatcatcattcctgtcagtcatcaccatgtctttcacgttcatcttcagtggctctttatcttcatgtctacatctctatgtagacatgctgcatctagagacattggctaccaaggggtttaaggcatctctgtttctattttctgcatacccacagataaacaacaaagccaacgtggtaaccagccccaaagaaaatattcctaccccagcgctggtatacctggactctttgtaacccttcttaagttctttacatttttttttttttgtggtttctctcatttgctttcactatatagatacatatatataaatattttatttcgttgggtgttgggttttgttttttttttttttgctttctatgatatgaccaagttcatttcttttggttttttttggttaagttatttgtcaagcagtgtgttctaacatgagattatctcatttcgttgttgaacattgtactgatagctgtggtctctgtagttggaattactgcatgctgcattcaaaatacagcgctttggttgctcttagctcttctgatgatgatagttctagattatgcaaacaatggtttcttcttttcatgatgcaaatgcttacatcaaggagagctaatgggattgttgctagacaacataaaagtagaccttattcagagttctcgtttccctcttattaaaacacaacagggctttgtaagacttcactttctgagataaagaggcactggataatttagagctttctgtttattatgttttaaattaaattttcactgtttcactttaatccaaagaatgaaactgcaaagaatagaggtttgaattatcagtggaaaccagttatgtctatctcaatcaaatccacacaattaacgactaaattagtctaacactttgagatggtattatgttaaaattcagaatttgaatactgtcattcagtgctgagttccataacattttccctaaactgtttcatattttgatttatgattttcagaaatgtttttcaattatttgctcttctcatactgttattttaaataaatttaaaaatgttaaggaatcatttcacttgagttaaccatgaggctccatttaaaaacatttaaaaggaggacacatcaaaataacaggttatctactagtaaaaaacaatgttgatcacagctgtagccaagggaaagggagaatggaagcaggagatatgtctctcaatattacagcagtgtaaactgtagtggtgggggagtgtccatgattgagaactcccagtgggttgcagtacctccccattgccaagatatcacacaatgaaagtgccaagcatgtcactgatgtatgcatattgaatctttttttacatcagttatttgaatgttattctccacttgggaatatttctttgctttctgatagaaaacaatagaaaacccatactttcttcataaaaaagcatgactttatagccagatatcctgtatatatagtccataaagtagaagttttttagatatgaattaatacaggatttaatagcagtatgcctcaaattatagtgattacatgattagttctagattagtagattagttctagttcatgattagtcccttaaactttttaaatgttccttaaaatttttttatggtcttttgaaatggattctttagtatagtctttttttaagtgttgtccaatggctctagattttataagggtattcagttacgtattaattaatgacaccataatcgagtttcaaaccaatataactgaaaaaatatcttctctgagaatttgaaatcatctcagagttttagctccagtgtccttggccagttctctatgggacagacgttcacaggccactcattaaagaagaaaggaaagcataggattaagtgaaacagtgagtgcctcttcagatctctaaatatcaaagccttgtttgaatgctgatcaagaataaggtcttttgcatgctgcttctgggtagggaggttcctatctcatggcctcgccagggagatctttcatcagagatattgtcagctgcaactctgacagcagttaacatcgctttagctcttgtcactatttcattttgtcagctggctcactctgctctgtccttcacactagaaagaatgtacttaccaatgcgaactgtttctttctctattttgttctcactcaggagccccaaactactgtaatccacaaccctgatggaaacaaggtattcagaaagaatcaacatcatcttgctttaacaagactatacatctcatcaaatattcaaaaaaattaattcgttatctaaaaataggaaagaaaattctaaccattttctaccacacttccttttgggcctaatttatctagaactatggacatacttcttgcaaataaaaatgaatgacatcttgaaagagaaactaatgttaccatgagtcaataaaagtcaggctaaacatgaatgaagtctttatgtcaagatgactgtgtgtcttaagcaattccatctggtcatttttttccccatgactttgtgctttgtactgtagatatattgtgcatgatattttagaatttctggcaatattccattgtcttcaaaaatatcaacttgactttataggtttttttttttgtttagtgttacttttgagttttattctattctgttgtcagagtggtgttttttttttttttggtttttggtttcttaattccttgttggtgatgatgttgttattgttgttattgttgttgttgttgttgttgtttggcatgaatttgaggtgaatcaaggagtttcactttttgtgaaatatgtttgttgttgagtaatatatattccagtaacaggggtttaactacttaggttgaaagaagactaaatgtttcctatacattgtaaattatttgtatagcatgttaactaaataacagcactagcatacatgtctataggatgaaagaccttttctgaatgtattccatgtgtccaatttcttacttttcatatattattatatctctaagggaagaaaaaatactaaacttttctcaaatattagatatagtcatgcatcttctccatactcttatcaatgatgtttaagacttagaaagcacattttatcttaagactcagaaaacacatttcctctctggtttaacatttaattgatcaatattaaaaccattaaagtaaaaaacatgaagtgttatgttctttaatatgagatttattttatagtcatgacactgcaaatggtctaggtcccgaaaagccttgaggtagtcaggaccatcacatatgagaacaatttttttaatagcattagccaatgaaacgccaagcataacagctggaatggacacttcagtagttctagctatatcatttgtaagagttgctgcatgatatttcttgctgacatgaattagtttaattttacagtgcatgggtttaccttcattttcagcttacatttgaatactaggtcacattaagaaatgcatgaagattcctttctttggttttgtgtgtatggagactctgggtacacctttaattagtttttcccttggtttaaatattgtatatgatatttatataaattgatcacttttttgaatactgaatctctaaaatgatactggctggtgtttacattattttccagaatctgttttccattactgagctattgattggaagtttgtttccagttatttttggctctagcatttaatcattccaagtagaaaactatgtctttcttatgaatattgcaaaatttatttgctagaaaatattttactcatacattattaatgagcacatttatcacaccattttaagaaatgtatcttaattctggcagttacagtgtacttttaagtgtgcttaacaatcttccacttaatttgtagttttacaaagaaagagctttgtctttttattatggagtaggtttcttatcaataacagccagttgctatttttgaaaagaatgaaaaaagtctaattgtccttgaaagtaaattattcattataattccattgtgctgaggacaaacatgaaaattcttctcaaaagtactttcagcatatctcagcttaacccccttagcttcttcattaaatgatgcggtgaaatgctttctctccctataaaggtgtaaggcatacaggccttaacatagtgcctgacgcaaagaaggtactctttattgattaattaattgggaatagaaattttttctattttaagtatcaaattcattcggctaacatattcaattgcttgtagacacacagaaaaagcaaaccttatagggcactgtaacacaaaacacatccttacacagtttctaaaataaactgcatacttccgctgcttctacaaatcacctggatttatacagcttcggagattaggcaaccagagtactccgtttgaaatgtttgcagcatcagacattttatttctgttaaaaaccacttaatgtgtttgtccatttgcatgtcagcatatgcacatagcctgctgaagaattttgcatgatatgtatgtcactagccaatttttaaggaggaaatcaagctattcattgcgtgcaacctaaaaatgtgttttcttctcatcaggagtcaactgagagttcaaatacaacaattgaggatgaagatgtgaaaggtatgatttaaccagaaatggaaaatcctacctcagagcttcacatatatatatgaaaaaaaaagtgcttcaaataactaataagtttaggaagtaggcctatcctaaagcacaaaaatattttatttatgagtaaaaaatatttttataagtacataattatttcaacaatatgttacttttgtcatttttcctacatattcttttatatattttgaactgtagacatgtagcatattctagcacattgcagtaatgacaactaataatgagttactagttataggaacataacaaattgtaaatttgtcagtcaaaaagtaatataaaatgtatacacattgggtacattcataaaacctatctggaaaacaatttatattcaaggatacagtataaaaataactttttaacttttagtcatctcaaataatatcagtagaattttctatttggccgcctttttatcctagctttttgtgtacattccaaaggtattcttgacctccattcactttggttgccaaggttcttttagctacatgtatgagtcattggtagtgtttctacagacatcttctcagtgcccctgcacacacatactgaacacacatttgcagttaggtcacctcctttggccacatcactgttttagaagtattacttttgtatcaattgcatttgcagttttatgttgtttttgtaattcattatatataactacagtctctatagaccagttgtctagaagatattctgacaaacagcggtaacagtaggatatttgaaacagaaatattaaaggaaaagaaatataaattgggagcaatgatccataaattaattaaacctcatctgaaaagattactgacctaatagtatcaccataagctttaattctaaaggtagtgttaatacaataaagtcttgtaaagttgtattcatattttagaataaaggatttggaaattctcaggtcaaggagacgtggggtcaatttaggaaataaaaatggctgtagatcacaacttggcagtcagctctgctgactttttcctttttgtttgaatagaacagctgatgctgttaaagtgtactctctatttatataactaagcacactgacctaactctgctagaggtagtcagtcattttttacagtggaaaggtagatagctgtgtcaagaattttatttagtaggtctattcatctcactctttgcacttaagctaaaatttgaactgaagtagttttatgaatcattgataccagtcatattagataaaaatattctttttttttagccaaataaatagatatgccatttagctttcccactgattcaggaagcattatctttgtgttttggattcattagctctttaagctaagctaaatgtttcatatgaattttcacattcttcccttgagcaagactaagaaaacttgttcattgtccactggagaaactgaatctttaaataaccaaataaaattaggagaataccagcaccttactatatgcagttcatctgccaaggaacgtaatcatgagaagggttttaataagtggtctttctcacctgaatttggcactcaactgtactaagtattggttcaggatcattgctattaatctatgtaaacattaatgtataaacagagttcctgtcagtgttaccttgtagtttgtaatttatttttgataaaatgaaataataatatcagttcttagaaaacagttctccaattcaaatcataacaatgatatgggtttcatcttgcctctgggatttcataaattgagatagtatttgtatttataattacattgagtctgtatacaagtattagaggaattcagcatcatattgagatcaaaagaaatgtccagttgatcgtttaacccaaagtgcttagctttattaccttaataaatacattatttaagtttctgcttaattttgctggtgtggatctggccaaaaatgtcataaccatagcccattaggactcatttgtgttctctgtaagacccagacagccttctggagactaacccttttaatattgaatgatatcagaaacctttaagactagaagacactttgaaagattgcctaggccccatcatttttactgggacaagtggtagataaaatggtcttaagtgattttaaattatttattatgctgatgatctgtttgtgtgggaatctctccatttatcagtgcatggtcctcaagaaagaccctatatgtgaataattatgctctcttatttttactttagaattgctgtggctctcagtagcttggtagggaatgtgtttattgtccagctctgttgaaaccaaaatttacctatatctaacattctataactaacatccaagaactcacaattactatcagttaaataatctgaccaaaactgtatcccatctacaaaaccatgtcatatctacaaaactgtgtcttccacacacatacttttcaaccttctcttttctgtagacaacattgtgatcagtgagacaccacactttttgacatattcttaaaggcatacccccatacatacttctgcatgcgagcacttgctctacccattgctgctggctgtcccagctatagtgcatctaacaccagcacctagacttacattgttttatggtggtatatgattccttgaataccatgtcacatgcctcccataccaaggcagtgcacattctgccccatccccaaggactaacctggcagggacagcttctgtgtcctctccaatgtaaagaaacatggagttgctggaggaggggattaaacactgtggtaacccggtcaaaggaagaaatgaggtaaactaacaacaaagtttttctttctggcgtctttgaatgggaaaaggcagacaaggccagctgttctcaaagaaagataaaagaaagcaaaagtagtcagagattaatggttcctcagtctggagcaccttagaaagccaagatttaaaggcccattttccttcagctcttctaattagtttccattgagaaatcatgtccccagtctgtgtaatacttttgaattgtgtctaggctgtttcttcattcagcaaatatttattgaatcccttctctttacctgacttccatgtgcttctctttttgaactagccatgttcaagagatttgaatgcaccagagtcaaaatgctgtttcctaccctttatatgaatcttgttatgctataatgtaggcccatttatcttacttaatacaataactatcaagaaaaattagtgaaacccaacatatatgcatgttttacctaaaaaaaaaaaaactcagtgaaacccaggaaaaaagtgagacccaaaataaatacatttttttaaatctaaaagttcttttatttcctttttcttaaaaaccttcaacatttagctctaaccacatttttcttcccaagctcgtaatcatcccaagggactggcattgttttacaactcttctttttaaaaagcttccagagttcattgttttctttctccaaggcaatgtgttgacaccctagtgttgacctcttgagcagctttctaattttgttcagtgtttaaaaccaaatattatctctgatgatgctatgtcaggaaactcagcagcaaactcagtgtcatggagagttactaatagtttaaaagcaaatgggagtctgggagtggtggctcatacctgtaatcccagcactttcggaggctgaggcaggcagatcccttgaggtcaggagtccaagactagcctgaccgacatggtgaaaccctgtctccactaaaaatacaaaaattagctgggcactgtggtacgcgcctgtaatcccagcaactcgggaggctgaggcatgagaatcacttgaacccggtgggtggagattgcagtgagccgagattgtgcctctgcactccagcctgggtgacagagtgagactttgctttaaaaaaaaaaaaaaaaaaaagcaaatgggagtcccaataaagcataattaccatcatggaagcactgtggtaacaactgcccatcctatataagaaaaaaagttttcttcttacaactaactggtgttttcaaaatatacaattctttaggccaaaaattgttgaaatagtcatttccatttttaatcaatttccagtaaaacagctacttccattgatttaaggtgttatccaacagctgtcatcattagctcttaattagcagttaacagtacaaactgcactcctcgccaggggtgtgggtgtgcctagagtcagtgatgtgtagcagtagttctttccacactgtatacatgtgaagaccgtcctttggtttgtggctgtagccacagtttgcaggacctgtcgctgtatgccgcaatgcctctccgcctcataacccatccagcaccattgttcagagtcacccacttcctcctgatgggtacatgtccatatggtccatctgcttatgtttcccagcattcttgtgcagcacctgttgaagttgggctcctgtatgcccttgtgtcatttctgtcaccatcctgtttccagtatctcacttcagctcaccattcaccacgagcttggatctcttgctgcatttcatccttcttacacatctaggaaagtggagccctttacaacaagcagattctatggctatgagactgtgtgtggagacttcatccttcttgaattcctttttacttttcctgattactaggtagtagtaatgaggatgtttgcaaaagtctcaattaaggacaaagttgttggcacccttattacttgaatggtgattcatgtttgatgacctggatatcgtggtctcagctaatttatagaatcacttgattaatgagctctctgtgtgggtcttctataaatatgtacattagtgaatagtatgatgactgattacccagattcaactattcttaagttctgtttgatcactgaaaaccttcttttctgtgtggggtttcctaaggcagatgatctcatggtactgatcttcttggtatctacatgtaatttatatttcaggacttgtcttgcatacatttctcacttccagaaaaatctgcaaattaagaaactcttgggtattttattgagggacttttgataattatgtcattccattaggttaaaaatatcttagaggaaactgtagtgtagtgtataataacttctttcaggtttctaatccaaaatttgattttacaacaagtttacttagaaaaattactggggggaggagccaagatggccgaataggaacaactctggtctacagctcccagcttgagcgacgcagaagacgggtgatttctgcatttccatctgaggtaccgggttcatctcactagggagtgccagacagtgggcgcaggtcagtgggtgcgcgcaccgtgcgtgagccgaagcagggcaaggcattgcctcacttgggaagcgcaaggggtcagggagttccctttctgagtcaaagaaaggggttacagacgggacctggaaaatcgggtcactcctaccggaatactgcgcttttccgacgggcttaaaaaacggcgcaccaggagattatatcccgcacctggctcggagggtcctacgcccacggagtctccctgattgctagcacagcagtctgagatcaaactgcaaggcggcagccgaggctgggggaggggcgcccgccattgcccaggcttccttaggtaaacaaagcagccgggaagctcgaactgggtggagcccaccacagctcaaggaggcctgcctgcctctgtaggctccacctctgggggcaggacacagacaaacaaaaagacagcagtaatctctgcagacttaaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcacactgacacctcacacggcagggtactccaacagacctgcagctgagggtcctctctgttagaaggaaaactaacaaacagaaaggacttccacaccagaagtccatctgtatatcaccatcatcaaagaccaaaagtagataaaaccacaaagttggggaaaaaacagaaaagaaaaactggaaactctaaaaagcagagtgcctctcctcctccaaaggaacgcagttcctcaccagcaacggaacaaagctggatggagaatgactttgacgagctgagagaaggcttcagatgatcaaattactctgagctacgggaggacattcaaaccaaaggcaaagaagttgaaaactttgaaaaaaatttagaagaaggtataactagaataaccaatacagagaagtgcttaaaggagctgatggagctgaaaaccaaggctcaagaactacgtgaagaatgcagaagcctcaggagccgatgcgatcaactggaagaaagggtgtcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctggcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggtcaccctcaaagggaagcccatcagactaacagctgatctctcggcagaaaccctacaagccagaagagagtaggggccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagttcctgaaggaagcactaaacatggaaaggaacaaccggtaccagccactgcaaaatcatgcctaaatgtaaagaccatcgagactaggaagaaactgcatcaactaacgagcaaaataaccagctaacatcataatgacaggatcaaattcacacataacaatattcactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagaaacttagactcccacacattaataatgggagactttaacaccccactctcaacattagacagatcaacgagacagaaagtcaacaaggataaccaggaattgaactcagctctgcaccaagtggacctaatagacatctacagaactctccaccccaaatcaacagaatatacatttttttcagcaccacaccacacctattccaaaattgaccacatagttggaagtgaagctctcctcagcaaatgtaaaagaacagaaattataacaaactatctctcagaccacagtgcaatcaaactcgatctcaggattaagaatctcactcaaaaccgctcaactacatggaaactgaacaacctgctcctgaatgactactgggtacatagtgaaatgaaggcagaaataaagatgttctttgaaaccaacgagaacaaagacacaacataccagaatctctgggacacattcaaagcagtgtgtagagggaaatttatagcactaaatgccaaaaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaccctttaaaaaattaatgaatccaggagctggttttttgaaaggatcaacaaaattgatagaccgctaggaagactaataaagaaaaaaagagagaagaatcaaatagacgcaataaaaaatgataaaggggatatcaccaccgatcccacagaaatagaaactaccatcagagaatactacaaacagctctacgcaaataaactagaaaatctagaagaaatggataaattcctggacacatacaccctcccaagactaaaccaggaagaagttgaatctctgaatagaccaataacaggctctgaaattgtggcaataatcaatagtttaccaaccaaaaagagtccaggaccagatggattcacagccgaattctaccagaggtacgaggaggaactggtaccattccttctgaaactattccaatcaatagaaaaagagggaatcctccctaactcattttgaggccaacatcattctgataccaaagccaggcagagacacaacaaaaaaagagaattttagaccaatatccttgatgaacattgatgcaaaaatcctcaataaaatactggcaaaacgaatccagcagcacgtcaaaaagcttatccaccatgatcaagtgggcttcatccctgggatgcaaggctggttcaatatacgcaaatcaataaatgtaatccagcatatacacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaacctggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcctgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatgaccatactgcccaaggtaatttacagattcaatgccatcctcatgaagctaccaatgcctttcttcacagaattggaaaaaactactttaaagttcatatgaaccaaaacagagcccgcatcgccaagtcagtcctaagccaagagaacaaagctggaggcatcacactacctgacttcaaactatactacaaggctacagtaaccaaaacagcgtggtactggtaccaaaacagagatatagatcaatggaacagaacagagccctcagaaataacgccgcatatctacaactatctgatctttgacaaacctgagaaaaacaagcaatggggaaaggattccctattgaataaatggtgctgggaaaactggctagccatatgtagaaagctgaaactggatcccttccttacaccttgtacaaaaatcaattcaagatggattaaagacttaaacgttagacctaaaaccataaaacccctagaagaaaacctaggcattaccattcacgacataagcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaaccttctcatctgacaaagggctaatatccagaatctacaatgaactcaaacacatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaattctttgcagccataaaaaaatgatgagttcatgtcctttgtagggacatggatgaaattggaaatcatcattctcagtaaactatcgcaagaacaaaaaaccaaacaccgcatattctcactcataggtgggaattgaactatgagatcacatagacacaggaaggggactatcacactctggggactgttgtggggtggggggaggggggagggatagcatcgggagatatacctaatgctagatgacgagttagtgggtgcagcgcaccagcatggcacatgtatacatatgtaactaacctgcacgatgtgcacatgtaccctaaaacttaaagtataataaaaaaaaaagaaaaattactgtccgcatatactacctgctgattttttaagtgttgtatcagaattagtaacttatatgactgatgcagaatttattctattccaccactaatgtaacacagtttcattttctctatttttatatatttcttctattttacctctatactcaatttttctctttattgcttgagtcctgccaagttatcctaagttttcagtgataacctcaagcttgtttagctctgctaacaaaatacagggtcaaactgttgccaaccccattttaaaacaaggtccaaaatcaagacaaatggaaccaacaaacaaaaacatgtaacttctcattttaacattaggaaaacatcagctcactctatagtaataaagtttttctgctcaaaatttctataaatagcttttcttgtgagtttgtgaaaccctgtaatgagttttagaactatccacagcaaaaataatgtagcattgttttataaaaaactacataaactctaaaggcatatatatgttgtaagatttcttccatcagattctaaactttgattgagctatcaatcagtttttaaactgtgaattcactttaagaattaactttaagaattcagagtttaaaaacctgacatttacccacttatacctactgttccattatcgaaacgctaagcatgtgagagttatttatatcctactgctcaaggtcatcgctaaggtctgattttccactcacgcaaaaattcaaaaaattgcaacctccagcataaatgggttaactattcatagatattactttatgtgggagttaaaaatacaagaggtaatcagactcacactttgtgtaatcaaaaatttcatagttatccaaatataatttactttataatatagttacataaatgttgattataaaactttctcatttttgttcatgtatctatttttttcccattacctaacaaaaattgtccaatttaataagctactaaatctaaggtttgtgtaaattttaaaatattattccttctatcttctttattttttcagattatggctttatcactttttttaagtgatgtaaaatataaaatgtcagcaaggatctgatttgaatctgaaatctatatttgagcaagttacataatttacctgtggctcaggtttcctcataacagcagaatgtagatattgaaatcaataatacagacttttaagctctttttctactctactgtgatgcaatactattaatagattattgtaagatctctttatataaaatgatacattctaatacatattattataaaacaattagatgttaataatataaactattcaagcagtcacagaaagacatttaactcaaagtttaaagaaacaatacactgctacagttttaggaaatcttattaaaactgggaaaaaatggtgttcaccaacctgaatatccaaaatgttatcaatagcactataggactataaagttactactttaaacacattccagtgagaattattatgaggtcaaattttatgtttctaaagtttccatacaaaatttctttaatatctaaaattaaattaatatttgagctcattcatttctatatagaagttaaatcctaattatttgctatgtttttcttaactatgaattttatgtaattctgaaattatttattagagtaaaataattgcttgagtgaaataatgtctcctttgctgagtttgtattattttataccaataaatatatctataaattatgtaaagttatatgtctatatcatgattctttttgtgagtaagtggagtggccctaattttattttctgctatggatttctgctataacccccttgatttggtcaggaggaattaggtctaaagtatttaagaaattaatctcaatcctgtgcaattttaatatcccaccaggttacaggtgattttatctcaagctaatatgatagatgataaagtaaggaaaagcaagatattagcaagtgaaagcagagaagacattattcagtgaggagcttaatgaaagagcttgtgtagaaataaagaatttttatttttcacatccgaaacagtggtattttcacttttcaatttagtgcaacaaatattttatgaacacctgtaatgtatagtcttctaactagactctagaagatttagaaaagaaagatgattctacaagataatgttgcaggcaaagacacaaatgattgagagagtttcaaacggactgggctaattctgagtggattatagggactgtattctagcataaatcaatagagagtgaatcgtgatcaatagcacttaactaaactacaatagttgtgttcagtccagggagggaaactcaacaaggcagctttcctaaacatttccaagctttgttgttatattaaaaaataatttaacagcattggctatcatgtaagtatagcatcaggaagcagagattgggtataagaaaaacataaacatgccaaggattcaggcttaatattcttgtacttggaggtatttttggccataaagtaaaaatgcaatcaatgtattggatagatgtaatggcacacattttctgtctgtgtctttgctgtgagttttcctttccaaagttctgcaatatattaaaactgaaatattgagttttcttaatagttctgaggtaagaaaagattataatcacccaagcccagtggctcatacccgtaatcccaacattttgggatgctgaggccagaggatcttttgaggccaggagtttgagaccagcctcggcaatataacaagaccccatctctacaaaaaaagaatttataaaaattaggcatggtggcacacacctgtagtcccacctactcgagaggctgaggcaagaggaggccaggagttcaataccacagcgagctatgactgcactactgcactcactccagcctggatgacagagctagactctgtctcttaaaaaaaaaaaaatcaaaggaggaactacttaatctcttttttgtgactttcttctgaaaattgagtttatagaaagctggtctaatctgagagagttcattcactcttcatatctcttcaccaatggtcattctgaaaggactcctcaaagataaaactcctgaacttagctttaaaggggaaggtactattaaccaggtgaagaaggtgcgagaggagaaacattaccaatagaaggcacagaaacaaagcatggtatgtctgaggtattgcaggcagtcaggatattactgaagaatgaaatgcaagttggagagtggtagcagatcaagcttgagaggagggaaggtgctagttatgggagcattgagccatatgaaggagcttgagctgatctaatattaagagatgagaggcatacatcatagacaaggatgattctgcaagataatgtaccaagcacctgaggaatatcagaaagttttaagcagaggaaagatgtggtaagatgtccataggtagaacactctggtgattctgtggcatatgtatttgaaggctataagaccaaagatggttagaccagttttaagactatgtctaaagggagatacatggtcaagggagggttgagttttgttttgtttatgttttaggatgaatgagtctagatcaagtttgtaggctaatgataaaggacaagtaggcatgaagaaatttgctgatcatttttacatttatttagtaagttactctttcagcaaatatttagtgagggactattgagtgccaagccctgttaaaagcgctggatattcagaggcaacaacatagataggatttcaactttcatgaaagttagattttagtgggcagaaatagctaataaacaaggctcatagtttctaccaaagacttacccttgggataaaaatgatcacagagtagctaaagactttaccttacattatcctgattaaaaactccatttgttaagtaggtcttattaacccagtctttcaaaagaacaatctgaagcttagagaggttaaatcatataaccactaagtgctttaacaggagctgggatcatgctttgaaccactgcactgaaccacgtggggatttatggaatccctcagccctcacattactccaatattatatcgtatgcatttaataatatgtaaaagtattccagaaaggttagtggcaaagacacttgccagggaggttttctatcaaacatgaagacttccaagttaggtagcacagtctaatcttacatctgcaggaatcatcttttgctcctgggatcaggtatgaggtcctaaataatgaggaaagatgaaacataattcaggataatagcttatcttttgtaaagagcccccaaagaaccttaaaaccatttctgcttataaagtttagctctaaggctataaaggaatgtgttgacttgattgataacagcatgttatttgtcagtttttgtgaagttaattctactgaatagaaccaattggtgtcttgcatctatatataaaatgctgtaccattgtatttgtaaaacattttaccactatgttttagggcttttttaaaaaatctcatttaatctgtacagcaagcttgtaaaatcaagaaatacaataaagaagggactcaggacattgcaactatgtttgcaatgtcctgagatctggaatcatataagcagagatctggaatcatactagccctaatggcctcctttcagagaagatcaagcactttgacaggaattagggatctagactcattcttagagagagatagagacattttaaagctattcctggactagtcatctataagagaagtggaaaaaggactataaattgctctttaggaattagacattgggttactaaattccatggctgggtagaagggatgaggcttgtgaatatcacaatggaaccaggacccaggatgggagtgggtaagaaagggaagtttggatagaatgggtatatagggaaaggtcttagcttgttgtgtaaaatgtgtaattttcaacaagtctgtaattaaattctttgtttcagaatgccccacagatttcatgagtctctcggtatcttccctacctaacacaaaattcagattcttagtaaaatatccataaagtgactctgtttacttgacttaaccaattattgcttatatggaaacagacattctcatagatgcacccctttttcatttaaataaaaattgggcattttctttacaccttccacattagttcccttatgtatttctgcttctgattttgaccttttactgttttctcatttttttattttttagagacagggtctctctctgtcatccaggctggagtgcagtggctaaaacaagaaataatatgtgcattaaaaaaataaatacggccaggcacggtggctcacgcctataatcccagcactttgggaggctgaggcgggtggatcacctggggtccggagtttgagaccaacctggccaatgtggtgaaaacccatctctactcaaaacacgaaaattagccgggtgtggtggtgcatgcttgtaatcccagctactcaggaggctgaggcaagagaatcgcttgaacccgggaggcggaggttgaagtgagccgagattgtgccactgcactccagcctgcgcgacaaaagcaaaactctgtctcaaaaaaaaaaaaagaagcataaggatatagctgctatcatatgtgaacaaacacagaatgcttcagatgaatgtaacacatgatgtaatgcctaacaaagagacctctatttgaaatacttggattcattcatttaaaaacaagaaaaaaagattgagcaccttctgtgtgctgaatatagtaaaatagactgaggctgaaaaggcttagctttttcctaagggagtttttagttttatagtatcctcttcaatgaaattatatctgctagtgcatttcccattccagtgaatagctattttttgcattaaaattttattacatgttaaagtttcttccagagtacatgagtggataaactatcttgcctttgaaactcagtgaattaggtagtctgtctttatttcttttaaaatggaatagcgtaacatttttcccttggccaacgttgttgagcagagtttgccaatccattatatgaaagtgagcaacatgtttagtacaaaaagactgatttaagtattggcattgctatgatttattttactgtggtgaaactaacttctctgccaaagctatattatcccactgattacatatatgtgactacttcagtatccaaaggaaattctttgcaatatgcaaatacctttggatgtttgatttcgtctctttagattagaacaaaatttaaaatctgtgatgagttctgaacatttccaaactactcaattgtgttttctttaaaaacaaatataaaacctctctatacaactattttatttaatataagttatagattaagttatatttttaaatgtcacctccaaagaacatttctctttcatttctcctcacttccatagtactatcagtgcagtctgcactactgcattactcattgcaatactcctgtatagtatgtctcaaccatttttaatatgtttgtgttcaaatgcatctaagaaaactgaattgatatgactatgttatattctagtgcttttaacacaccttcatcatcatccttagtctttctttgtctcctcagtttcttttaatttctttgtctccttagttttgcttataccccacatgcggtctcagaaaatcctactagttcttcaaaatgcacacttttttttggaattgactgctgctcaccaactccattgccatcactctaacttaagatataatcatcttttgctgatattattgacatagcttcttagccattgacctgcttctgcttacagtctattctcaacagagaatagagttacactttcaaaaatacattagatcatgtgctgctcttgctctgtattctccagtggctgccaaagacatcagaatctattaaaaggcctaccatgaccagggctccttcagacatgccttgccttgccatctgacttaatgtcctattattatatgtgcatcaggaacactgtttctgaaatgtatcaagcaggttcctgccacagggccttgcacttactattccatgtctggtatgtcctgatacacatttccatgtggcttactgccctttctctttttaagtctctgaccaaatgttatcaaaagttaccctctctgtgagatcttttactaccttattttaaattacatccctccagactgggcatggtggttcatgcctgtaatcccagcactttgggaggcaggcagatcacttgaggccaggagtttttgagaccagcctggccaacatgacaaaaccccatctctactaaaaatacaacaaaattagccaggtgtggtggtgcatgcctgtaatctcagctacttgggaggctgaggcacaagaatcactggaacttgggaggcagaggttgcagtgaactgagatggcaccactgcactccagcctgggcaacagagtgagactctgtctcaaaaaataaaataaaatgaaaatttacatccctccaaatccagcactccccattctcctgttttacttttctctttatatttattatctgaaatatctattttacttgtttcctgttcctcttccccctactaaaatgtaagtttctgtagagcagagatttttgtctgttttgtttatagccatattcatagtatctagaatagtgttgggcaatagtgggaataataaatatttaattggtagaggaaggaagcatagtggataccaaccatgacatgtcctagcagccactaaaatgatcggaattctcctgaaattgtgatcagtttacaactttttctgtgtaggtttttgtacatataattacctcgctccataatttaggagttaaaaacaccgaaaatgcatgttttaaaagtgtcttagtccatttgtgatgctataacaaaatatcacagactgggtaatttataaatagtagaaatttatttttcacagttttggaggctggaaagtctaagatcaaggtgccagcagacttgatgtctggtgaacgcttgctctctgctttaaaaatggcacctcttgctgtgtcttcacatggcagaaggaatggaagggactagccaatccctcaagccctttttttgtttttgaagaggagtctcaccctgtcacccaggttggagtgcagtggcacaatctcagctcactgcaacctccgcctgctaggttcaagcaattatcctgcctcagactcccgagtagctgggattacaggcacccgccaccgtgcagagctaatttttgtatttttagtagagacaaggtttcaccatgtttgccaagctagtttcgaactcctgacctcaagtgatccgcccaccttggtctcccaaagtgctgggattacagatgtgagccactgcacccggccctcaagcccttttataagggcactagtccccttctaataaccactcaagggccccacctgttaataccatcaatgtttggtattaaggtgcaacatggactttgtagggacgcatacattcatatcatagcattaagtcataggatgttttttcctattggaatggaggacgcgctttggtgtcaaatatactagatttgaatcccagcccagctctccattgaatatgcattctgactgctcatgtaaaccattctgagtcatatgtacaatagggataataatatgtcaatgctggccgggtgcggtagttcacgcctgtaattctagcactttgggaggccgaggcgggcggattacctgaactcaggagttcgagacaagcctgggcaacacagtgaaaccctgtctctactaaaatacaaaagaaattagccggtgtggcggcatgcacctgtagtcccagctactcaggaggctgaggcaggagaattgctggaacccgggaggcagaggttgcagtgagccaagatcccgccactgcaccccaacctgggcgacagagttagactccatctctaaaacaaaaataataataatatgtcaatacctaaccattttttacctacaaaagtaatttcatatggctcaacctgaaaataataataacaataagagagcatactcatgttgaatagtgatacaatctattaaatgcctagtataattcctggcccatgatttaaaacagtccataaatccagagagaactgtgtgtgtgtttttaaacatcgtttctattttctgaaacatttattttagataagtaggtataaatgttaagacccacatccagccaacctatgtgcataaatacccaaactacataaagctgcccaagtgcagaaaacaagttcatttttgctttaaaatcgaaactgatggtttttttaaagtgtttgtgaagatgacggtgttcttttaactcattatgaattttaaacaattaaagtattttagttcactacttttggcctccatagtaccatataataggcacttaatagattaatgaattaattatgaggtttctacattaattctgagttgagacatattttgtacttattaaacatgttttaagtaataactcaaagtcatccctcatttgaagtagtccttttatctctggatatgttcaactgttttgaaaaattggctcaattttgcctgtgtcttgattatcactgctgagaggaaaagaaaaatatgtagactgattgttttccacaaaagtaaaatgtgaatttaaaaaggagcatatctatgcaaaattacttaaacacttctcaagcaaaatatctcaagaacgataacatataatgtcccttttagaaattgtgattacccggttcagtgtttcctcaaaagaaactaactatcttgatagaagttaacagattaaatgtgaaagacctatgatttgtttttgaattgactgtgtacaggatcattggtttctttattaacatcactgcatgtggttatttacagcatgtctgtctggcaaaacacagatggtaaatgttatggagagaatttggatttcaggaaaagttgggataatagacaaaaacttataccattatgtgttttcaaatttaaaaagaaagaaaaaaaaatcctgctccaaatgtcattttttttacaattgtacaatttgaattaggaaatgttttccactggagaaaataatgttttggggccgtgagtattttaagtagagtatttttactccatgcctaggccacttcacacagaattatagcattctgattaaacattgtaccacattacacaaagttaagctacacaaaaatgtaaacatattactaaacagtaaagaaatacctctggaaaggttaatggtccgtaatgacagaaaaaataacttacttccaaaagagtgttgtgattttttaagtggtattttgaccaatgtaggaagagtgtgagcatatgagattgtatatttaagtctctcttcaagaaatagaagctcttcactcataatctttataagaagagagaagcctaagaaggaacttagggctatttaaatatatgaagagttaataaacatgaaatgtgtttacctgtcactgagaataaaactaacaaaaacacatttgtttgagatgtgtgtaaacatctgtacctgagttggtattctttaaatctgtactacaattttgtaacaggagcagtgttgtaagttattgaggaatttcatcatctgggttagttaaattaacctcacttcggtaagtgctgtgtggttgtaatctgactatgcaagtgccagcgataacctttgtagtcattctcagtagtcatcctctctgaaacctccaagtcaatattttcatgttatctccagtttttttttaatgtaaaattcttactattgtcttaatctcagttcatataatataaatgcagatttcctaagtgtggaatattaattacttattaagtaacttgaatggtgtctttgaagactgttcatcttttgaaggagtcatactcacaaatatgtatctactatacattaaattttgaaataaattcataatttatggtaatttacatttataatacatgttggaataaatgagaatacataatatgttgttggttctgaaatatatggctcataaatttaatttttactgcagttgcattggttaaactaagaacacctttactggacctgtaaaactgggccccaatattctttttttttttttttttgagacagagtctcactctgttgcccaggctggagtgcagtggcacaatctcggctcacttcaacctccaccacccacgttcaagcaattctcctgcctcagcctcccgagtagctgggactacaggcacccaccaccacacctggctaatttttgtatttttagtagagatagggctttaccatggtggccaggctggtctcgaactcctgacctcaagtgatccattcacctcagcctcccaaagtgctgggattacaggcatgggccactgcacctggccaactgggccccaatatttcaacaagaatttttaaattaattatctaagctgaatttagaggcaaatatcccagagctaaactgattatacagtaccaatgtgaggtatcctttattaaaaagcatgtgttactgtgaatcatttagtaatttctggtatgataggatatttttaacttcccaaagtaagctttaaccaatgtagtaactaagcacggaaatggctcttgggcctacgagtcttatcattgctttcaaatgcatgacgacattggaagagttataggcattcacatgggtacagcccaatggattcttctcatctgctgtacagataaggccaatacactgagacagtgatgttgcagtagagaaacagtttagttattgcagggcatccaagcaggaagacaggacatgtttctgaaatctgcctctctgagaacttggaggcttgggttgttaaggataatttggcaggcagggggctagggaaagggtgctgctgattggttgggaatgaaatcataggtgtgtcagaactgtcttcatgtgctgagttagtttctgggtgggggttgcaggaccggttgagtcagttcctttgtatgagtcacatacaaagggtggcatcagttggttcaccagaatgcaaaagtctgaaaaatatctcaaagaccaatcttaggttttacattagtaatgttatctattaggggtaattgaagaagttatatatcttgtgacctccaggtacatgactcctgatcagtaagcaaactagggaacaatagctggttattgcttaactattcatagatcttagcaaattcaagactctaccataattctaaccttgtggccttttattagttttatgaaggtagtttcagtcctgaacaaggagggggcataattttgggaaaggcctgtaatcatccttgctttaaagttaaaccgtaaagtaaatttctcccatagttggcttggtttacacccaggaatgagcaagggcagttagcttgtgaggttaaaagcaagataaagtcagttatgtcacatttatctcgttgtcgtaatttttgcaaatgcagtttcagcatcactatgtgaatgtgtgtgtggtaaaaatgggaagtataaataattttcctccaaacctaaataagtcttgcaagttgtgacagaccattgtaaatttacacagatttacaatgctgtgccttttcagtccaatggtctgacatctgagaaagctacagtaatcatcaaagttgggcatataggcacacatattacgttgagccctggcctttggatctacaatgccatagatgaatgcaacatactcctgacatatcaagaggttctatcattttttcataattttccaaattggaaaaattctccttaattattttatttgtattataaacttttttccactagttccccacttactgttgactacagatgctttagtagttttaaacaatgaatgggaggagactgattttcccatatgttttgtaaattggcctttcttcttcccacttcactgaagataatctgcccttgcagattatcttttattgattcagggagctatggactggatagtgatggactttgtaatgaaagcacaagctactatttttgcagctgctgaagataagaataagctagaaaacatgaaagtacaatgatcggagatgctgctgcatattcctgtgtagtaaaagatctgctttgttatctggacagtctcttccagaagaagagacttcttgagtcaaaataagataagaagtatgcaacacaaagaagtgaaatgacattcttacagttgaaatattcatactatgttagttggtaaaactgcttagcttctacctcattgaggcaacattggtgtgagaaacactgaaatatgactgagagcctacactagcaagaagatggggggaagatacctttaaaaagatcacttggagttcaataattatggatgcataataacattttgagtactcttaatatagtcagcctagttctttctcaaaaaataaattcaaggacataacagttcagttgatactatggaattttgtttgtttgtttgtttgttagttattcaaaaccagcaaagggatatgatgcttatttggtagagaggacatgctcttcagctctttctgccttcttgatccaagaaagcattcacaaatttaccagtttatttactcaggaaaatgtggctataaatgaatttacccaggaataaactaaattctattatttactaagttcaaatagtatacttttcataaagggatgaaatcagttattgaaaagaagctaaattaattgtaagctaaacaacagcaactgaaatcactgaaagaaattaaaacctactatcatgactgtaaaggattttaaccattctcactttttatatttctagctattaatactgaagggaggacagaatattaacactttgaaattaactctccgccaggcacggtggctcacgcctgtaatcccagcactttgggaggtcgaggcgggcagatcacctgaggtcaggagttcaagaccagcatggccaacatggtgaaaccctgtctctactaaaaatacaaaaattagctgggtgtggtggcaggcacctgtaatcccagctactctggaggctgagacaggagaatcgcttgaacccgggaggtggaggttgcagtgagccgagatcacacctttgcactccagcctgggggacaagagcaaaacttcttctcaaaaaataaacaaataaataaataaataaactcttgacctgaaagatatatgctccgttttgactaatataaaattgattagcagagttagttgaaatcattacagcacccaggggcagctggattgctttcatgaccaaaaaaaaaaaaaaaaaaaaaaaaaaaggccaaaaaggactttccaaatattttaaaactttatgactaattggtctcattgtctcttttccacgtctgaatttttttctttcaagaaaataactgtggccatcaccttggttacacagtggagagaagagatacccttagagaatgcttagaacatctctgatcatgcaaatgtgtaaacttgaatgccaagagactttataatcttaaatctgagcagaggatgtgagtctttgacccgtttcttaaaatctttttcttccatgtcatcaactcttaactggaaatggtaccacacctatgtgattcatggaacatcttaatacttgaaatactcaatggtattcacaatgctgtgctatttctagcttctgcaagtcagctgggggtggcagaatagttacccaattactttaatgtggctagagtgaattctttcacataagcaaatgttctgtgtaatcatagtttctttagactctaaaacatttatttaagtcattttttaatgaaaatctttataaatactttatacctcctttaatttaatagtaaatattttatttccatttccggtcaaaggtaattttaggaataacatgaccatattttactgtaacccgtgatatccttgcaaactaaaaaaaacataaacctatttgtacttattctaaatgatcccaatgctagatctttctgatcttaaagatttgttaattatttattattaggctatagcaatttaacagggctaagactgatattacttcttccccagttaactatcattttgtactatgaaactactctgcattatatagcaaagttcaaagatggtttgaataatttatttattttttttaatcctgaaagcctctagtaattaaagggtgaaaagttgatgttattcaacaggtgacttctggataaaagaggtttacagtaaacattcgtgaatagaaatttagtaattgccaggtcttatatttgaataaaatattaaatcactcaactttagaatctgtgataagtttgattttaaaagccaaaattatgaaaattcctctccccaacattaactgctacatcagtctagtgaagtaaaaataaagtcacagagaaacaagccgctaattgcacagagaatgccaaatataactgaattgataggcacctttttctgtaaaactaccaagagcataatttgtatagttgcctaaaatagtaactattcccaagggttaattttgttaatggcagcatggaaaaagacaataaaaccacggggcacccagttgtgtgaaattgatgtaataattaattacacccttagcctagtaattaagtagtcagtcaccttgccagagtaagttcaaaggcatttaggtggttcatttaagtttatgatttcaaaatattgaagtaaagcactgtgggctggaaaggaacatagatcagtgaattgaacagcagaggggaaccttagccaaataaagctctaaccctggcacagcctctgaatttgctagatgacttgagcaagtcacttaacctccttgtccttcaagtctctgacagccaagtacccaataacctgtaagaaatgtagaaagaaggatttaaattaaatagaactagacatattaagaaagtaaataaatagaattgctaacttaagatgatacaaaaattgttgctatataacaattttaattgcacagcttttgatcattgaataagtgctttttaggcacaattcactaaaagatttcaacatatgacactctgcaaacatcccagtgaagacacatttgcaggtataaattcagtttattttgtggtccaagtttcattgtagtcagctagacctctcaatagggcttatcatcaagtagtttcacttcaatgaactgattaatccaaaatctaaacaactgaaaagctcaagctcaaatactagaatttctttgcactcaaccctcttgaaaagaaatattaaatgtaaacattgactagaagtatctggtttatcttactaaacttttaagattaaatctgctgctattccggcatctgaaatactgcagcctcataaactttggtcctgatgcagactctgaagtatccaaggtgccttctcagcaccgccacatccaaactgctatcatacatgataattgtctacatacttgcatttatctagtgatttaaaatgtacacagtattttatatatattgtctaaccatatactgatatttattcatacatgcatgcatttatggacgttgactcagtactaggtgttcagactataaactggtcaagttctagttagatatatgaacatcccgtgataatgcagtaagatcaaagtaacgtaaagtagctgggtctgaagcacgcaggaagagcaatacagacaaagtgacacttgagcaaggtattgaaaaagattttcaggcagaagagggagagcttctggcagaaggaaaaatggcaggaaaagtacagttatcaaagagccaggactagctgaggaaaggtgagccccttggtgtggctggagaatatataaaagccctagaggacaaaaagtgtcaagagataaagcaggaaaagtaagaagatctttaaaacagagaactttgggcttcagcttctagaccatgagaggagggggactagaaaccttaaaggggtgggggacaatggcagctctgttctatagagtgatgattctgcaacagtgaggagtgagagaggccggtgtgggagacctgggagcaggaagggtcaggaacttccgagagcctgaatcagagtagtggcagtgagcctagagaggaagaaatggctctgagaaagagttggaagaatgtagaatggctaaagatctatgaggaataaaaagaaaggagatagcaaggcttccagtttgggcagctgagtagattatgatgccactatccaagatgagaaattccagagaggcatcagactttgtgagaaaaatactgaggttcattttgggcaccctgggtctgaaatgccaggacaaattcagatgtttagaatgcagttagaaatatgagcatggagcctagaaagatttaaggtctccgagatagagaattggcagtcttcagcatgcggtcagagccagaggagtgaatgagattgccaagagtaaccaaatgaaataattaagaggctaaggatgtatcctgggaaacatcatcagaagtgctaaggaaaaagaatgatccatggaggattggatatggaaacaaagaaagaattgaatccagaagaaaccccaggttttgagctgggagactggcaaaattgtggtttcattagcaaaaatgagtaagtcaggaaaacaaaggagttcgatgatcagttttagacaagtcaaaaagtgttttctgtcattgtcaataaacgataagacatactactttatacttaaattatttccatttgtcaattttatatttcttaaaggctgtctggttatcaccaaataatgtaccatcatatattttaaaaaggtcattggattgggaatcgaaaccaattgagtttgttctggacctactattcattcaaatacttattaaacatttcctatatgccatgcactgtgttatctgctagagatgcaatggtgcagtaccacccttctagagtaatagagaaaactgattaatcggttacatgcaaataaatatgtaaatacaagtgtactaagtgcttttaaaaatcaggtgccagctatgtatgaattcataacatcgcggggacctgacctaacatgaggctcagggaagactttttttttttttttcttttttttgagacaaagtctcgctctgtcaccaggctggagtgcaatggtgcaatctcagctcactgcaacctccacctaccgggttcaagtgattctcctgcctcagtctcccgagtagctgggactacatgtgcgtgccaccacacctagctaaggtttgtacttttagcagagacggggtttcaccatgttggccaggatggtctcttgacctcgtgatccacccgcctcggcctctccaagtgctgagattacaggcatgagccaccgcgcctggcccagggaaggcatttttgaagaaataatagttgaattgagatctgataaaagaagtaggagcaaaatggggggggtgcagttttccaagaagagaagacagtacatataaagggctggtaataggaggcagaatgtccattttgaattggtaaaacaaaggagcaagagtggattggagaagataaagtcaaagagtctgaatgagtctaatgagatgggcagagtccagattacgcaaggttttgtagtctctcttcaggtacctatcctgagagcagtgagaaggttttagaagagttcaaatagaaggttatctgaagagataggcatttaaaaaaaagaaagagagagagagaggtggttgcattgtagagaacagaatagtgaagagcaaaattggttgcagaaacactaaatcagagggctgttacagagcctggacaagaaatgatgggtgcttatacccagagagagtgggggtgaagaggaaaaaaagtcaaaaagaagaggaaggcaaattcaacagaacttaatggattggcttgaggtgctggatttagggagtcaaatatgatcctcaggtttctttctggcttatgcaactgagagatgatcttgccattcaccaaaatggggatccatggaagagcaagcaggcttgtagtggtggaagttcttaagctcagttcagtatatgttgggtttgaggtccatttgagatacccaaatggaggctcaaaaatagccttgacacatagatctgaaggaagagtctagaaaggaggttaacaatttgggagtcattggaatatagatgactatttaaaacactggtgtacacaggactttagggatgcagcatgagataaggagagggactcaaattgagtctttagaaggaattgaagcatttaatatccaggtagagaaggataacatggcaaatgagaatgagaacatgtagaaaagcaagagagttaagtaaaaggagagtgttccaagacaagaaggtgggaaggagtgatcagcaaactccatacctttgggcaatgcgcataatccctttatttatctgttaaaccaagaaataatcactgcattcctgagtattgttatagtaaccaaatctaatgtttgaggaaatgttgaaatctgtaagttgttttattatgtagttactctcagttcttgggttttattttgttttcaaacactgggatcattcacacccttatcttactcttccaggcctcttagaacaagagccaaaaatatatgaatttgaaagggaaaatgttcccaattctttgtgcataattgcatggaaagtaattccactcagaacctggaacatctctcccacttggttttctctttttccttttcctaagaatctagaaatcgccagaaagtactttgtgtcctatgagtataggcttgagcacttcagttctagaaataaacctagtaggtaaacagcttcctgcgattaaatggctagctctggagtggaagaagcttctggtattcagggaacaccttactggtacattctgcattcatcgtggtataattagggacacatcacaagctctccactttgacttttggagtggttatttattacttggtgttcaggaagagggaaggccagatgagaatggaccccctccccacacaacttgtctgtccaagccactgacacagtaactgttcctcaacctcactgctgattgagagtagagctagctaacaccaaaccctcgctcttcctctaggtcagatgctgggcttgtggcaacagttccaacaacaagctgactactatatacaaatgattcatttccagccttctgctttcctttaaagagtcagctgtcatgtgccgcctgtgactcactcaagctcctttgccccagtgaaataagcactctaaagattcctgagttccaggcccctcctaagccaaacgagtcacattgtttttatggtgatacagcacagaagcatcctggctaattcccatttgttgtcctgccagcaaaagcaccatcgtttctaagcataagaagtgagagaaggcaatttgtgttgctttgtttatgcaggacaacccttaagccagttgtggcatgcaaaatacttaagagtgaatgcgtatttccacagtggttcagaaagtaaaagatggccatatacacccgatgattctaattccatattatgcttgtgaggcagtgcagagactttcagaaactttaggaagtgatcctaaactcttcacactctataaactgaagcctaccctaatgaagctccacgaaggacgttgatcttatgctcatttcaaattggccatgttttctaaactgtagtttttcctatcagctgtatatcagaccaaaaaaaaaaatctgttagtttgaaatgaggatttcatgtgagagagaagttttggtggccacatttttataatctcattttctgagatcctcctcacccgtatcccttatattccagaatcgggtcagctgtcattagcttttgccaaatgttcatactgttgagggcacagacagatgaatcacctattgcctaactgaattaagctaaaatgtgtcactggcaggatccttattacaaaatcatgccctgataccacttctgtcactatgttttgctgttgaatgtattattgatattcatcaatcaaatgagcaagggcaagaaatgttttggacttctgtaggagctgtgttatattactttatataaatgaaaagtaattatgtaactaaatatgaattctaacccatatagtgattttttaatattatagaccttgacattgttagcaaccatattatggactaacttaatcacattttataggatagtttattacttgtatttgttatgatatagtctcatatagtctcgatgaagtaaaatgtggtttatagaaaatttatttttaaataatgtcatcacctaggtaacctgaagtttcagagtgaaagtaagcatttaagcttgtggttaaaatctgcttgatgaagatcagattcataaaaaatgcaaactggtttctttagtcaataaagaataaaacctgaggtcagctttcttcgtgatcaatagcctcactacctcagtaagataagatgggaagtaacattttgtgattcccagtctatgttcagtgattttaagggaatatcgcaatattcttaaaatccagtaaaatttgatttctaaaatatttcatgcagtaattttataaataagagaacagtgttctgaaatcaagaaaagtttattagtctcaattgattaaattcacaaacattgagcatctattccataaaagacactgaacaaagctttttaggctatacaagaaaataaaatgttctttgccctcgggaagcttttaagttaacaaggaagacacattacacagtacagaaagtttaataacaatttaaaacaagtaataatgtgttttaaactaaagaaggtatcaagagatagcatatgcataattgccgagtgatacagatgctgcaggctttcaaaaaagagaaagaacacttgaggcagatgtcagtagaaacaaattcactgaatagataggatttgagccaaaccactattaataatttcaccaattatgggctaggaatagaaacaaatcatgattggtgttgggtttgacagctatacctggaggctttcatcttattatctgcctacatctacagtattgattcatatgtcacttcttcaatttgtagagtttactaaaggccatttgtctaaaaacaaaggccagtcacagtgtcggcatccttttgtagagtttgtcaagcagaaaagtgagaaaatgcaaataattatataaagttcaatatctcaatgcaagatatcatctttactctgaagatagacatattattagaatgatactttttaagattgtttttaataacacttgttaactatgaagagaaatatgtttactaatccaatcaagttaaggtagtaaaaactaattttattttattttattttatatttatttatttatttatttatttatttatttttgagacggagttttgctcttgttgcccaggctggagtgcagtggcgtgatctcggctcactgcaacctccacctcccaggttcaagcaattctcttgccacagccttcccaagtagctgggattataggcatgcgccaccaagcccggctaattttgtattttttttttagtagagatgaagtttctccgtgtgggtcaggctggtcttgaactcctgacctcaggtgatccgcccacctcggcctcccaaagtgctgggattacaggcatgagccactttgcccagccttagtaaaaactaattttaaaaaacatagccttgaccgacctttcaggtgactgttgttttcaaacaaatggaaaatagcagtgctttccaaacatgaatgtactcagaggtcacctgagagtcatgttaaaatgcagattctggcagggcacagatcacacctgtaatcccagcactttgggaggcagaggtgggaggatcacttgagcccaggaggtcaaggctgtagggagctgtgattgcgctactgtactccagcatgggtgacagagtgagaccctatctcaaaaattaaaaatgaaaaagaatatttaatatgacttttgtcttttattcttacccaactccatatttttgcctttagcacgaaagcaagagattatcaaagtcactgaacaactgatcgaagctatcaacaatggggactttgaagcctacacgtgagtagcggacgtttactttgctttcatgcatatggtaaatatattttttatatgaatgcattattcaacatgtctgaattcacatatatttaattcaaggtttgatatgttaacaatagttttatttcataaatgactaagtgcccctaggagagaaaaatttcagagaaaatttcagagaaaagatttcagaggccaggcacagtggctcacacctgtaatccttgcactttggaaggccaaggtgggaagactgcttgaggccaagagttcaagaccaacctgggtgacaaaacaagaccccgtttctacaaaaagtttaaaaattagtcaggcatagtggtgcacacctgtagtcccacatacttgggaggctgaggcaggaggatcacctaagcccaggaggtcgaggctgcatggagccatggtcacatcactgcactccagcctgggtgacagagtgagaccctgtctcaaaaaagaaaagaaaaaagatttcacagagagaaggcttgacttctgatccaacgattggagatttctttgtaaatatacagatgtataaccactcccacatcacacatacagaagtccagatgagaaaaggtcagtccaggcagagcaattcatgtgagcaaacacacaaaaaaatatgaaagtacataaaatgtgcatttcagcttaagaaatgttttcccttgcagttctgcagaggttctggggcagagaaagagattaggaggtgacatgaggcagccttctctcttcagccagtacagctcaactttatctgcatctcttttatatgtttgtatcttaaggaaaactttacttgaagaatgggttttaatgcttatttaaagtttataaactcctggatcataggaactatgaaggaaattactttgctgaagttaaaataaagcattcaatttaaatagggccttctccttacaccatgcaactaatgagttccaccccagtgaaagacttaaaatgcaaaacggagattgaatctgatctctggctagaaagatccaaaagctgaagatataatcataaatgagaacataatatgattatacctaaatagataaaacgtgtatactttaattaaaaaaccaagaataaaagagacaaacttagaaaaacatttgcaaaacatatatcaaaatttaattttttatattgcgtgaatatgattgaaaagtagaaaaataggtaaagaacatgaactgactattatcagaggaggaaatataaatgacaagtaaactagtaaaggcatattcatgtttactaattaagtatacacaaacttgaatgcaagagcctcttctccctataaagtcagcagagatgtaaattctgctgatagccagcaaggtgcagatactgcaggacaatggtgactttcctccaccatggaataaaacacaattgggtgcaaactttcagggtggtggtggtggcagatatggggggattagtaatatattttgttgtataatctgttattatatacctgaaagcttttataaagtctcactttactgtaatactataattctacttataagaatttaacaagtataaattttttatgtaaaacatgaacaaaaatttgtgaacaaagatatatactgaagcaaaattcataatagtgaaaaattggaaacaatgtatatgcccaacagtaccattcccattaaatcatctttggtacaatggttatgttgagtttctagcgacctggaaaaatatttatgatgtttttactgaaaattaagcaggacttaaaagactatgtacgtaattattacaactaaaaaagtaaaaggtattaaaagtgccaggtgcgatgtctcacgcctgtaatcctagcgctttgggaggccaaggcaggcagatcacctgaggttggaagttcaagaccagcctgaccagcatggagaaaccccatctctactaaaagtacaaaattagccaggtgtggtggtccatgcctgtaatcccagctacttgggaggctgaggcaggagaatcacttgaacccaggaggcagaggttgcggtgagctgagatcgcaccattgcactccagcctgggcaacaagagtgaaactctttctcaaaaaataaacaaataaataaataaaaagtattaaaagtggaatgaaacatgccaaattagattttaaaaagaaaaaaagaagttgcctctgagaggtaaaattatgtgtgaatttttttcctgcttttttattcttcccaaattttacataagcaagtattacttttatcattagttataaataaacacaaaatataaaatatggacgagattagctaaatgtaagacaaactatatcaggagcttcttcttataacttaaatatgtgtgcatatatgtataaacacatgcatatacttatgtatgagtgtatccattctttatcatgacctaataagacatacttggaataaaagaaatagtaaaaattggagttaagaagaagtctgttttcagagacaaccgttccctattaaacaattgtttatagctgtgccatagaacctgctttttaaaaattcttgttgctgttatatccttgttagatacatatgattatccaaagaataagattattctcttttttaaaaaatcttttttttttgcaatagcatttccttgtggaatgataaaaagttgtgtttgttattgttaaaaagaagttgcctctgagaggtaaaattgtgtatgaatttttttcctgcttcttttatattctttctaaatttataaacagatactactgttatatagggagcaattgtagccaggcaaaagtgtatgtttcctatattctcagtttaaaatagggtattttaaataatgctaaaccttgggatcataccagttcactaatatctttgcctatggagacttataatctggcctgattttgtactttccagccagagctaatccaacagggcttccattcgagagcttttgggatggtagaatgtactggtggatccctgtcagctggtccttagaacacctgttcagatcacacacacccacatgtcaaatggcagctttgtggatctttcattaatacaaagccttttatggggtagatggatgattagatagatagatagatagatagatagatagacagacagacagacagacagacagacagacagacagacagacagacacacacacacacacacacacacacacatttccaaatatactgactctttttcatggctgggtaagaagatccatcatggcacagtgattcccagattatgttagtactgatgtaaggcagtaagaaattttggttcactgataatgacaaccaaaaaccatatttatagaggaagtaatagcccctggcagaataaattcttgttaccataggaacgctgttcttcccattttgcttcttagaaagagactatatatatttgattttaagcttaaaaatgcctgcccagcaggcaatctgaagtgaaggttactgtaatccttgcccccatcatctttaaggcacaaaggatatccactgtgatttctactttttaaaggtattctttaaataacaccggttccacgttctataaacagtactgcactttgaggaactacagtgagttagacttttgaaatttgtatttctgttgaacatttaaaaaattttgctccccctccacccaaatggggaatttctctatgaaattagatgtggccccatccactgtattaccctttggggcaaattaataaacagtccaaaatcctttgatttgtactccatttgatctaccttgtgaactcccattcattcttcaaatccaggtcttgtcaccttctctgagaagcctaccctgatcaccataggcccaaaggaaatattttcttctctgcatttccaggggccttacacacataacacagtgaccctgctttccatatcaagcaaccagtcatcattccccaagcatactctgcattttcacagcagcagaccattgcacttgctgtcctccccctgcccaccacctcccacacacctggaaaactcttactcattcttcaaagcccagctcaaattttcttcctctcttaaacctttcctgttcatctattctagtattgattattgtataattgcttgttttgaagaatatctgccacatagtaagtgttcagcaattctttactgaataaataaatttctccaaagaaagctcattggttttttccaaatatttaaaattgtgcacccctttattgaatcatatttctaggattaagaaagaaaaccaatatgagcatttgaaccttctgttgatttcattttaaaaataaaataaacttaaacacaataataagatgtaagtcttgtggacattgccaggaagtgtagggtgtgatactttctttcaagtcaattgtaatatacatgtttgacatgaatgtaggatatgtggtccatcaaaaattattccaaggctaagcatggtggatcacccctgtaatcccatactttgggaggtcaggtgggaggatcacttgtgcctagagtccgagacgagcctgggcaacataaggaaaccccatctctactagaaataaaaatttaaaaattaacccagcatggtactgtacgccaatactcccagctactagggaggctaagccgggaggattgcttgagtctggaaggttgaggctgcagtgagccatgattgcaccaatacactccagcctgggcaatggagcaagaccctgtctcaaaaataataataattaattattattattattgcagaagtatttaatttcagaatcaaagatagttttataggatttggagagtgtcttacacttggacaataggacttggagagcatttttaaaaaatagtaaacctcaatcaagagttagaaaaactggaaaattcaccttaaaaataaaaaagtagaaattataaaaaggggcctcctaaaatattgtgtattatcatctgcttgaactggataaattagtttgttcctatcagagttctctgcaaaatgtctttttaagagtctgctcctcaacccaccttgccaaggtttatgatagaacttttgtatgtaagtgtttttagaggctctttccttcagtgactggtaaatcagaatgtttacacatgaaacaacaaaacacattaaagcacctattaattggttgttttcattatttttcttttacagaaaaatctgtgacccaggccttactgcttttgaacctgaagctttgggtaatttagtggaagggatggattttcaccgattctactttgaaaatggtacatttattcctaatttaataacatgccctttttaaacctctctgaattttcccaaatttgcagattattttgctcttttctacaatgagagtttttaccttcatccagcatttgaaaccatacaatggttttgtattcaaaattgaaaaaaaaatatgtcaggcttggcttacagttttggtgtgttttaaaaaatatctttgtaaaaaaattaatgttgactgggcactgtggctcatgcctgtaatcccagtgctttgggggccgaggcgggtggatcacttgaggtcaggagtttgagaccagcctgaccaacatggtaaaggctcatctctactaaaaatacaaaattagctgggcatggtggcgcacacctgtaatcccagctacttgggaggctgaggtatgagaattgcttgaacccgtgaggtggaagttgcagtgagccaagatcgcaagcctgggcaacaagagtgaaactccatctcaaaaaaaaaaaaaaaaaagtaatgttgattgaatacacttcaagcaagttgcagttaatgtataatataagctataaagcagttacaaaaaatgttatttcacattttcataaaactatatataaaaaaattaggcaggcacgctggctcatgccagtaatcccaacactttaggaagctgaggtggcaggatagcgatagtttaaggccagaaattcaagaccagtatgagcaacatagtgagaccccatctctacaaagaatataaaaattaaccagtcatgatgacaagcacctatagtcccagctacttgggaagctgagatgagagatcactttgagcccaggagattgaggctgcagtgagctataatcatgccactggactcctgcctgggtgacagaacgagaccctgtctcaaattttaaaaataagaaaaagaaaaaataggaggaaaaaatttttaaaaaccacaccatgccaaaatatttaacatagaagagtgctttcaagcatatgtgatgcttattttcaaagtaaaatgaaaatgaaggtgagtaatcagataaatctttcaattcaaattttaagacttgtggtagtttcagaggaaacagccacttttcaaagaaggtgacaaaagaagttcatcctgcagaaatccttcaggtcatcaagaaaaatgtaaaccaggaattccctttatccttctctttttccttacacctaatgacattagacattatgctgtgtttgcatcttgcattaagggaatttactatttttgcagagatcttattgaattaaaaaagaaatgtattataggaatgattaggataatcacatcactttcagtaattataagctttgataagaatgtctgccttggcatggattttcgaattaagatgtgttggatgagttactttttcttatatgcattagacatttacaaacaaataaacaaaaagaactatttgataaattctctttaacaaaatttcagtaaatgttatcatattccctatattccagtgttctgatagcatctcatgtttcctccaactaactctctatcgacaccatctgatccctaatgaaagaattaactcattaatattttaacctatttcagtataacactatatatcatgttccataaatataattccttcataatggggtatttaggtgactataataatattttatataatttgaatagatgttttctgagaatggaaagcatgtttggataatagccaaaaacaattcaaccttttctagtgatctaagaaagaaacagcatcaataagtgatgtgcactaaatcctcctcgtatctcttggtgactgaataattagaattggtaactactgtcaaaaccagaggctggagcatagtgagggctactcagtcaagggaaagagctggaagaccagaatcaggctatgtgccaacaccacattttgaatgtttatcagatgatcacagtggactatcatggaatggactctagtatgtggaggagtcagagaatgagatgagaaacaagttcataggcttgttcaaaggctaccaccagccttattttgaagacagtgatgtctatacctgaaacttgatatatttcccttctcccacatacttcaccaactaacaaaaacaaccaccaccacaagatccctggtcagctgtcccagcagttcattcctggaaaagacaggggcagtgcttggcacacctgggccaggccttcttcacttctattcatgttgtgatttctgtttctaaccactttccattgtaaataaatatatctctccagctttttcacccaatcaaaatttccagagagcatataaatgcctgtaaaggaaaccagataaaataaagactgtatccactttcattctttttttgctttgtacagtgcccagtacccaattagtacaaatagtagattaattaactaattaattagtgagtgaataaatgtcatttcattcattggtcctaactgaagttattactggttttagtttcctttacatagaaactaaattttgcttttcatgtttttctctttcagctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtttatgattctctggaaagatcaatcagatcagccatttgtgggttgaaacttgctatagagcagtatatgataggtttagacaggacgagagactacgtgatcaaaatctcacagggttaaatctagaggacttgtataataaggcaaaatatttgtgacttcatcttctcaattgacagaagaaggggatatcagaggaaaacatagggaggagtttctaaaatggccaatatattatcaggagtttcatttcatagatgatcccctaaagctcagttagagagacagcatttaaaaggccattgtcaggtagtgcaatgtcattctcacctcaccactctacctcagatatcatttgcttttccagtcagcgattaggcacatatttattgtgaatcacctaggtgcttaatctatgccagattcaacacaaagtacaagatattgctttcaagaaacatgtattctcatttagccaatcattgattctaaagaaaaaaatgatataataaagtttatcatcaacttcagaatacagtagagttaatgaacagtgtagtaaactgtttataacagtttggaagtacactttgtatataagatagaattttggacaaaatcttaaatgatgagtagaatttagagacatagactgaaaaagcaaaggaggatggatagtccaagctaaatgagcatcatgaagaaaagtacaatatcaggatttagtttaatatgatagaacattattggtaaggaaggccggttacaactaaagaggaataattgaaaataggcttattggtaaagtggagtgagatgaaaacaagaagagtttaaactcagtgtagaagttgggtccactgttgatctctttccaaattctctcaccaggatcacctgttaatatttgagatttggaatgggggttcatacaaacagccattcaactcactccagagaatccatcatgatttcttagtttggtagcataccacagtggttttcagaggccttctgtatagccttaataattatatatcactgttagatttgtaaaaagtgggtcaacagggacaaaaatcaaaccaaaccaaacaataggctgaaatttattcccaaaaccatagctatgtaattaagagaaaaacacaagaggaatatgaagataatgaagacacccgtttttgtgtgtttttcaccccaaagaggtacagcacaaatcgccagttaatatagaaggggttacattcatacagtaccaggggtttaggtttttttgcagttccctgaagtgtttatgggatgaagcctattcaagaaaacttcattttatgccaggtggcttaaatggggcttctcttaataggccaccctgtattccaaatgggaaagaaaacttctcaggaggcacctctttgtggcaaaacatctaaggcctgaaaaccattcacatatgggtcttgtaagtaacatcctgctccgtgatactttgtgactggagctgaatgaaaagctgcatggctgttttccttccttttgaggatattttttattgcataatattcaatgaaaaacgcacaaggtctttgaaaattcatagcaattttgcatgagcttttgaatctaacattcagccctatttggtagcataatccttattttaaaggtaataaacactgaaaagaattttttccaacatgtggattgtgtcatgttagaatcctgaagttttcacatcaaaagtaaattatgtctgggtcagttcagataactctcaattatccggacttaatttatattaagctttagaatcctttggtgtcttaaccattctttcaagaggttgcagttctgtaagcagctggctatggcgaatgtgtaaatcaatttgctgtgcctgactgagtataatggtacttgaccatgaggacaggccacaggaggaagtcaagctgaaatttaaaactcacaaaatgggtaattccagaggataattgaaagttgactgtaattaacttcatgcttttgttgttgtttttaattaattgtttcttagacttgggttacaagcattcagatatgtatggtgctgttgtgaatatttgcctcattcagagaactaaaccttatcagagcttttaacaaatagtgctcccagctgttgctttcagcaaaggagatctccaattaaagagagtaatcatgttctctctactttcgagactatattccttgttaaattgacttctaggtttcatttcccaaggaatctaacaataataacagaagctaaggatgaacttgaattttaagtctatttcaacaaaaggattatattcatttactaatttgtccagtaaacaggaatgcttaagatgtatacttagatttaataatgtgactgaagactgtgtctctgtctctttatttttagcttagctttgtgtgaaaaaataattaatactgatcttctaatttaatactctctttgtgtaacattgtatgtttcttcttgtaatgatcacaagcaaacatctcttatacatagtgttttcaatctatttgttagccaagttataaaactgtagcctagtcaaatctatggcaaagcaatttgatgatattttgtaaaacaatataatttatttcttcctccccctttctcctttcagctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgcttttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaacctttcatggctctgtggtctttttatcagattttttaaaggtgagaatgtacaaaaagattacaatgaagatcagcgtactagaccatgtgtccatgaactgaacaacagctgtcataaaccaccctaacctgagaaagcagcaggaagcatttacagcattcctgcttttctctcagacaaaaccaattctcagaagagagctagaatgttctcctgcagactggagtaggaaaagttgataacagattaagcagtaattgtactccagaaggatttgcatttaggcttttgctgctttacaacagaaaaaaaaaattcttgtttgtccgtaaaaagtgtttttatgtttttttaaatgtcaccaacatttaaaaattggatatgtcatgtaaaagtcaagatttctggcttaattaatttgaaaaagtgtaaggtctgccccactggttctgtgttcactacagcagcagtcagagaagctgctgcctgtttcagaagggagcaggcactcccctatccccaccaggcacacacatacttcacatctgccccatgagtttgctgctggctcctgtggacactgaagactttgatctctttctttttttcttttcttttttttttttttttttttttgacagtctcactctgtcaccaggctggagtgcagtggcacgaacttggctcagtgcagcctcatcccgggttcaagcctcatgcctcagcctcctgagtagctgggattacaggtgcatgccaccacacccagctaatttttgtatttttattagagacatggccaggctggtctcgaactcctgagctcaagtgatccacctgcttgacctcccaagtgctgggattacaggcgtgagccattgcgcccagccagctttgacccctttcttaaagccaaagggcacctctgttggcacctcaggccccagtgaacaggtatgggcattggtttgtagagggattgttctcagcatccctaaaaccatgctacttaggcagctgtcttctgctgggcccctgctactaaaatgcttgtcattatttttacttcgttttaagaagaaaatcaaggtctacaaaaaaaaaaaaaaagcacaaagtgtttctatggtactatttaatttcttaaaggaagatctgcagctattttacagtaaaatgagtttattttgtcctagtttcaaagtcttcaatggccaagaactgttgggtaatttttattgctgagtctctaggcaggaccaggacaaattgtgaaatacttatacaaattatagtaactttctatctataaccagatgtttagaaactgctttgggatataatggtttgcactatggcctaactcaattgctagcacataatgtagtctgggcttaatctaagttagctctttacaaggctagtagaacctaactcacttgctccttggactttctcacactcttggaaactcacaaccatggatacatcctcttatctgcttgggccatgctcataatcctaaggctgaatgtagctggaaaaacgtgcacctatgctgacaggtcttgttatatattcatggccattgacctgcctcaggtaagccccagaggctgcccaaaaatcatatgtccctaatccattctctcttccagtcttctgtcaactatttcagacttcatttacttttcccacctccaatatttcttcccctattctcactcaggtgaggaccttgctgcttatttcactgcaagaaatgaagtaatctctgcatctctgtgtatgcaccctgctatctcttttattactgtttgtaaataggtcatgcacctaacaaaggccaccacctctgctcacaagtattgctctagcaactctcttcaccttgccttgtcattataaataatttcctccatactagttgtatccaccagtgccccatttctttatagccagattccttgagagccttgcctaaactgctgtctgaaatttctctcctcccattctctcttaaacccactccagttacctttaccactccacagaacagttctctaagtcaccaatgactaccatgttgttaaatcaaggatccattttctgtcctcatttttacttcatctctcagcagcatttgacagagttgttcattgtctcaatctttaaacattcttcttttgtcattcaaacaatacatttgcctgattttcctcccagctttatagatgctccttcccagtctctgactggtcctttttcatcaacctgacttttacatttggaagactttttgttttcattatttttttttctgtctgtttttgagacaaggtcttgctgtgttgcttaggctagccttgaactgggctccagtgacctttctacctcagcttcctgagtagctgggactatagcacatgccaccatgcccagcttgacttttaaatttggaactcatcttcattctctcccagggtaattgcatctaatctcaatggcttcaaattatattaatgattcttaaacatatctctccagcttagatcactcccctaaactccaaacatatatattcagctgcctattggaaatctacattatacatctactaggcatgccaaattaacatgtcataaactgaacacctgatagtctgtaccaaaaccctttcttataactctttccatatctcaaggatggataactcaattcttccactgatcagaccagaaatcttggtatcattcttaattcctctctatttgaaattccttcaaaacataatcagaatgtgaccacttctcacaatactgtctgctacctctcttgaatcaaatcatcatcctgttatctatattactgaaatatcctcctaacagtttcttggcttctgctctttgtctattctcaatgcagcagccagaataaacttgttaaaatatgtcaaagcatgtcacttctctgctaaaaatcatctgatagtttctgctttcactcaaagagacaaagtgagttctgcctgatgctcttctccccatgactttctccccttcctcttctgtgaatgtgccagcgatgctcccgtctcgtgacctttacacttgctatttactgtgctagaaatactcttcctcagaaaggcaagaggcaagaggctggctctttcactttcttatttcgttacaaaataaagtcactttcttagtcaagccttcactgataatcctaagatttcaaactccctcccccaccggcactttatatcttccttccctgattttcttctgcttggcacttactatttaacatactgctttcctcattttattcatgttatttatcagttgtctcctctcctaaattacacacacagcgagagcagggatttttatcacttttgttcactgatgtattcccaactcctagaagtatctggaacatagtaggtgcttaataaatatttgtggctgaataaataaatgaattgctctctagctttacagttgaaaaacctgaggctcccagcacatatatgacttgcttcagagtaattccaagagctgtatattgcttacatcgtaatcaactgaaaaagaaaagaacaactctactgtagctaaataacttttagccatcattgcacacatttagaatttcttaagccataaggaacagaaactagattccaaacaccttaaataataaggaaaatacattacttcaacaagagagagatgagtcagctctggctgtttatttcagtaacttcaacaacataaaaaaaggacccaggttctttccattttttagctctgcccttgcaagagaggaaactctatactccaggttaagcgaccttgagttcccaaaatgcatgacttggttcctcatgtcacatccagacaggacaacacccactggaagaggaacgcttgctcaagtcttctccacacctccccaacccatcctcagcaaggaaacatttcctagcagcccaattggcccagaactggatcacaggccacacactattgggcttagactgataagaacctaaccctcagctaagtatgagctactgttttttagaccatgggtgttcaggggagggtggacacagagagagactggattgcgttgcttttttcaagaaagagtttgggaactcattggaatcaagaaaagtcagaacaaattatgtttgtattgtcccctttaaggttgttattctatggatataatgagagttgtgaaaaaataaaatatgaagaaagaaattgttattttcttcaaactctaaacttcatccgctgttgcattcactcttgctgtagcttcctgatgtgcccagccagtgctggatagtttttcatcacataatgatttgggactaggaaactaaacgtctcactcagtttaaagttcttgtaggaattccagttgggagaagggtacgttaagccagaagtgctctgtatcacctttagatgatattatcttctccctgccctaacttcaatgaaaatttttttaaaaacaatgaaaagactgcttagcacctgaaaccgcatttagtgatcaattttcttcagttctgcttttctgttttattactttaaataagcaaaataggaaagtgagcgcgtggggcgactagcaaccaagtaaacatcaatgatcttattcacaatccacccacttgattctgcctggcaaagtgaacaaaagaacaagcagctagttcacccacagcacctgttcctccagggtctgaagaaacaattgctgttgtgtgggaagaaggatttagctaagtaatttgtgattaggtggtgttacgtgtacaatgcttctttttgtcaatatcattgctcatcataggtgactcagagacattctactgaagatggagttggttagtcaccacagccttataaaagcattaattttcagaatttcccttcctctcctatttgctcttttaatcttgtcatgagtacccttttgcccccaagcaaaagaagtagatgctttgttgttcacaccatgagaaaagaactccctctaaggcatagggctaagaggactaatttaaaaaatgacaatcaagtttacattcctgcatttccctctttcagttcataagaaaattactcggcccattttactaaaagatggaaaactcaatgtatacacacgtgtatatgtaggtacatatgaggagatatggaaaaagagacactttagaatggcgaagagtcatttggctagcaagtagagatgaaaaacaaaattaaacaaaacttccttgcaggcagaagataagaactaaaggaaacattgattaaggagccactatgttacaggcactgtgataaagacaatgttcccagaaggagagagcccctttcccggaagatttcactttgggatcatatctagtttctaacttggctccactgccttctgagagattcatgctttttagccaacaaaactccttcttgaaacttatccaagtaaacatgctctacttttggaacaagtcacacttagccatgggagatttcaccatctgatttattactcattccccaagagccattctcagggttgagacatcgaggctggagaagcatcttgggcctcgctcaatgtgatccgttcgctgatgctataatgccacttggcaggaaagtgtgaaaaggaagtgagggaaaaagggggtgagagtttcgaagctccaggtctcagcaacatgaaacttcaagtatatttctcttttgggttaatcccatcattgtgtttctcatccacaaaaaaactttgctggctgtcccatgatcatgaatgtcctctctcatttttagtgtatttggtttcttttctactttcccttcaagcttaccagaaaaactatggagcactatatacttttaatgatgattttataagagagattttgaaatgctgagtatcttttgttcatatcattcttcatctgcatacagaaaagggggtatcctgttctcccaattacataaacacaaaaaatacaagatcatactatacattcctttttgtaacttgctttttcacttaccaacatataataaacaataaattttatttcagaaaatatgcttctgttatggctagtggcttcactggaatctgtttatctaaatgatacacaatttatttaatcacctattgttgaacatgtacattttcttattttatgctaccaacaataagccaattaagtaattcttgtagccaattttttgcacagacacttatttccttagggaaattgccagaggcaaaaatactgagtcatccattccattttaacttacaaaaacagttatgatttatagtgcagaaattaccagaaagataaaattacatacctaagctaacttagtggcgaaattttatcacaaatccaggtttcttcatttcatgtccagggtcctttgtactgtccagtcatctgcagcttttttaagccagcatgcttggctctggcaacaagtgcaaggcaccacacaggagagagattccagaacaatattgctattcatagctttagttctgagatgctgtcctcaacttgttctttatacctgattacattcttcccagatcttcctatacatgggccttgctattgaggctgttgttttagttttgttgttgtttcttcattttgacctttaagagcgacacactcatttcttacgtatcttttaggtttgaaagtcctgatagagctactcagcctaaattatcggtttcagaactactgtatagatcagagagaatgacacaagaatgcaaaaggatccatttttctttataaccccaccttagctgttatttttgttatacgggtactagcagaagaaaaagagaaagaaagaaagaagaaagaaagaaagaaagaaagaaaagaaagaaagaaagaaagaaagaaagaaagaaagaaagaaagagaaagaaagagaaagaaaggaaggagagagagagagaaagaaaagaaggaaggaagaaggaaggaagaaagaaagaaagaaagaaagaaagaaaagaaagagaaagaaaaaaggaaagaaggaaagcgaaagagaaaggaagaaagaagagaaagaaagagagagaaagaaagaaagaaaaggaaatgcctcattttcagaagcccagataaatggatagcttatagatgctatccagtctaacagctaattttgtaagtgagaaatcccaagaaatggaatagccattgtccatttaaaaactggaatggaaacaggatgaatttatgaaacctagagcagtgtttctcaatttcgtcccaggaccactttacactcctaaatgtaattcataacctcataaagcttctctctgtgtaggttatatttattgatatttgccatttaaaaaaatgaaaactaaaaaattttcaaacacaaaaatattcaagcacattgtccattagctctcagaggaatgatgtcacaacacttttttttttttttaagacagggtctcactctgtggcccaggctggaatgcagtggctcaatcatggctttctgcaaccttgacctccttgagctcaactgatcctctcacctcaacctcctaagtagctgggactacaggcatgcaccaccaccacacccagctaatttttatatcttttgtagagatggggttttgccatatnnnnnnnnnnnnnnnnnnnnctcgtgaggaataagaatgaaacaggaagttaaggttttagtattataatgaaaatagttttaacctcttgcaatccttgaaaatgtctcagggaccccgggtatgttcttgaatcacactttaagaatgtctgtgggccaggcacggtggcttacccatgtaatcccagcactttgagaagccgagatgggcggatcacttgaggtcaggagttcaagaccagcctggccaacagggtgaaaccccatgtctaagaaaaaaaaaaaatagctgggtgtggtggtgggcacccgtaatcccagctactcaggaagctgaggcagagaatcacttgaacccgggaggtggaggttgcagtgagctgagaccacaccactgcactccagcctggcaacagagaaactccgtctcaaaaaaaaaaaaagaaaaaaaaaagagcttctgtactagataaaataagaaagaggtacagagtaactaatcagaaatgtaaccatgtacctaaattcttaacaatcaggggacagaccatttggaatccatcctcctccaatacatttctgatgatggactataaacagtgatttgggtgttaaatagataattaaatttagaataagaacaaaggacaagtagatattgatgaacagaaaaagatgaaaaatagatttggacagaaacagagagggaaaaacagtcgccaaacatagcaattgacaatatgactatagcatttggaggacaggggagaggtggggaagaaatcaagcatcccaaattatttaaattggccaagatggagtacgaggggctggatttattctcctccctgaaataacttcaaaaaagacaaaatctataaaacaatggttttcagacattggctatcaggcaccacaggacagtgaatccctcagagataggaagaatcaaggtgagcccggcaattgccctagcatacaggccagaggatttccagcctacagcacaaggcgggtaaaatccaggcattactcagccaagtacccaagttgaagagatagaggtgggagaacagggaggtcaaagcggctacaattcataggacaatgtgccagagagaagagaactgcatggagaatgctgtggagatttgcagaggattctcctttagccttcagctgagtactgatcagtgaggctagggaaaaatacacctgagataattaactggcgagatccctggggctcacacaagcccaggaatagtttgtgctctcaccagccagagaaaaaaatccttgtaattcactgggcatgggatgcagtactcaaaaatgtattgtccctgtagtgggagaatattagccctagactaaaggcttctccgatcccacttgatgatattaaaaacaagtctcaaaaaagatcagactgtttgcaagtggcttaatggagcccccagaaaaaaaatttaagaataatttacaggagtataaagtgcccagcaacaaataaggtaaaatttactatggcgggcatccaataaaaaaaatcatcaggtgtgaatcatgacaggagaaaaaccaataaaagaaacagatcgggagaggacacaaatgacagaattagcaggcaaagacatcaaaacaggtattacaattatatttcatatattgaagaaggtagagaaaaaattgagcatatcaaatataaatattcaagaatatatgtgtgtgtgtgtctaaagaaatactttttataatttttggattcaattttctaagatttttttgagaatttttacatctatggtcttgagaaatattggtgtatagttttcctttcttaaagtgtctttatctggttttggtgttaaggtaatgctggcctcacagaatgtgtgcaccctgcttctattttctgggagaaattgtggagaatttgtattatttcttttttaaatgtttggtagaattcttcagggaaaccatggtcctggtgctttcttttttttttttttttttttgaggtaattaattattgattcaatttatgtaatagatataggcctattcaggttctctacttctccttgtgtgagttttggtgtttgtgtctttcaagtaattggtccattttctctaagttatcaaagttgcctgcatagagctgt

SEQ ID NO: 1499 - DNA, 5928 bp, Homo sapiens
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggcttaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgcttttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaatt

SEQ ID NO: 1500 - protein, 499 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 1501 - DNA, 50287 bp, Mus musculus
  misc_feature (1)...(50287): n = A,T,C or G
atcgtagttactgaggctctccagtatggaggcttctctctcttctgttattcagccaggtaggctctcctgtgggcccagaggtgtctgagcatctcattttcacgcttctgttgtttgctcttctgtacttcttactgcaagggtggtttgtttggttttgtttcttctctatctaagatctatatacacaaagagcacaatgaattttttaactaatgagtgtgcttgtagatccttgtgaagggcagaaggtatctgttaatgggatggatctaactttaacagctgacatctaaacttcctcagaggttgaatccaaatcctgatgtcataagttgtataaaagccctccagactccacatccctgaggcttgactgggtggctcctgagatcaaagctgctcctcctccttactggccggtcctcaccagttcgagtaaggtgttccagagaagagacaaaccggtctgctgggacacggtctgctgggacacggtctggtctgctgggacacggtctgctgggacacggtccactttctcagggttttgcctgttgtgctttactttcaaataagtcttcaagcttgcactttccgttcctcagcactgggcccacattaacactgtattctttgctgcatttagtactttttgattcggaacaccctcctcccccaagtggtttccaggtctcaaagttatagtaattacatcttggcacatacacctttgctgatttctccataacgatctggattatagactttagtgtcttttgtgttgactctgcgttaagatgggtacctccatctaactatgaataaaacaaatttataattactgtgttagcttcctggttttgttgcaggatattttatctatctcaggtttatgttggctcactgttttggcgatctcagtctgttactggctgccctcttcttggtggcttatggtgaggcgctccatcctggccatagagtgaaaacagcagaagaatggttggtgccatcctttgatagcatgtccttagagactctctcttgtcaggccccacatcctctcagttctgccccgtcccagtagctcagtggctctttaattgttaggcctttggggaacatttaacaaccaaactagagaaattacttttcagttcctgcttttatttctcttgttggtctgttcttcttccaactagataacttgaatcacatattttaggattttaggattcagaggagaacttctttgaacattttgtatgtctgatcaatataatatatcctcactgtcatccccagtgctagataacagaccaacaccttccctatcccaagtggctcctaactacctgtgtaactctacaaatgggggcctgatgtttgacttctgccagcatgtcatggcccctcaacagacatatgggaacacacataattaaatataataacaaaatcaaatcttaaagcaaaaaaacaaaacaaaacaaaacaaaaaccccaaaccactgttcagtcagtagcctgagattatagttgtttagcaggattgaagaacataagcctgtccttttgaccttgattattagagtatgtttattcccttcagatttttaatctcctattaatttttaattatgcccatctattcccagtattttataaacttattaccactgttttttttttttgataatttgcgcagaattatggtagtcacagttcatggctcatgatgtacagttacatgttatgaaaatatcttttagtctttttcagtcaataaaaacattgtgtacatttatctactaagtcagtggttctcaaccttcctaatgctgtgactctttaatggtgtgattaggattttaggattcagaggagaacttctttgaacattttgtatgtctgatcaatataatatatcctcactgtcatccccagtgctagataacagaccaacaccttccctatcccaagtggctcctaactacctgtgtaactctacaaatgggggcctgatgtttgacttctgccagcatgtcatggcagacatgctgaccccccagtaataaaattattttcattgctactttattgctgtgattttgctactattataaataataatctgcaagttgagaacttctgatctaagcaatactttatttctagttttatgaaagcattatcaatccaaggttccattttgataagagtgtcaatcctgggcagggacacagtgtcttagttttccctggcatgcttttcctcaggcttccccttctcttgctctgacagggcccacagattaaccctgtgttcttggatgtgtttccatcacggctaccttttgatttagaccccaccccccacccccgccccacacatacccaagtggtttcccgatcttgaagttatagtagttaatcagcagtggagtgcatttgatcctcagtaccaaggaaaaggaggggagctgtatctttgagttatggcggaggaatttaagttttatcagacagtagtgtttcaccatgcactgtacgtggtgactgattttaaactataggacgtagtcatgagaacaagtattttaaaatgattctttatctttcaggaaactcctggttttatgattttaaaattacattttaaaagttaatttttttttaaacatgtactggtgttctttctgcacgtatatctgtgtaccataggtgtgcctagtacccttgaatggttgtgatcggcagccatgtgggtgctgggtgggaattgaactcgggtcctctggaagtgtagcctgtgctcctaactattgagctacctctccagctcctaaagtcactttttttttttttcagagtcaaagaggatttggcaaaataggtgtagccggagtacattattaaatggaaaatttgtttcatttataaatgatgttccactgttctctgtccattttttcttttgtttctatctgtgtatcagggtagggcacccccttaaatagttacaatcactcttttggttctgtcaggtgagatgatgatgatgatcaaaagcatcagatgacttttctagattattctctgaattcactgaaactaagcagctgtttaaaacagaatctcctttgtggagacttactgtcaaccaattgattaatcatcatgagaacgtatcttaaatttgaagattttaaagtcagattttaattatatttaaattttaacctattgactagtaaacaatatatttgaaaatttgcttaaagaaaataataaacttcttgtagaactaaaaacattatctttttaagttctgaggatttggggttgtggtttattgaacttactgggggctatgcttttagagaaaactgacccttctcccaggagctaagacttacccttgactaggggcagacctgtgttctgcttccctctccccactggatcttggtctgttttaggctcacacgggttttgtgtatggcgtctcagtcatcggtaccatatgcatagctgctccgctgtgttcagaagacactttctctctattcatctacctctcctgactcttactgctctttctgctccctttcccacagtgactgactgctgagcctggggaggnnnnnnnnnnnnnnnnnnnnnnnnnnnnnnnnnnnnnnnnnnnnnnnnnnnnnnnnnnnnnnnnnnnnnnnnnnnnnnnnnnncagaatagtagtagtagattccctcccagagtctatggtcgttctagccacagattcttggccaggtatgggtttcatgttgtggagcaggccttaaatccaagctgagtggctggttactcctaggatattcatgccaggattggattcatgcacgtcttgccaggctggttgttattgtaatccatacagttcagtccaccgggcaatgctgatgactgtgaaactagccagaaaagatgatgcttccaggacggcaccagcttgctttctccatatggttggtgtcttcagcaattcggtcttatctcaagacttggaggataagcaagaacattggcactagcttgtaatgtttgaaggcctttgggccctgggctgtggggacccatggcctggtacacgtgtgaaggtcaaaggacaacttgctggacttagttcttttcttttatcacgtggtctctggagatcaaattcaggtcatcaagcttggcttggtggcaagtgcccttaccagctgaaccatctcaccagccccaagacatttttggtttttgttacatggttttaatgctggggtttagatacacctattttcttttgtctattttgaggtaactctcgcatgtggcataagagtccaacctccccgaattccatgagagtgactggttttcccagcacagttgttggaaagacttgtcttgatggttggtttgggctcttagttctacggcttaggtgtatgtgtttcctctgatgcaagtattacagtgtttgattactgcagtgtttcagctctttgtagtaacgagaatagccctctaattttctaatacttttagagcattacaattatccagggcccttggaatgccatataaattttagggtatgttctgtttttgaaaaaacaccactggacttttgattgggaccatattgaatatgtagatcctccttgagccatagttttaattgatttgtcttctagtccatgaaaatgggttgtattttcatttacatatatcttattgagctttattcaacagtattttttagtttttagcatatgtgttatctcattgcataactcgtaaggatttatctttttaatactatttaaattactgtataactgtttcctttttatgtgtgagtgtatgtgtgtgtgtgtgctgtacatgcacatgtgtgggcatgggtggagccatctagcttgctttttgagagagaatgtctcaccaataaatatatcttgtcctggacttttcttcattgtattaatttgttcttggatgttagagatctacttaaattgtactttttcaagagtaagtggacatttctggaatatttgttcattttattaggttactcactttctggtccataattcatagaattttatgttcttgttgattgaaatcagtactaataccctcatttttaaattgtgtttatatatttgtatgtggcacttgaacttgtgtgtggaggtaagggcgaccctgagggtctcttctttccttccctgtgtgtgtctggggataaaatcaatcccttgtctcggcagcaggtcccctatggacatgagccatctcactctctcactggtgtgttttctaagtcagtgtaacattttcaaagaacccagttctgttctgtggtgtctctgctctgctcttactgtggccctctactagttagtttccactttaattggatctttgctttctaattccataaagtgtcccatttggatactaatttgaggtttgcttttgatgtagacagtgcagctagaagttttcttgatgcttagctctacactgtaagttttggtgtattgtgttagtgttttcattggttttaaggtgtattctgtggtcagttgtgagttctgtagtgtattacttaggattgttttgtttttacatatttgtaaattttccttgtttgatacctagtttcattttactaaattcagaagaagatacacacacacacacacacacacacacacacacacctgccaggactgtatctcaggagtagagcccctgcctcgcatgtatatacatatccctggatctgatactaaaaaaggaaagccatgttttcagtctgttttgtggtcttgaggtctggtcttcagtgcgttgtgtgaacccttgggaagagttagtgtgcacggtagttgatgaagaatcctgcacacgcctgtcaggtcatgtctattaaatgtgcagcgtttccaagttctgtctcttttcgtgtgcttttctaacagttgttgtaagttggctgttgacattttcagtttattgtaattttccttttactttgccctggaagccttccttccactctagtgtgtgtgtgtgtgtgtgtgtgtgtgtgtgtgtgtgtgtgttttggttaggcagttctgttgggagcaaatgccttaatctctctctaatttccaaagtatagttatgtggaatatagtattcttggttaacattttctttttctttctaatatataaatatgctgttcctgtcctcttaatttctaatatatcaccagccttttatcatgttgagaaacctttgtgtagattaagtagcttcattctgactgcttcaggatttctttctgtgggatttctatatttttagtaaagaagtgtcccagtgtgggggtctctttgtattctttctaggctttggatattcacgtctttgtcgttggaattgggaagtttgaggtcaacattaattttttaaaatgtatttgtctccagttttgctgtccttctagaatttttaggatcctggtattcatgtgtgtacttgtgtgacagggtcccaaatgtcccttgtgctcagctttttattttgcttgctagaatttccttcgttgtttgacaaaataaatactaaattgtactagcgtagattatgggtaagtggatccttccctgttgtgtcttattactcaaatgcactacagtaagaagttatgtgcgccctctcatggatctacttaagcccaccaaggtgtatttaatgctctgtgttagcttgttttctatctctaaagttccttttcttgaaaaacaggacacccgtattaataatttcccactttccatccttcccccaggccttggaacttttagttttgtttgcttgtttgtttgtttttatgattttgtctacagttatgaagatatttttacaaccttgttttcatgccaaatttatattttgcatttgcagcataactccatttggactaaccactttggaggtgctcattagccacatcggcctatattttgggtagccaaactcagtactatattaaaatgtagcagctatatatagttgatctatgttatgtgttattattttatacttctttgtcattctagaacaataggcaagatctgtgaccagtaaacttgaaaaaatgttgtgtcagggttccacaatgacactatatagttggacagacacgagggaccatatgactacattagagacatggtggctgaaatattgataggcatttgatctggcttgagggttggctttgagtggtgcctagcatgcatgaggtactgggtttgatcttcagcactgaaatgatttcctgttgtgacttagtctcaagtatatagaaacactcatcacacatgcagtattctaagggcttacagattttctctcacagatgaggttctctgcagacaatgtagggttgatgtagtacccaagcctgcttagttattcctctgctgggtctggcactgctttaaccttagaaagaagggcttctgtaatgctggctcttttgttgttcttgttcctgtcatttgtcttctgagaaggcctcactctgtagctccagtctatctgtgaggcccatcctgtccagggcctagcatctgccaacctcccaggtgctaagactatagagaaacaaaacggtagtttgnnnnnnnnnnnnnnnnnnnnattagttactgtcggggtagagctattcgaaaggtgcagctacagaaagtgaagctgatacttttaggatgacaggtacatgacatttaggatgtgtttacagctggcacgtttaaggatgtgtctgcagttggcatgtttaggatgcatctacagttggcacatttaggccatatcttacagttagcatgtttctttgggattgagtttagcatactgggctgcttcccattgacatcttatactgccttggctaacgcacaccaaagcctccattttgcctatgatggaataactaagtgaactgaagtcctgctgaaactactaggaatgctgggaggtgggggtgggtggcttgagataattttggaagtatataagcctgtccaaacttgagattcaggagggcagggagggagacgctgtatttctggtgttggtaagttagttaacgcccttgaaactgttctctgtgggaggatgaagctgaacagggcttaaaaacgaaaagcaactagggacagtgcagagcctcaactgccctgtctttatttttgtatattttatttttaatattttatatatttatatatgtaatcattacctattttacttaacagcttccgctgctgttattctgcgttagatttacagttggagtcccttgaaggaccttaccgtagaagggacagtaatgtgggagtgagtgcaactctcagtgtctgagctcagtccccagcagtctctgtccttcattggattgtgctctactgctgacctgcttctgcttggatatccagctaggggaataagtaaagcctctgtagaggaagatagccgcatctggaacctctgcattcctctagcttcacctcatcattcacatagtgtctgacagtcagtaaaatactgctacccacacagcaagaagagaaaaacgtcagcagcagaaacaggtcaataggttagacagacggtggactggaactttaaaacacggtgatgagtatgttcatgaaaatagatgctgaagctgagaatttcaccagagaactggaatctatagaaaagaatcaaaagggggttctataactgaaaaaatgagcagcacagcaagcgggtgggtggagtcacgggctagacacagctgagaaggatggacggtaaactggaccgtaagttcatagacactcggcacagactcatcccaagctatgccacggttgctctttagactccctaagccgtgtgtcttaagactggagtgtggatataaagagaaactgtattagattgtagttgtaatacttgactttaaatgtgtgttgcttcgtgttttattatggtgatggtttttaaattacagtaaatgcctactgggtagtgatcagtactaagttatcagttctaagtttgtatttgtgttctccagactttgagcaacaaaacctttctatgagtcacctgttgagcaaacctagggtaaaccgttaggatgagaaattgagcaaaacacagacggagaacaaccacagctgggtttattttagcctcgggtaaaggcccttgtttttatttaggatagtttgcaaggtgctctggtcagtttgcttattacatgtaggtcataaagagcagacactaaggtaaatgaccgagtttcttaggggggcaattgccttgtttttcagttagtaaggctccaatgacagggaaaatactgccagttgcatttgacgttgtataagttgtaacatgcatcctgatttcagaaatgttttgaattgaaagaaaaagctaatattagtctcacctctgagtctttagttcttttgcttggtatttgatggtttgctgagggaaggtctttgagcattttcctaccgtgagaatgggataggccacagatctgactggttctggatggtggttgagacctgtgcctggaccaagtcagagtaacagtcgctctcagagtttgcagggggcatggtccagggactttcatcccttctgatctcgtcattcttaagggctcactgttgagttccataaaaagtgtgaccctctgttgatgccaactaaatagagcattaattagactttatctttttaaacaaaaagtttagattctgtgatgtttgctggaaatgagaatcccttcattcctattttgaaggtaaactctaaacctagagcgatatttttcttcagcaataaaatatttaaaactaatgttttttgtttgtcctttaccttcagaatttttcaaaccacatccaactgataggatgaaaaagtttaagaggagactgtccctcacgctcaggggaagccagacgattgatgagtcgctgtcagagctggctgagcagatgaccatagaggagagcagtagcaaggacaacggtaagtagctgggggagactcagttaccttaccaatacactcaaggctcctctgcagatatgctgaccatggcagttttgtttatctgtggttacttggaaacaggagactgacctgaatgtgcttggctgatggcgtgtcctggtctcctcccagcctgcagcatacttggtcacctactcccaggagtgcctttatgtttttactagttctccggttctcatgctctaaatttataccagctgttaagtaactattggtaaattatcatttaaatatttgtattaaatatcctgagttaatacaggatagtaaggttgtaagattcctgtttgtggctttattatatataggctaacagcattctagatctgtattgactgactttatagattacaaggatcatcagatgagggagttggttgttttcttattttatgtgccatagtatgtccattgtactgagaactcctatgacggagacaaagccattatctttcatttgacagttctttttacaatacaaagtagtagtgtacaaattttaatgtaacaatttaaagaggttattaaattgaactaaaatgtaaactggtaaatgtttttagaacactgttatatactcaaagccaaaataaacctaggaatgtcctagtgatcaggaaggagataaaaacagccaataataagccatggttttcagtgtctgcggagctcccttgtctgagcttaaaaatctggttcgagatctctggcggtggtcaaagcatgctcgcttgcttcattgcaggggaaggcttgtggggtgagagacgtgtggttgtgcaggttagcagtcatggtctgggaccgtgtttgccctaaggcactgcagtactgcttcacccacggtggggggaagtcagtttatcctacgcaggtttcatagaccttgcctttcttcctcagacatcattgtttgctgaacactgtccatcttgttggcagagccaaggtggccttgcgtctgttctcgtggtctatcttggtttcgtaatgttttccttgatggtctgggtttttgacaagagcagagaaaaatgagctcagtaagaaattcaagacaatatttggttatcattccatatacaaggcaaaatttatatttgtctcaagtcttgaagatgattttgtaatatttaatcctcttctaagagaatctgctcgatacatggagcagaaccctgctattctcagattcccattgaattcttggtggcaataatggctgactccagcttgcttattcttgtgctagaaattctgaccaacatgtttgccagtgatgttcagagataaaagaggcacggtgtccaccatggtaggtggtttttggagcacattcctctgagtatttgattaccagacaaacgtttttattaaaactgagtaatggacgatacactgacattttagaactaattaacaatttagttctaattggatgttttctggaatattttggtaattatcttaaaagatggttagtttataacacgtggtgagatgttaaaaatatccaatagtttgaaaatagtgtaagctgtctatttgtgacagaccttaaaaaagaaagacttaagagcactgtcttcctcatcagagagacctgtagttgtacacagacagaccttaactaccatagtcagttgatgctcattctctttgtgtaatgtgggtttcatcaattattttcacaggaattttaagtcttttttttttaaaaaaaatcatgttaatgcctactagctgtactgaacacagtttcccccttggagagtttgtttgtttttcccattttgtttttagcataagaactacataagctaggttgcacacagagatagagtctgtgtcaaagtactctgcaggaatgtatgcagaagagtgagctccaggacagccagggctacacagggaaaccctgtctcgaaaaaacaaaaaaaccaaaaaacaaaaccaaaaaccaaaaataagaatgtatgtagagtgtgctatttaaaaatgttacacgtaacgtaatcaacttataaagcaagagcgatttgtctagtttgaaacagtgaacattctagcttaataagtgaaatagtttgtaatttctctgagtaaactgcctcagaccaatttttgatctgtctctagttcgatcaagagctctgttatacttgcatactatatagacatgtatacaataacaaaatggagaagtacacacttgcaggattgtaaatatcttagaaaaactaaatgggcatggtacttttatctacggtactatccccccaactagaatttgagagacttttgtaattttaataactgtatcccaccttgaaggctaaagttagttagaaatgttgtgctgtaattgtaatttacagtacatcgtgcagctgtgatgtgtgcacggtgtctgatggatcaaatccagaaaggaagaatcttgaattttatgttctgaattggtagtgagaatgtaaaagtaagcttaaaattgttaatcttggccactttacacatattggccctaacttggaacagctatacttaaatatatattgaaaatttacaaatggaagaataagaaagtattcctaaagtgtcttctatgagagataactcaaaaattatgtctttaattaattaattaattaattaatgtatttagttagttagttagtttttgtagctcgagactttgatgtgggggctcacacatgctaggccagcactgtatcactgagccatagtcccagccctgagtctttagtctctttaaattgtcaaaattatttaaaatcgtcaaaattgatttgtttctttgtctctaaaagttgaacatagaattagcatatagaccagcagtttcgtttttagggatattctcaacaaaatcagagtaggtgttcaagcaaagccctgctaagattcttcctcatctatagctaaccgatcagtaagtattatactgtaagatgtttctgcttggcaatgggtctttgcttatttaaagattctttacataacagaataccatatttgaagtgataatcttagcttccatactgagatacacttaagtttttgtcttattcactaattgacatgctgctctgaatgtctagtaatagaggtatagattagatgccttttgctaagaattacatgtgttatattctacagcatatttaaccctgtgtgtgacacatggtaatcatggtcagtcaacacatagaggcctggtttgcaaataaatttaagattagagtaatttgacaggatacctggtggggcatattagtaactgttaaccagttttggtcattggaccaacctaagttgttaaggtatttcctataaatgtgtgttcatagaaattcgttctaactattgcactttgaatgaaatcgccaaagaagtaagcttacatgtaaatgatctctgttacagccttgtgttttgttctgttttcttaacccttctcttgtgatcctgactcttgggacggctatggaatgatttttggatgccgtgaaccacagagcccattgtgaagaatggcaggccgcccacatctcacagcgtgcattccttcctccatcagtacacaggctccttcaagaagcccccgttgcggagaccccacagtgttattggaggaagccttggttccttcatggcaatgcccaggaatggaagcagactaggtaatgtgctcattgctccgttgtgtttaacagtctgcttctaggacatgtgcactgagtgtcattgtatgaacaaagccagcctctgtcattgtcagatttcctctagtcatgtagagaccaggtgaggactggaagggtagcagaaagatgagggctgctaacaccgcagagaatgacgtttgcttgtctgttcatgcagagtgggtgctgcttcaggagcttttcagttaattactgcatattggcagtacaagaagtagattatcacctgactgcttattcttttgccattatgtgcttttgaaatatccagaaaagatacctgcaagtttttatgtattttatgtctctcatcttttttggtagtggtatattatgttttgatttagaagtcattttaaatatagatgtttcattgtcccattagatagactatttactacagttcctgaatattgtatccctctgtttcctttatttattgccacagtaggctacttcctggttcttttccctaattttaagactgtgagcctctctacagtgtggcttcatctgtgagaaatgtgccaatatccctgctggcacagcacagagaatggcgcgctggagtcgtcttaagctggttcatgagagatgtgggttacagtcggttattaaacatagctactgttatagtttatattgtacaggtttagagttaagctaaagtaaaaaccaaagttaatgagtactccagagtccttacctccagttggtttcctgtcccggtcatcttttctctgaggtaatgttatttgcatcatgtgtcaatagtgataacactgtgtaataatgtgccattgcatttttctggacagtgtcacctgtccagtaatactgtgccaataatttgaagtcagtcatgagggagtatttatgtttaagaaatcaggtcttggcttgtaattttgttggctgtgtagtcaagagtgagttatgttttaggttttatggactggagtctgttgcatattctttttctgtgtgtagtaagccttttaaaatgcaagaaacatttttagttcaggagcaacgtaaaagcatctgttcttgagactcttggtctcgagttaagaaaggaacactaaaaacgttagtaatattgatcaaatttatcagtgcatcatgcaagtggcagaagcttgactaagcaagcatcctgatacgcttcacgtttcatcgaagccctttgtcccactaaggagacagtgaagctctgacatgggccttcactttctcacctcgctgtattcggaaggaggcagaaacagctgtgcttgttgttaccctggctgctctcctggctgagtccagtggaactcagtgtttattcctatctgggatgatacctttgcttggcatccttgtagggcaggactggtcggttctgtttgcttactggttgcttgttagttctggggaactgaacccgctgcctcattaaggcatgcttcagaagtgctgagtcactgagcttacacagcgttcccagtttgtccaggcaggtcttgaacttgtgcactggctctcagcagggttgtgatacgttagagagcacaaacttagctttgtagtagacactcagcaagtagtgcttggaactccagacagcttcttgctggcctctctgttccatcctgctaccttagttctagagttacaggtgtgccaccacatctggctttctactggtgggtagcagatttgtaaatattttaaagactgttctatgagttagctctattttcttgttgacacatctaatgagagaatagtcataagaagcaaaagaccaggtttctagtccagctgtgtgcctaagctacatgatctaaaagtaggttaatttttaaagtctctatctcctggaatctggaaaataggcaaagttacagtaatttcaagaactctgtcaagtctgtaattttattcaattcttggcaataacttgaattactttccttataaaatttttcatactttgaaaatgtggagagatgtcttttcctgcctctctctccctagtgcttgtgccacagtgctgataccatagtttgctctgtattgctatgagaaacaccatgatcaaaagcaatttgttgagagggtatttttttctttttcttttgttcttgttttttgacttaaacattcctgtcacagtccatcattgaaggggaaacgaagggaggaaaaacaagggaggaacctggagacagcaactgaagcagagaccatggcagacgctgcttccttccttgctacacatggcttgctcagcttgctttctcatacagctgagggccgcctggaatggtaccatccacagtcggttgggtcctcacatagcaattattaaccaaaaaaggtcaacacatgttttgcctacagagtagtctgctagagtcattttctcaactgactttcccaggtgactctaacttgagtcaagttggcaaaaaactaatcagtacagttaaccccttgtcaccttgacagacacatcattattaaaccctaacctttcctttagtgttttccccaagaaagcatactaatataactattatgtaactctaaaacataatatatctttaaaagttccatagttttaaaaaatattcaaacaccttttaaaaattcagtctttaaagtatcttaaaactccaaagtctctcaatttgagcttctgtaaaaaaattttttttaagttaaacagttcttgtcccaagagggaaaaggcatggcacagttccaataagatcagaggaaatccaatctctaacagtgtaaatcaaagctcatagctaaatgttcagcctctgggactcattcactctcagtccttgggctcccgtggtctccagtggctccacctttcctttggtgcagtccacagcataagcagctaatgtcacaggctcaggttgatactgttccacacatgccatccttagtggttttcccgcagtgctggactgtccagtatttcggagtctccactgtaacttggctgtacagtcagcagggcatcagctagctgctcttcagggactcacattgtgccgagcctcagcatctctgcaggagtccttcaatcctggggtctacaccacagctgaggggacacatccaccagtgggctctcctggcctcttagagtgccaagcctcagctacgccttcaatcctgcagctttcatgctgcccaaaccagtaacacatgggagacgtttacacatcaccgagactgggtgcccgcttgagacgaagctttggctccctctggtccacagcttattgtggtgaccctgaggaaatgcttcccagaagatctcacctcagtggagctgaggtctcttcatagtcacagctgcctttcactctcagctgaccagaagccacagactgtccatcagagtctaagagaagcctgatagagtgtctgcttccttccggccctgcatgagccaggcctccaccatctgtattgctcccagcatcttacctccagcatgtttccactgagcagcctgttaagctgccagcactaatggcacttccagctcaaaagtttcaagcattgctacaatcttttcccaaaacaacacagtcaggtctgtcacaacagtagcccacaatgctggtgctgatttttctattagtttgctttctattgctgtaaggaacaacataatcaacttggggagaaaccccttggcttacacatctttgtcacagtacgtctttgagggaaacttgggcaggaactcaagcagggcaggaacctggagccaggaactgaggcagagaccatggagaggaaccttacttactggcttgctcagcctgctttcttatacaaataaggacccataatagctgggttctttcatgtcaatcattaatggagaaaattcccacaagcttgcctgtaggcagtctgatggtgtcgttttctcagttgacttttccttcttctcagatgactctagcttgtgtcaggttgacccaaaacaaccagcacagctggcctgagatttatctttctggtaaggcatttatgttctgatctggtaactgcttacatgcctgtggatctcgagcatagacgactttcaacactgtgatttgtgtttgttgatatctctattttacttgtaatgataatgaagtgtactgtttagtaagatctgacctttaaaggtaaacagtgcctccttttctgatatagatattgttcatgaaaatctgaagatgggatcagatggtgagagtgaccaagcttctgggacatcatctgatgaagtccagtcacctacaggtgtttgcctcagaaatcgtatacatagacggatctcaatggaggtaaccagttaagaaagtggaaacgcaaccattgtgtgaatatttgtgtttgtaaaggaacatgcaatgctcgtttgaagcatcatgaaggcaaatggaactcacacaagagctgtttctttgccttggtgagctgtggtctgaatgttgttgtttttttttcccctagttatcccaaggcaagtatacattaattacagttcacattctgcagaaaacctttccttttttttgttttttgagacagggtttctctgtgtagccctggctgtcctggaactcactctgtagaccaggctggcctcgaactcagaaatccacctgcctctgcctcccaagtgctgggattaaaggtgtgcaccaccactgcccggctagaaaaccttttcttaatcacacctttacggtgctcatctgagcacttcatatagtttatatatggatgctttaaggggtataaatgaactagaactagcttgttttcttacttggctagtttctcctttatggtacattgtatctatatattcatatgatacatttatcataaatataaaagaagaactggggactggagagatggcttagcagttcagagcatcactgctcctgcagaagaacccaggttccattctcagtggatccaggggccctgatgctcccttctgacctctgagggtgctgaacagaaatggttcacatatacacaagttgacaaaaaaaattcatgcacataaagaaatactgaaaacaacccaagcaattcatttctttaaagatgtctgtcacagttttatggacagaagttttgttatgactattactatttcagcataccctgtaagttaaaagctttctgcaaagatattaaacatgctttaagataaaattttagggggctagagagatggttcagcacttgccagccagcctggcaatctgagctcagtctctggagcctgtgtggtggaaggagagaactgactcctgcagactgtcttccagttctgtaagagatcacaccctgtggcagactgcttatgtctgcatggagaagaatttcaaagtaaagttccacttgaatttggtaaagaaactgttgcgtctttttaaactatttatatcaaaccatatcgtctgcctttgattatgataagtattcttgccttaagtaactttggaactgcaagccagcttcagtggtttatcactaaagaataatgtggggggctggagagatggctcagcggttaagagcactgactgctcttccaaaggtcctgtgttcaattctcagcaaccacatggtggctcacaaccatctgtaatgggatctgatgccctcttctggcatgtctgaagagagcaacagtgtactcatatgcataaaataagtaaataaatcttaaaaaaaaaaaaaaaggaataatgtgtctgggcccacatcttcccaagtctaataccctgctcccttatctgcataggacttgaataagcggctgtcgctgcctgcagacatcaggatacctgatggctacctggagaagctgcagatcagcagcccaccctttgaccagcccatgagccgcaggtcccgcagagcttccttagtaagtttttggccttgactgtgccgtaaggatggcttgcttgctcttcctccttgtcctttagttttttcccttcattcctcctctctctcccttgctcccttccctttcttttcttccttcctctcccttttgccctttcatgacttttaaacccagaggtttgcacataccaggcaagtactctgccatttggttgtaccccagccctgaagttaatttttatatgtaaattttaaatcactcacttagttgtagcacattattgtctacattttgtcatttttcatacttaaagagtgtactggaacagcacttgagttgtatcttacttttgaatgtatctgctggctggatgtgcaccatgcatgccagatgtgcagctgggtgggaatgctagaggcgcggcagagtgctcagacctggctttagctcagtgtgtttgtggtgctgtcatcctgtgtggccagatgaataaatgaatgctttagacactctcctgctacttttctctttacttaatactcctcattcctcaccttactcataattcctgccctcggataacaaaggtagttttacacacatggtcatactgtctcagttatactcttttcgtactatgattttatatttgagccttcttattcataagcatgttcacgttgtttctgaagtatttaatactttattttcattgacagagggttttgctggtctgaaattaacctgtaaatcaggctggtctgacataccgctttgcttagcctccttaagggctgggattacaaacctgttctacaatacctgaatctgtttcctacatactctcactcaatctttgaactttatgtattatgaatatatgttataaaatgtgcttatacaaatatgcaaaaagtttgtatattatataaagctgctgtaatatttaaaaaagtctaaaagctgctgttctgttataaaatcacagcatgcatgtacgtatgcaaatgtacttctgtagtttcctcatgttgttcagtgttaagtctgagcccatctgttttgttgtatgtagtcacagtctgctctcattgtatggtgcacagttgtataactgtactatcctttctgagtgttagactttatcatcctcgtgtccgtggtctccaagcttggtcttaggctctgtcatgtcggcttcgtcaccattcctatatgggtttgtttatgttactagagacaaagtaaaagctcccatagtgcctgctaccgaacttacaagttacactgttagaggttggcttactataagttataatttatcttctatataatgttttaatatttgtatgcctttgttgtaagggtcgcctgaacagggatttgcttaggctgtgaaaagttatttcttgaactaatgaagtcacaaaataaattattctcttggggtgaattaccataaaaatctttatttgtataatgatcaagttatggagtcttgatagtgttttaaaatgtaaggcttctagagccatttctaagtctctatgatgcctgttagttttctctatcactaaaataatccagggtagactgagtgcacattgttaactcaggaaaacagggatggcgcctgtcttctccctgtgctcagcacctggcgttgtcccgagcaaatgtggagtaaatactctttgtcgtttgtcctcggaatgatttctgtaggagagtgttgacaagctgccgactgttattaatctgtcatgttcaacagatgcatgtgcaggctaagttttctaaaaattacacttaaaagttcattaactgctatttggatgcaatcattgagtctactaagttcaaaattctgtgaggggcttgggcttgtgtgtctgattctctgaaccagaatctatctgacagccacttcacccatgtaagacattctgtctgaatttcctaactaactatgtggatggaactcagtaatactgtttatttttatagactaactacttgttcaaacataactttaataattacaatttactattcgctttctcttctagatatgtgtttatttttaattggcatattctgcatatttatggggtatggtgtcatttcaatacagagtgctttgattagagtaagcagcatatatatcaccaactatttatttctttgtgaggatatttatattagatatttgacatatacaattattgttgactatagttactttgtgtgtatatatacatttaaatgtgcatgtgtgtttgtaaacttgtgcatatgaacatgtatttgtgtgtgaggtatatactaataatgttctctaaagagagactctgtaatatcaatttctgatacatctgttatatcttattccatatgtacttggtattatagtaatttctaaaatattttctttacatagctttcattttgttgacagtacattatatagtccttatagcagacctcaatatttttgtcataatcactactggaccaagtgttcccagagtatggtagaattcgttcactataacaagatgagtgaattaagaagtcactgttcctgagaggaaaaagtttagcttatacttaacattttcccaagtgccttccattgttgataattgttgttagaatataggtgcttactgttttgttcatattactttgaatttattctcaatgtagtgttgttctctctataaaaaagaacaagaaaaactcactgccatttaaatgaaaatatctgaattctaaagatacccacgtataaaaaattttcatatagtttctatgaccttggtaattagctttttacttaacttttacataaaaaatagtccagaatccagctgtcatgggtcagataccttctataatgacagtatcttatataactccttaaatgtttattgcattttctaagttgaaatttaaagcttcccttgtatttggaatgtatttctgttgtaattttacccaactttttcatcatcattaattctgagtcatacataaggtagatagaacggttctaaaacttgagttttctaaattttttttccataaaaataccatatacatataaaaaaataggagaaaaaaccactaaatcatcagtaataccacctgtgaataaaagttttagtttgctgaaactccactaaatagtgttgtagtatggttttagcatgacatgtgtgatcataacacatacactgtgagaacagttcttggggagactttgcagactcgttagggtttaaatgccggtgatacttaaaagtcctggaggtttaaatgttcattagcagaaaatcagccggctcttgtaaagactattttaattgtaaactctgatgttttaacatcaaatgcattttagaacttgacaagtgttcaacaatttcatacttgttagagttagaagataaagaagtagagttttaagaataggcgctaaattccgaattgtttgctttcagtcagaaattgggtttgggaaaatggaaacctacatcaaattggaaaagctcggagaggtaagtatactctttattttaaaagcaaggcattttcttattatctaaactcaattagtccatgattcttgtcatcttagaaaaataaaggctgtagatattacgtgaaagactatataccaaattctgaaatgaccgacattacctaaaagactatatactgaattctggaatgaccactattacctaaaagactatataccgaattctgaaatgatcgctattacctaaaagattatatacctgactctgaaatgaccgctgtgagctaaaagactatatactgaattctggaatgaccactattatctaaaagattatataccaaattctgaaatgaccactgttacctaaaagagtatatacctgactctgaaatgaccgctattacttaaaagaatgaatatatatatactgaattttgcaatgaccactattacctaaaagattatatacctgtctctgaaatgacaattacctaacagactatataccgaatgttgagatgactgctattacctaaaagagtatatactgaattctgagataaccactattacctaagagattatataccaaattctgaaatgaccgctgttacctaaaatataatataccaaattctgcaatgaccactattacctaagagattatttaccgaattctgaaatgaccgctattacctaaaagagtatatacccgactctgaaatgactgctattacctaaaagagtatatacctgactctgaaatgaccgctattacttaaaagaatatatatatatatatatatatatatatatatatatatatatgtatgtatactgaattctgcaatgaccactattacctaaaagattatatacctgtctctgaaatgactattacctaacagactatataccgaattttgagatgactgctattacctaaaagagtatatactgaattctgagataaccgctattacctaagagattatataccaaattctgaaatgaccgctgttacctaaaatataatataccaaattttgcaatgaccactattacctaagagattatttaccgaattctgaaatgactgctattacctaaaagagtatacacctgactctgaaatgaccgctattacttaaaagaatatatatatatatatatatatatatatatatatatatgtgtgtgtgtgtatatatatatatatatatatatatatatatatactgaattctacaatgaccactattacctaaaagattatatacctgtctctgaaatgactattacctaacagactatatactgaattttgagatgaccactattacctaaaagactatataccgaattctgaaatgactgctattgcctaaaagagtatatacctgactctgaaatgaccgctagtacctaaaagagtatatcgctgactctgaaatgaccgctattacttaaaagaatatatatatatgtgtatatatatatatgtatgtatgtatgtatgctgaattctgcaatgaccactattacctaaaagattatatacctgtctctgaaatgactattacctaacagactatataccgaattttgagatgactgctattacctaagagattatataccaaattctgaaatgaccgctgtcacctaaaatatcatataccaaattttgcaatgaccactattacctaagagattgtttactgaagtctgaaatgaccactattacctaaaatatcatataccaaattctgcaatgacctatattacctaaaagactatatatctcactctgaaatgatcgcacaactagatggaataaatcttcttggtccttgaaaccttgcatcaggtaagatgaaattaatatttttggtagatttgtaatcttttgatgaagtacaaatgctgtgctctgtgagtaatggaatagggtctattgtttactcatggattctggcggcatggaatttgtatgagttcagagaactagctgtagagataaagatgcttcaccaaagttgagaaaattcttaaggctctggctttcttgagcttgcttcttcggcctgtactcctgttaatttttaaattgcctgcgatccacagtaagaaagggcaggaaaatagcaggcaagccttaagggagcttttagaggagagctaaggtgcacagattttgaggagcgtgaaggtctggatcaagtttttgtgattgaacattatcattacatcttcattgaaaatgctcagtctcctgtggtttttatgtatcattacctaagtgcccttgatatgaaatccactggtccagctgttcatttgaaataacacaagaataaaggagatgtggaaccaccatggtatggtggggatgtggatggtgtgtgcagggaactaagtcattgctgtaagaaaaaccaaataggatgatttttttttataagacatactttaatatgcttagaagttagaaactgaggtttactctgctctgtatactttttttgagcagagactcaccatgtagccccagctgccctgtaactcactacgttggctaggttggcttccgagtccctctgtcccccaagtgctcgaagtaaaagcatgcagtaccatgttagcagnnnnnnnnnnnnnnnnnnnntcttaaaatgttcttcaaaatatattctatagggtacatatgcaacagtatataaaggaagaagtaaactgacagaaaatttggtggcattaaaagtagatccgcttggaacacgaagaaggtgcaccctgtactgctataagagaaggtacagtgtttacatagaacttttggtccaagtcacattaagaggactgtttgtaaaaagtgctcagatagaaacacaatcaatggctggaagtcattctttggatcttgcaaatggtagtttttaaaaccaaagtactcaacagaaagggatcagtcaattgtgttattgtataactcacagtaaaatatttacgaagccattaaaatctctgacagataaatattgacctagaaaaagttctatattgttatggagagaccatggtgactataaattagctacatcaataaattttactaaatataagaaacaaatagcatatatacatgaccatgttgggttttgttttttgtttatttggcttttccagacagagtttctctttatagctctggctgtcctggaactcactttgtagaccaggctggcctcgaactcagaaatccacctgcctctgcctcccgagtttttttaaattgaaaatgtacacagcgcatacaatatattctgattatggtccccaccccaccccctatctcctaccagttcctccctacttcttcactcacccaaatccacatgtgcttttctgtctcattaaaatacaagtagatatagaaataataagatgagatagaaacaaacggaggaaagatggagccaaagaaaaagcacaaagaacacggagtgaaaggtaccctgtgctctgtatcacagtcagtgtcagagcttccaacagcgggcaggaagtcaggagatgccgcttggaatatcgggacggtttcaggaaatacagtgtgagacccacagcacacaaccagaggagtcagaacctcgctgcctccattgtcagtcctgctctaacctttgggctttatcttacccacagtcagctgtgttcccatagactgcctaccacagactaacacccctccccctcttgttgtttttccagtttcactgttaaaggatttaaaacatgcaaatatagtaaccttgcacgacatcgttcacacagacaaatctttgactctggtctttgagtacctggtaagtatttaatacaatttagcattctattttgctttaatataatagaaagttagaccttctaacagcctcagggacattgttgtttaactgttggcgtttaaatgcggtgtaatgaattctgtatgtttctttgaaaagcaacttagttataaaaattaaatgccccaagggagaggggaggtctgatggggtaggggtgggggtggggacatcctcttggtatgggacgaggaacagtcagagggcagactgggactgggcaggggtgggggggataaagactggactgtaaaaaaaaagactaaagaataaaaataataataaaaatattaaacaccattaggctgggcagatggctctgtgggtagaggtgtttaccaccatgactgacagcttgttctgtacctggggcttccatagactagagtcagctccctggagttgtccttggacccccacatgcatgccatggcacatatgagtacaccccaacatataaataaatacttaaaaaaagaaaaaagctctcaaggtaaccagccatgccgtcccaaaaccatgtcacgtgctaaagtgcggcatcttttcaggacaaagacctgaagcaatacatggatgactgtgggaacatcatgagcatgcacaatgtcaaggtatgttgtccatgcacttctgagcccgtgtcagcacagctggactggatcgcccagcacatagactggcctcataagccattcacatcggcgtggttaggttactaccatctaagcatatttagtcagcacctgttgactgtattacagctgttaaaaaaccagactctttggagtggtgctttgctttaaaggtcttttacacttttgacaacaatttattctcttatgtagggtggatatccaagtctgttctggataaaaagcccctaaaaaaaatacaaatgttgggtacaccctgtgaaagaccctttgaaggataaacgccactcatgtattgaaagaagtatttaaaatagccagttggacaaggtcagaaacttataggtaatagagatctgtgtgatcagaagaaaatcgataagctttcttagcgttagttatctaagaattggagtaactggagaagtttgctaaggcagctaatatcggatgaaactcaaaagttacttaacatgaaagcatttaacatagctgaattttcacaatagatatctttgacctaactggcataccctattttttttatcaaagatttatttatgcaaaattaatagttcctggaaacctattttggaagaaggcagtgtgtcatgtgtggttgagacatttctaattctgtaggtagtaaatttaactttttctttaaatagtaatttggtagaaatagagggaagccagtttgttactaacagagtgctctgaagacaggcattgctaagaccagggttttgaatagattttcatacattctatgagttttttaaaaaatatttcatcatattttataaaatgttatgaatagcatttatatatttttgttttgctaattttgctttctctacttagaacaataatttggaaagagcatagagtttagctgtcataatttgataaaggtttgcaaagtccctgctttttaagttaggtccaagtggtggctgtaaggtgaaacgcgttttattgtctggctgttgaaattacacttaacgttttccaaggatagaatgtgacagatactgagataataattctggagttctcagaacatagcaatgccaactctggaaactgcttctgagaattcattcaggcctctccacatcctccgccgtgacctaaagacactctgcatcttctgtatgcagcctctctttttctaaccacaaagactcaaaacgctttccttcttctaaaatacacaaaagcccttagccattaaccttacaggagtccctttctcgtcgttcagagtacaatagtgcctgggcccctttctgagtcacagtggagtttgaagagtgagtaggaggcgctcaaagtcaagtgcccaggaggtgggtgaggagcctcttacttttatagcaaatggcttgccagagctaaacagcacttttctgatagcctggctcgtctgaaaaaacatcaaatatgatgcccttttaaggtgatgctgctgcagatcagggaagtgtttgtgtacgtgtgtgtgcgcgtgtgtgtgtgcgtgtgtgtgtgttttggaaggagaaatcagtgacagggtttgcttggttgttacaacagaattttataatcaaactataggcctccaaccaatgaactgctgttattcaaagttttatgtgtagtgtttattttcctggttctcattgggttaaaaactagttgatgttttaaattgaacaatgaacaatcaaattcagaaaatagctgcaagaggaaaagatgtcattttaattggctttaattgcttgatttttctttatagcaagacccgttccattatctgtaagactgcttttcatttgtttctgtagctgttcctgtaccaaattctccgtggtctggcatattgccatagaagaaaagtgttgcaccgggacttgaaaccacagaacctcctcattaatgagagaggagaactaaagctggctgactttggtatggagagataagatattcattattacttccaggtggctaagtgagaagaccaccgttttcacagagtgtcgtcaattttctgtgtgttttgacgtgttctctgtagctcagagatgtgtgatggaatttaggtgaatggtttattagtgaggaacacgcacgtgtttcctagcatgctgagacctctagaacttctaagactttccatggtgtctaaagataaattcacactcagaattactgttctccttgctttttcctgggccactctttgcaccgaggactcaacaccaagtaagcagtagagtcgctggttccttggtgtatttgggggtattcagggcagggcatgtgtagtcctcactgttgacatgtttaggggacaagtgtcagttatacctgggatacttgattctgcagtaaagtttattttcctagactataagtcaatacaatatttcttgtgataaaatgaagaataagcataaaacacattgagctcacacagaaacaacagtaatctaaagagaaagattactaggggtccttttctttctttctttctttctttctttctttcttaaagaaacaccatttttcctaggaaatttgggaccaatagactgattatttagtctttaacatttgattttcttaaaaataaattattgcccttcaggcctgagttaggcagctttgttgatatttcatgggtgtggcttccctgacatttcagggaggtgtcctctcagcagatttcctgttcctaccgctttttcactctttctgtccctctttggagttgtcccctgagccttaggtgcaggagccgtgtcatagatggaccagttggggtggggccatgtgcagggtcctccttcttctcttggtctctatgaggttcattcttgtcatatgtatgtgagtgattacaaatttgataatttgatgtgctgtcctctatataccatgtatatcaaagaaaatgatatccagttaccctttattaacatgaaatttaaaataagtgataggaatataagatttttttttgccttggaaaataactttttattaagatattattgcagacagcttatgactggtgagcacttgaggttcgcatcgtttctgtttttgagtcagggtctcactgtgcacctacattgtccccaacctcatgatcatcctgccccagtctcttgaattccatgattataggacagagtcgctgcacctgaccgtgccttgtttttaatctgtaaataaacacctttccattttctcagtgttggcttacagatacggtaaatgtcagtggcccatgtaaatagaagcacttggcttcttaagtttgacgcgtttatgccagatcccgagagctggaagctgcctctgaaaggcgcccccatatgctgaccacagctgactgcttttattatctgctcggtgacttcactagccgctggataaccttttagctgatctgattttatgcgacctgaaaataaaacgcagtgacgtgcacttcgcttttaggaagtaaacttgtatattgaaagaacgtttttagagtagctttgattttgagttatatacttagaatttgaattattttaataagttagttatgttagtaacaagttaaaaactcattcttactgaatgctggatttgccctggctattcatggacatttgtttatttagtatgttgttgtttgtttgaaagggatttgctgttggctacctgagattgaagcagacgctacaggttaattttgtatgcttgtatagatcccgtctctacttcctgagcatcattatgtcattcccttacacttgcccctgcacccactccctcactttgccaagctgctttttgtgcagcttgcgtggaatcatgcaaagggtgtgtcaaagaccatgggaaattttttatctgaaagtactttgaatctagtatttcatgcttttagcctccagaaagcaaatctcacaacacagtcatcattttctgattcttggcttgttgttgtgttgttgttgttgttgttgttgttgttgttgttgttgcatagcatatatatggcttcaagtaatgaatgttgtttacttttgattatttctgctgttagtttagcctcccccacccgtactcctccttgatggtgctgggatcacagtgagagacttgagtaagataggcaagcactgtctctgaattacagccctaccttctttacttactcttgattcctttgaaaatgtcaatattatagtcagtgaaattcacaaaaaagcaaggtcaccgtggtatagtgactcaaaaaaccaaggaagaggaatcagagctaccctacatcttgctaattactaaaatgtgtggaaaaataattcgttgggcatgactgtatcaagctggaatgctagggtcatgatttgtaattaaaataatgtcagcattacattattttaatgaagtgttgaattactactgtgtatgacatttttcttcttcaattttttttcacaagatacataaagccttacataacagcaatcttagcataagtacccttattacttgaaacaaaatatatggtaaaaataaggttatatttgttcagatgtaaactcagtgactacagtctagaggctatggggagctaactctccagcagtggcaaagcaagaaggttgggaaccggtctgtctgtctgtctgtctctgaacacagtggagcccatagggaaccggtctgtctgtctgtctctgaacacagtggagcccatagggaaccggtctgtctgtcagtctctgaacacagtggagcccatagggaaccggtctgtctgtctgtctctgaacacagtggagcccatagggaaccggtctgtctgtcagtctctgaacacagtggagcccacacatggttgacagggcagacagttgcttacagcaggtggcattatcccagagtatcaaggcctcttattctgaagttattcacatcacttacatcattaaaatagacaaagactgctgaattttattccagggaaatcgcctaataggttcaaggaaattgccagtaagctccaactgattgtataccaatgatcttgaggtttaaaattttaaaacatagtatagtaaaaaaaaagacaaaaaacaaacaaacaaacaaaaaaaaaccatgtgatttgagttaaacagtgatagctagtttataacggtagcaagcaaactgcgcctcagtgtcactgacctattttgggttaattccagtgggaaataattccggcatcctgactcatcaacagaaaatatcttaagtttagataaactcagacagacactgcaccagcttcgtctctcactgtataattactgtgttcagtttaattatataatattgacttggcccaggactacatacactcaacagagtttataaatctacttttttgaagttgcaggaagctatagagttggcatctcttgaaatgggtcatggcgacagtagggctaagaccttcagcatgttaatggatctcagtatttttaattcttctgttttcttttctctgtaaaggactagccagagccaagtcagttcccacaaagacctactcaaatgaagttgtcaccctgtggtatcgaccacctgatgtgcttcttggttcctcagaatactcaacacagatcgacatgtggtaactacagatgccatcgccgtttatagttttgaaagagcatagctgttaacagggcatactgacaaatgcttacttttaaagagttatttcaaagagtttgagcagtgagtaagaattgaggtgtgaaaataaaactatttagatttaaatataagtctaccactaatggctatattagactaaccatcttattcacattagtagcccgtgccttcatctcctccgttaaggaggtagacaaagtaatgagaaagtcattaagcctgatggtattaagcctgaatgagccaacgtgcacagagcaccttttagaagagtacatgacacatagcaattcaaaaagtattgtttaatatggaaaatatagctactttaagttggtctaaaaataataattagagtttcaaagatcttcttatgcattattacatatatgtatgtaggtgttatagatatatgtacatgtgtgttcaagtgcactcgcctgtacatgcatacacaatggaggccaaaggtcagcatgaagcatgctcagataccgcttttcacttttaaaaagttatttatttatttatatttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttatttatttgagacagtcttccactgaacctggatagacggactggccagcataccctggggtctgcctgtctcagtcgggcctgtagcactgtgtgcagcactgtgtgcagcactgtgtgcagcactgtgtgcagcactgtgtgcagcactgtgtgcagcactgtgtgcagcactgtgtgcatgggtgcagaggatctggactcagcttcttctcacgctgtgtaacaagcactctagccactgagccacgtccaagccaatagatgcctcagtgcccctgtgcttggctaaccccatcactgcctatgcgctacaaattgcatttccttgatccaggagatacagagtttcatagtctataaacttccctttctaacttaatctggcctagttcttaatccagacgttgtcttttagcaaagttgctctttgctgttcgagcaagcaagcctgactctcccagctctgttgagtgctcatcccaatctgcccgttggcatgctcctcacccaacagggccacacttagtaattaattcccccgggtttgtcctcagtcctttcctgagtgggcctggcctcagaggcagctcctttctcaatcgtggctgtgtttattatgtcctccttatgtcctggtaagttaatgcttgttttcctgtcttgagcaattgcatagaatctcatttgcaggacttttttccgttagttctgatatgtataagataaaacttatcattttacctagtttagctgtgtggttttgaggttctaagttcattcattacactgttgtacaaccatctccactatccatccttttagaaatccaaaacttttactcttttaaactgaaattttacctgttggacaaccattctaccaattttacttggtccttggtaaccaggtcactacttcttgcctctgaatttacctgtcccaagtacctcatgcaagtgagattctgccatacttgtctgccttctgctgacttactcagctcttctcggttaccatggtgtcttcatcgtccatcagcactgtctgtagtgagtctcctcaagtccttgtgcgtacactccacactttgtttactcactccttgtgcgtacactccacactttgtttactcactccttgtgcgtacactccacactttgtttactcactccttgtgcgtacactccacactttgtttactcacgtccttgtgcgtacactccacactttgtttactcactccttgtgcgtacactccacactttgtttactcactccttgtgcgtacactccacactttgtttactcacgtccttgtgcgtacactccacactttgtttactcactccttgtgcgtacactccacactttgtttactcacgtccttgtgcgtacactccacactttgtttactcacgtccttgtgcgtacactccacactttgtttactcacgtccttgtgtgtacactccacactttgtttacttgttgggcacttgagtctcttccgtcaccactgtaagtgatgctgctttgacggggatggacctagtgtttcaagacgctgcactgggctctcttgcttgtttacccaaaagtgagattgcgggccatagcaattgtatttttaaatgttgagggatcatcatactgcttcctataacaacgtgccattttatttcctgtgaactgttgtcagttttgtgaagatttactgcctgtgagcagtgctgtggaagtactgtgtcgcaaccttctgtggaccacctagttcccaaataataatgcctgttctctgagcctcgtcctcctcttcccgcccttacacagtccctagccacagcaatctgctacagtcaccgcttcctgcatcgggcatgagtcactcattcacttctctctgagtgaatcatttgttcacttctctctgagagaatcatctctctctgagcaaatcactcattcacttctctctgagcgaatcattcattcacttgactctgagctgctgtagccactgtcacctcccagattgccatagcgatagtcagcactccatcactagtaagtggtgttttattctttaagaatcttacaaaaaagaaagctagaggttttaagtggggaaaaggattagtagcattagtagtagttgagattgtaaatttaataaatttgttggattcaaaagtatctgtacagaaaattttctgggaacctgatctaaaattctccagaaaggcaatcttgaaaaaatattatcttgtgctaaccaatgggtaaatggattgatttttttctctctctctttttttaaatgatgcattttaaaggggagttggctgtattttctttgaaatggcttctggaagaccactgtttccaggatcaactgtggaagatgaactgcatttaatatttcgactactaggtaagaaagaagtcttttttcccatgattcacacctgcagttgactagttaaattaggactgtatctgtaaagcataagtatgacatgtatccatagctgttctgataagaactgcagctggcttacttgttacaggggggtcttcaagctaactcagcttcatttcataaaggttttaggaaataagatttgaccttatacatattattaagagctattcctagtgtaggtgatgccatgaggatagaaagggagttttatcatatttagggcatattttcattggccccaatccacatgtatatatgtagtatccctaagtgtacatacagtgtatacacacacaaaatattattttaatttcaattgaaaaagttaaatcgtttaataaaagtatgatgttcttaaggatagttcttacttatgcctgttgatatatatgtttgcatgcatataatttaaatgcttatcatgaatttattcttttaattcaggaactccatctcaggaaacttggccaggtgtttcttcaaatgatgaattcaagaactacaacttcccaaaatacaagccacaacctctaattaatcatgcacccaggtatttttcttcttaagtgagaagggccagactctcatttgatgttcaagttcattcaatttatcccttcctttgacataataattttataaatcaatgccaagaatcaccaaagcatgtaaatagaattgagctgtaaagggactatagaatacatatattagaattccaaggcttatgtaggtagatccacaaaggtgaagacagcactcctgcctaggagttatattggctatgtcattggtcttttagccatattgctgaagtgtttttgaacttaatactttatagtagccattgcttagcaggttgttttgtataatcttcttgatggcttatccattttgaatgccattgatatattttggggtcactgtctcaattttttaacctacatgcagggacggtgatattttggtgtgtctgccttcattgacacactgaatatttgtaccctatttaaactttctttataatagagagtactttggggatagaatgctaacttcaaaatttctatagtattagtaatttttcttgaatattaaaattgtgaatagcagtctattcatgatttgttctcaagcaaatagcaagatgagctttttagggataaacagagttgggtctttgaaagcagtaaagatagttattttagggcacttaaatttggcaaatggaagcatttggaaaataattttacctgaaaggtttctatcataaaagaataaatggacacttgttttggtttcttttatttttttgtttctaggttagattctgaaggaattgaattgataacaaaatttcttcaggtaagtcaatcttattttataaagttaaatgaatgagtaagtgtcactttcctcataggaaaaatagactcactagtaaccccatcaagtaccgttagcagtagtaggatgcctatggtgcttcctagggtgcttcagcagctcagagccatgttctttgcagctcatgctctgtgtcctctgcttctttgtgcttcctgccatggcggatactgcactttcaaatagcactcctcctctgttttccccagagcaggaagacgagatgacagggtagcaacattaactctcttatatctcgaaagcataggcttttcccaagtctcactggccagagcattcattgtagaaacaaaacaacacaaagagagtctgggaattggggaattagcctcgacctagaacagtcatgatttgtctgttggagttggaagcatgagcatcttgagcaaatctaagttgtgtcattaagagaggagcaatggcttttatctgccgagaatgtcggctataaaggcactgggcatggttctgtcagtacatttcacagttcacaaagaaaaagagcattaaagattgaatattttaatttttcaccacttcagaaaaaaatacaagaatctaattttttatttagaggcttagctaggaaatgtggaattgagatagaattattctccgactttgagtgtattgggaggattctaaagtgatgttaggaaattgtcatattaagtaatcaggagtttttaaaagtagttctaaatactaatttatcctccttcaacttcttatagtaattagacagaggttgatgagccgctttttgctttttcacagtatgaatctaagaagagggttccggcagaagaggccatgaagcacgtgtacttccgcagcctggggccgaggatccatgctttgcccgagagtaaggagccctcgcgctcgcgctcgctcctctgttcgtttgtctagggttgaggatcagcaggcttatgatttagtaatttttgtaatcagatcataatttttccaaggaagtttttctcgtcttgttttccttgttcatgtcttatagctctgagtatgttgtctctcctcattaagaaatccatcatatttgagtgtgaatcattaatcttccttgattcaaattagaatatgctggcaacatcatccttagccctaatctggctaaaagtggatctctagattggataggtggcggcgtgagcaaagtgtttgctgcacgctgtgcagacctgagtccgggtcatcaggctccctgtaaaagcgctgtcctacacctctgtaaccacaggacttggcagggtgggaaccctgagagctcactggccagcctagtcacaatagtgagtgcgcgcacacacacacacacacacacacttctgaaaagattagtgaagcacagtcagagtaacaagatggcttcctggagaaagtgatttccttcctgagaagatacaaaggaagtttccctttcttgcggttgctctgactgtactattcctaagaaattagtgagtctattatcaaaatcactaaagtagaaaatttcccaggcctgaagtaactctttaattttgtccatgctgccttaaattagtccagtgtttaagtgggctgagcggggaaggagggcagtgtttgggaactatggaagctatcaccatctccccactccctttcactaggcagtgcttcttaactgagggctgcggaacagtcagtagcaaaacccatcagaaaatccacaagacttctcgcgtagaatttggttttctgtttagaacttagggacaaatgggaaatctttccatggggccataaccttgggggcacaggatggatgtttgacattgaatcagtatgcgctttttgaataattacatttgatctagatttgtcattaatatctggtaatttctgtctgttcattttaggcgtatcaatattcagtttgaaagagattcagttgcaaaaggacccgggttttcgaaactcttcctatccagagacaggtgtgtttgtcataaaccatttcacatgtcgctcatgaatttttttgcgtggaaccaagctttgggttgataaattgatcagtaaaattatcgatgtaacaaacaaacaaacaaaccaatgtacagtgcatcccacaactctgtatgtttagaattgcacatacttgctgttgtgtatgatgggggcacctcagtaaatcttcagagagaaatgtgattcagtcaagtcagggatcctgaaagctacagatggcagagacctttcccaagtggcctggcttgacctctgcacacgccatccctggtgcccaaggcagaagacgcagcctgtgcatgcctagtcatcagcttcatcacttggaagcctagacgctgtagactgaccccgtcaacacagagggcacttaagacagctgatcactaaccgtggaatgttagcgtttgctggtgggaacgttagcttcctagagtcaccaaatactgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacagattcatatgtaatggtgaatattggaccactgctgctttcacagttgtcagctggttttatgttaagccctgtagcctaactgctgttatttctaactgacagacatgtattaatattgtactttgaaggttataaatattatgtgaaaattccttcatttgttttgaaatttataataactaaatctctgtgttatataaaatgtgatttttgtggagtcactgttctttattggggaagaaagctgtgcacactggggtcatcctccttctgggttatcattgtcaggtgacaagatgtcactgtgctgaaagtgacagccacgttaggtttgtgccgaccgtttggttagtctcttatgggatctcctgagatattattctttacttatgaagtatcagatttgttaatttgatttgcagattggccttagtttgtcagtaagcttgattcgtacatataaagagtatacaggcattatttaaaattctttctagggggtctagggtcttacggttaagaaatgtgcatgggttgcttttgtttgttgacgtttcagccttatcctgatcctggaaactgcagagaggagacttaaaacttggaaagactgaacctggaactctcagaagccccttaaactgacaagaattctgaaggtaagaggtgctatatcaatcaaacagcacatccagggtccttcactcaggcattttatcagcttagtttgaaagaatatttactacgttctaatctatctttcagactcatgaccctctttacgatattaactgcattcacaacatgacagtgaccttgatttatttccagaattgtcttcctttttcagaagttgaacttagtaaaatattccactcctcccgccaagcttctcagaactattaatttactctctgtatgtatgaattttcctagtctagatactttctgtccttgcagccataccagtttggcttatttctttcaacatcctattttcagagtttctctcgatggcggggtgatgttccgctgtgactgagcagtgtaaagactgtgaacattggtgtgcacacatgcttgagtcggaaaaaaaacaaaacaaaacaaacaaacaaaaaaccaataaggttgctttgttacatggattcccaatctgtccttacaaagcacgtgcttttcagttgcttcctcctgctctctgacagctttcacttgtagatgcccagggaggctgacatttaaatatcacttttcactcagttcctagttctacaaaagaccagcaggaagcccagggtggggtcacagtgaggactgccctgacttttaagtcctgtctccacaggtgggtactctctctctcttaacaacacttttcctggtccttgagttcagggagtcctttgtttatttagattatctttaactgttctcagcagcgttagtagtttttacataaaagttttcccctccatgcttgagtttactcctaagtattttttgctgctggtgcaagcgggataattttcttcatttctgtttgtttgtttttcattgctagtgcttggaagtacagatgatttttttgttttgatcttgtaacctccaactttattgaatttgttgcctttttaaagttttttttttttggtccattctttatgatcttctacatataaaattacatcatcagcaggaagaaatagtttgactttttcatttataatctggatgccttttcttctcttctctgtcctttactccccccctcccatttcataattagtctttagacctccagtattattgagtagtgaatgaaggccagtaacttgtgttgctggtcttggggaaaagctttcagccgttcaccaccccgtgtaaccagcagtgggtataactagcagtgggtgtgtatacagccctatgtttaaggagcttccctggttgctaggttactgcgtgtgtttattaaggcgggggggggggggggttgttggctttatcttctagatactggtttgttggctttatcttctagaacttttttgctgtcgtttttgatgatcatgctgttttctttgtttattaccttgatttttgtatgacatcagcactgcatttcttgaaagagtcccacttggtgatgaattaaagtttaatccccttatgaaatcatttgggactaaaagcatctcagatttcaaggaatttttcttttgcccccagtttgggatatttgcatagcctgtggtagttgaacatccctgcttcaaaactacgaagtctaaaatgcttcaaaatctaaaaatgttttgatcattgttactctgaaattttcaggtgtcagtgccttttagatttcatattaaggatgtttaagttgtaattctttaaacatgctgctaagtccagtttgctagtattttgttgagaatttttgcctgaattcatgatgggtgtggcctgtgctctctgctcacagcatctgtctcaatgatttcgtgttagcattgctgccatctgagatggagtgaaggccgcatcctccccttcagttatgtgaagtggcttaggatattgtcttaagtctccgaataccgcactgttttgtatttagtttatttttttatagtagaccatcttgatttccttcctttctcatgtgtatgtgtagttgttttaataatatattacaaatattattttgagtttgtgtggttttaagagatttatccccaaatatcatccctttctattattctgtcagtggctctagtttttaaatattctaatctagattcctaagtcaattctttgtttattttacattttcattcattcaaaatgccaatacaagctcacaagcttggtagaattaaacgtgtttaatgtgttcctttacacacaatgaaatccatgttttccttctataaagttttctaatgctaagttcagaccctggacttgcatgtcaggaggtttgttaccatcattcctagtcaagagtttctacttctaacctaagaaaactactgacaacatctgtccatccaaaatgggaagcatataagtaaattaactgattataaaactacgttgatgtgaaaagaatgtaagacttgacctacgatggttggaaggccttttcattcctggcttctccctaagagaaattaatttattgggaaactaacattcttttaaagctaccacttgacagactaaagtgtacacttgtgagaaagacagacaaacaagtctttcatagcaactgtggtgctgtccctactgaggtgttaatgcagggttgcctgggctatgtgggagcgtgggtgaagatggagctgatgagcacctggtcttagcacctctgggtgcagaaagctctgcgtctgaaaggttttcctctgggctgtgaacaggacatggactcttagtgcagactggattcccggaacagtgctagcgaagagttagaaacactccggccccttccgcagctgtagggacagttcttacttactgccatctttccgtttcctcctgggcgattgcatactaactcagtgaaatggtggtggtgtaggctatagggtcatcgtggaatggtgctcatgtgtcttttgttttttctggaaacactggaactcattagaaagattgccttggaagcattccagctgtttggcttttccagacccccagccagccattctttcaggtcttcttagctacctggaactccccccactctgtgccattcttttagaacttatgttttattgctactaattattccacattgctgtctcctaccatgatttactctttgatcccgagttacccaaatgttctcttctcttgcctctgcttgagtcttggctgattcttctggaagtccttccctgtaccctaccccaccacagactggcttatgagtcctccagttttactgccctcctgtctgttgtccatgtacttcagaatatgataatacttaatcactttttatcatcactcaataactcataagccctgtgaaggggagaattactatgtcttggactaaataaagacataagagtgaagaaatccttgtttgtaagtaaaacccaccacttacgttatattgttaaaaacccaagaactcagaggcagaggcaggcagagttctgagtttgaggccagcctggtctacaaagtgagttccaggacagccagggctaaacagagaaaccctgtctcgaaaaaccaaaaaaaaaacaaaacaaaacaaaacaaaaacctaagaactcataatcaagttgttctacctctgcccccctacacacacacacacacacacacacacacacacacacacacacacacacacacacacacacaggggaggggatagcaagagatctcacacaggactaggaataagtacaggagaagtccaggcagagcacactataattactgggaatctccccggcaacaatggtgtgtgcatggtacaatgtaaaggcgtagattactagttcttaaacttaaaagactttatcttttaagcatattgaccaacatccatggcctctgcaatcaaagtgtaattttgaaaactgactagctgtttgagtcagtgatttaactagagttggtctcagttcccttgtaaaattatgtataatagtacttctctcatagagctgtgtgcttggagttggagctctggactccagctgagtttctttgagtcagttatttaactacagttggtctcagttcccttacttgtaaaattatgtataatagcacttccctcgtagggctgtgtgagtgctctggacttggagcagtgagggatgctgagcaggtgtgaagtagtttagaagtagttcccaccagtaactaaacctatcatgtgatggaatgaaaatgggccttaggttccagagtcatttggaagtgggtaccagaactcagagtcagtcctgtattgggggccaaagaagggactccagatgcagagatgtcatgcctgaagattaaaacaaaggacacaggaccacacacggcatcctatcatcttgggtagaagctttctgcagtgcttccgggagtcacagttggttttcagatgtttcttcagtatgtgaataattccctatcacaccgacaaatatatcctatctagctatgaattcgtgtcccttttcaaactgtagtgacattgaacatcagtctgggtctctggttatctgctatttcttccttcctacacacacacacacatacacacacacacacacacaccacacacaccagtcttgtgaaccaacccacctggtgactgcactgagatcattggaaataaaacaaagaatcgcctttgccaaccagtctgtagttcatatgaccctgtgtcaacaaaatgggtaaaaggaaatattagcttctccttttcctcattttcttacctctgtgtagaacaactgacagaactttgatggaggtggtggtggtggtggtggtggtggtggtggtggtggtgttgtgtttgtgtgcagtgcccaggcgcagactagatgacatcagcagtcccactcagcaatcttccttatttctttcagacagggtctcacttctaggcctctgcatttcagctagactggtggcctgcaggcctcagaccagtccctaacacccacagggctggacttataggtccatgcacagtcatgccctatgttgcatgtgagtgtccgggtcctcatgctcgcttactcgccaagcagtctttgcagccccatgtcttaaggtcaggagaccatttcaaacccattttactactcccccagttcatcctcagtggtggggtgtgtggtggggtatgtggtggggtgtgtgggtagggtgtgtgtggtggggtgtgtgtggtggggtgtgtggtggggtgtgtgtggtggggtgtgtggtggtatgtgtggtggggtgtgtgtggtggggtgtgtggtggggtgtgtgtggtggggtgtgtgtggtggggtgtgtggtggtatgtgtggtggggtgtgtgtggtggggtgtgtgtggtggggtgtgtgtggtggggtgtgtgtggtggggtgtactgtagtgggctctagagtctcacatgtgctaggtaagtactgtctactgcgctataatcctcatgcgtatgtaaagcatttgatgtgccatatgtagagataggaacttatatttatccatcttgttgacacagaagaagcggtatttgagtcactgtaagtaaatggaagggaacaaacaccctcgaatccaaacactcttttattacaaagtatttattcagcaaaacagtattacagtaaaaacgacacccgtgtggcagcggaggaagccctgcagccgtaggaaagctgtgcgcagggacggagttcagctcccacagtgaggttctagagctccaacctcagcctcagcagtcaaacactgatgacgcaagcatagaaaagagagccgttccggctgaatttctcctgttaaaaacacagaaggcagagaggctgtcgttctccattctacagtcctcatgccagcatctgggtccacaggagaatcatggtagttggaagaaaaggaaccaacaggcagacttacagtcataggaacatttccaaccagcgtttatagtttaaaggtcgacagaaggtcatcttgttgagatccctgcacatcagtccctttagtttcttcttaagactcttgcacatcaaatgcatcctcatctagccattttaaacattccagccttacgtttccttacgttctgaggctctcttactcttccctcagtggatgctatgaccccaggcagctccaggccagcttctccacccccaccacccctgtcctatgtgcctgccttgaccagagaacagctggaagccagcactctcaaagcccctcccagctctgacactgtgttcggtaattacagtctcctgaaccagctcctttttattttagtacacatttattcttcgccgtgagggagtggcagggcatctatttatgggcttggagctgtctccatggctttacagtcagaggtttttttctccccttagtaaagacacacgccccttagaaagaaagtcaacttcggtagttaagtctcaatgtgtaagtatctaaacataagtttagattgtttaaaattcaaattttttgcacgagctttgtttttttaacccccttataatcctctatttagtatctagtctgtagaggcacattgcagttgtttgtttgtttgtttgtttaatacttatagatgagtggtgtttcagctcacctgatcttgaatttaaagtgccttgccttcagagtgttacagtagaacttccccttaagcacaggtgtgctgccttcagggtctcaccagatgagaggctgctcgcgtcacagccggaagccatactcagcacgtgaagccttccttgcggagcatctgaggagctgctgcatccggttcagagggagatcctgacaagtcttcctttctcagagtccctttattctcatcatcattactaccgaaagcggtggctcttgagtgctcatcctcagaagcaaggccttcagttcctccagctcttagtaatgcattggatttaatccatcaaaaattatatctacacacaggaaatatctctatacatggctggtagtatataaacatttctttgtttgaattcaccatctgtaagcatcttccaaaacattcttagtttgtttcccaccacgccctttttggggagagacagggagacaggttactgggggttatacccgcagcctcaacacatgcaggttacacattctatggagctatatcctcagccctaaaacattaggttttaaatattaattgtcatgccaggaatctaaagaaaccttaactcccagtagtgacaaagataccagatggttgtggttgtaggaaatgaagagagcagggctagtctcaaaattaaatacaaacctggaaagtccccttgagagtttggctggtgtgaacttaacggagccttagcatctcagacttctgcaggaagtagaaaggcttctacaaacggctgagcggcttggtctctcaaagttcttcttttaaaaaagtgcactttggaacatgttctt

SEQ ID NO: 1502 - DNA, 1283 bp, Mus musculus
ttcagaatttttcaaaccacatccaactgataggatgaaaaagtttaagaggagactgtccctcacgctcaggggaagccagacgattgatgagtcgctgtcagagctggctgagcagatgaccatagaggagagcagtagcaaggacaacgagcccattgtgaagaatggcaggccgcccacatctcacagcgtgcattccttcctccatcagtacacaggctccttcaagaagcccccgttgcggagaccccacagtgttattggaggaagccttggttccttcatggcaatgcccaggaatggaagcagactagatattgttcatgaaaatctgaagatgggatcagatggtgagagtgaccaagcttctgggacatcatctgatgaagtccagtcacctacaggtgtttgcctcagaaatcgtatacatagacggatctcaatggaggacttgaataagcggctgtcgctgcctgcagacatcaggatacctgatggctacctggagaagctgcagatcagcagcccaccctttgaccagcccatgagccgcaggtcccgcagagcttccttatcagaaattgggtttgggaaaatggaaacctacatcaaattggaaaagctcggagagactaacacccctccccctcttgttgtttttccagtttcactgttaaaggatttaaaacatgcaaatatagtaaccttgcacgacatcgttcacacagacaaatctttgactctggtctttgagtacctggacaaagacctgaagcaatacatggatgactgtgggaacatcatgagcatgcacaatgtcaagctgttcctgtaccaaattctccgtggtctggcatattgccatagaagaaaagtgttgcaccgggacttgaaaccacagaacctcctcattaatgagagaggagaactaaagctggctgactttggactagccagagccaagtcagttcccacaaagacctactcaaatgaagttgtcaccctgtggtatcgaccacctgatgtgcttcttggttcctcagaatactcaacacagatcgacatgtggttagattctgaaggaattgaattgataacaaaatttcttcagtatgaatctaagaagagggttccggcagaagaggccatgaagcacgtgtacttccgcagcctggggccgaggatccatgctttgcccgagagcgtatcaatattcagtttgaaagagattcagttgcaaaaggacccgggttttcgaaactcttcctatccagagacag

SEQ ID NO: 1503 - protein, 428 aa, Mus musculus
  VARIANT (1)...(428): Xaa = Any Amino Acid
SEFFKPHPTDRMKKFKRRLSLTLRGSQTIDESLSELAEQMTIEESSSKDNEPIVKNGRPPTSHSVHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQISSPPFDQPMSRRSRRASLSEIGFGKMETYIKLEKLGETNTPPPLVVFPVSLLKDLKHANIVTLHDIVHTDKSLTLVFEYLDKDLKQYMDDCGNIMSMHNVKLFLYQILRGLAYCHRRKVLHRDLKPQNLLINERGELKLADFGLARAKSVPTKTYSNEVVTLWYRPPDVLLGSSEYSTQIDMWLDSEGIELITKFLQYESKKRVPAEEAMKHVYFRSLGPRIHALPESVSIFSLKEIQLQKDPGFRNSSYPETX

SEQ ID NO: 1504 - DNA, 142318 bp, Homo sapiens
  misc_feature (1)...(142318): n = A,T,C or G
agcacctttaattgcacagatgatctacagttcagactaggaatataaaaagaggcaaatttacattaaatacacacatgagatggaacaatatctcaaacttttcagattatttccacattgaggaagtagagggagaagggaactgacatttattgcatattacagtctgctttaacaggatatcctggatttaccaggtcaatattttacatagagttaagtaggtttcaggcacgcctcactcactgttgcccactgctacactcttgcactacagagataaaatgtcaaaaaaaatattttggctgggcgcgcagtggctcacgcctataattccagactttgggaggccaaggcaggcagatcacgaggtcaagagatcgagaccatcctggccaacatggtgaaaccccctctctactaaaaatacaaaaattagctgggtgtggtggcacgtgcctgtaatcccagctaattgggaggctgaagcaggagaatcacttgaaccccggagatggaggttgtggtgagccaagatcatgccactatactccagcctggcgacagagcaagactccatctcaaaaaaaagaaaaaagaagtatttttaaagtatacttatagcttatattaacctcttctttgaccctgaggctagaaaccaactatgggttaagcgatgtgacttctatatagatatacttacagaaagcccacatttttaacagtgtgttttgaaaaattcaggcttgtacagacaggtcagataatacagtggtttcaaatggccattaaacagcacagtgttttggatcccattctctttctgtttttaaccgaaagattaacatgcaataaactgcacatctttaaagtgtccagtttgataagtgtacacccataaagccatcaccacaatgatttaaaaaagagaacacatttgtcatcctccacaagtgtcatgcgccttggtaatccttcccttcttcagacacaggcaaccactgatctgctttttgtcactatattttgcattttctatagttttataacaatgtaaccatacagtgtgtgctctttatttggtctgacttctttcgctcagcgtaattattttgggattcatccatgttgttggatgtatcagtaattcattcctttttattgctgagtagtatcctacagtatcaacttgtttatcccttcacttgtccctttttttgttttgccctcctatacttgtcaaaatttatactttctctaattttctttttttctcttttttttttttgagacggagtctcgctttgcctcccatggtggagtgcagtggtgtgatctcagctcactgcaacctctgtctcccgggttcaagcaattctcctgcctcagcctcccaaaaagctgggattacaggcgcccaccaccatgccaggctaatttttgtatttttagtagagacagggtttcaccatgttggccaggctggtttcgaactcctgacctcaaatgatctgcccatctcagcctcccaaagtgctgggattacaggcatgagccactacgcccggccctctctgattttcaatttctgattatgcccttggcatttacccatgtatagtggacaccagtggtttctgaccgtcgtgcattccaccccacacctgttacttctgctagaagcaccctccactcctttggacaactgcgtcttccccattccatgtagtctggtgggacccttctgattagtatgatgcaggccaatcagagtctttccttggaattttctaaatggacctccttccccttggattagcaactgtgaaggtgtgatctcagagctgtcagtgaacttataaagaatgaggttggcacatagacagaagcccagatgaaagacaatcttcctgaatctggctagtgataaagcccactcatccctggcttcctgcattttaattaagtgggtgccccgcatccaccaccctagttatggtaaaagcacctgtttcttgttttgggaggaccgcccttcccatactctcagcacatgtgattcagctgaggcagactccaccctgtctttggggttaagcatatgtccaggccctagccaatcactcatctgccttggccacagtgacagtcagtgatttaagctgagctaaataaagctaatatttgtgctactaaagatgttactccctttttcctttgggacttgaacctagaagcttagagctataaatattacagacatcttttgacctaatgggtggagagccaaggccaccaaaagcagaactgaaaggagaggaaccaggttctgatgacatcgggacagctgttggctaagatgaccttaaagtctgcgccatccctagtctttttttttttttcttgagacagagtcttgctctgtcacctgtgctggagtacagtggcgtgatctcagctcactgcaacctccacctcccaggttcaagcaattctcctgtctcagcctcctgagtagctgggactactggcgcatgccaccatgcccagctaatgtttgtatttttagtagagaaggggtttcaccatattggtcaggctggtctcgaactcctgacctcaggtaatccacccacctcggcttcccaaggtgctgggaattacaggcgtgagccaccacacccggcccctagtcttttcaatcacacaacaacaaaatcccctttctgtattgtttgagttgttattcatgtcacttacaacagaaaaacttgagatacaatgcattacattcattatcttatttaatccttacaacctggcaagtaaactgttaacccaattttacatatggagaaacttttagttaagtaatttagcaaaatctcatggtgacaaaattaggactcccatccaatccaactgattgcaaagccctattactatgcaatgttccttcagggctagaaccctgacctgcttaatttatgcttttctactctttctttctattacatgaagcttaacactaacaacatctgcagctttcttattgctgaaataaaacttgtataagacttaattctcccttttccctgcttcttaccttttttgtcttctttcccctcttcctcgttttttatttttccatttttccaatatctatattccaaatatttgctctagtcttcttcacagatcatatcaattctaggatggtcctgggagtcatgtaggctagggcaaggcaaagttagtttactgaaatttgcacttctgaactactaatactagaagactacaaatcagtcctatcagcttacctaaaagcatatcactgggccagatttcaaagatgacaaaccatccctcccttctcccattaaaaggatgaaaaggtgccgggcacagtggctcacacctgtgatcccagcactttgggaggccgaggcgggtggatcacctgaggtcaggagttcgagaccagcctgaccaacatggagaaacccccgtctctactaaaaatacaaaaattagccgggcatggtggtgggcacctgtaatctcagctactctggaggctgaggcaggagaatctcttgaacccggaaggtgggggttgtagtgagccaagatcacgccattgcattccagcctgggcaacaaaagcaaaattacatctcaaaaaaaggaaaaaaaaaaggatgaaaaggccaggcgcggtggctcacgcctgtaatcccagcagattgggtggccaaggcgggtggatcacctgaggtctggagtttgagaccagcctgaccaacatgaagaaaccccatctctactaaaaatacaaaattagctgagcgtggtgatgcatgcctgtaatcccagctacttgagaggctgaggcaggagaactgcttgaacctgggaggcagaggttgtggtgagccgagattgcaccattgcactccagcctgggcaacaagagtgaaactctgtctcaaaaaaaaaaaaaaaaaaaaaaaaaaaaggatgaaaaaggccaggcgagggggctcacgccagtaatcccagcaatttgggatgcagaggtgggcagatcatttgaggtcagaagtttgagaccagcctggccaacatactgaaatcctgcctctaccaaaaattagctgtgtgtggtggcagtcacctgcaatcccagctatttgggaggctgatgcaggagaatcactagaacccaggtggcggagcttgaagtgagccgagatcacaccactgctctccaacctgggtgacagagggagactccgtctcaaaagaaacaaaagatgaaaagatgaaaaaagatagtgataattcccacaagcccctggggaaatggccagttgccacattcttcttcttctcaacctgcttaagaagggaaaacctatactgccccagttcccactttccaactttttttttttttaagcaagacatttgttaaagcttaaagatgacttcatcacacctgtaatcccagcactttgggaggccgaggcaggtggatcactagaggtcaggagttcgagaccagcctggccaacatggtgaaactccgtctctattaaaatacaaaaattagccaggcgtggtggcgggcacctgtagtcccagctactcttgaggctgaggcaggagaattgcttgaacctggaaggtggaggttgcagtgagtcgagattgtgacactgcactccagcctgggtaacagagcgagactccatctcaaaatctcaaaacaaaacaaaacaaaacaaaaacaaaaacaaaaaacaatggcttcatgttatgcttcatttttttttaaaaagctcaaataaactttaaatgtattgtatttgattaagacccacatctggtttttctcagaggcagaacatcaatctagttaagaggtattgatattacatttaaaaaagaaatgaagaaaaaactagttaatcccatcttaatctcataatagagacgtgtatgcagtcttactggaagcctggaaactaactctccctaagcattttgtcagcaactagagaaaactttcatttcaaaataaaatgtttgaaaattttgtcccccttaactgccaagattcagtttggttcctggattcatttcccttgtaaggacacatgacatcactctgctgaaagctttttataacgctccctggacgagaccaaatgtctcagatgttattcatcctctagggttaaatctggtacaccaaatttgaaattttacatgtaaatagggaagaaattttccctccccaaatttgtaacttgtaaatctatggaggtattctgataatatcaaatagatctgctctgtaaaatctctaccattaagctttaagtgacagggtacaactgtatcattatgcaatggtatatagctgttttgcaggtgttgggatggtacaaaatattaaaaataaatgttaaggcctggctagatgtttcatttttgaagcaggttttaaaaagcctttgacaaaactcctttcttgcctacagcttcatttttgccaaatgtaaaattattttgctattgggggaaaattgttgattgctgtccttagcttaatttgctttattcttcttgcaaaacaagcaaacaaacacacagacttcctatatgattcagcctagtaaaacagggaatgaacccagacaaaaagtgttttttctatttggtcagtaatctaatttctttgagaatttttaaggaatatgaaataattagaaatagtccagaaattcagacatatggaaaattgttttgtaaacaaagctatgtattgatgttgtatagagcagtgattctcaaactttattgttcagcagaatcttagaaaatctctgtaaacagtttgctgggccccacactagagtttctgattcagttggtctggagcgggaactgagaatttgcatttctaagaaattcccaggtaacactgctgagaaccactgatgtagagcaattgaaaaccagcttaagtgtttcttgtttgtatcttacctgaaagtttcatatttgtttcccagacagtgtcattttcagaatgtgaatcccagcaaagattttctggacttaccacatttaactctctttgtccaaagttcaatgaccttcaaaattttctcccctcaatatttttatatatgtcacatgatatagctattctatggtgaaaacattttgggatatacttgtttcactggaaagaagattatttttcaatctcagaacttctaagagccttaaatacgtaaatgtatattgtgaatttccaaaagggagataaagtatgtggcattcctcaagtggatttgatcttggaattcttcctcaatctttctcctccactaagcactatggaatatctattaatgacagttagggaaatattctaagtaattttataatttaacatagttttacaaggtaaaaaaaaaagcctatattacaacctatggaaaaaacaactaacatgctcacaatattacatataattttttttttttttttcagacagagtcttgctctgtcacccaagctggagtgcagtggtgtgatctcagctcactacaacctccacttcctgggttcaagcgattctcctgcctcagcctcctgggtagctaggattacaggctcctgccaccacgcctgggtaatttttgtatttttagtagagatggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaataaataaacagataaataaataggccaggggtggtggctcctgtttgtagtctcagcactttgggaggccgaggttggaggattgcttgatgtcaggagttaataccagcctgggctgtcggcatagtgagactccatctcatttaaataaataaataaataaataaatatgaaaagtaatgaaataaatattgtgcaatctgtaattttttttttcattgaaagaacaaatcctccaggcacggtggctcacgcctgtaatcccagcattttgggaggccgaggagggtgaatcatctgaggtcaggagtttgagaccagcctggccaacagggtgaaaccctgtctgtactaaaaatgcaaaaaattagccgggcgtggtggcggatgcctgtaatcccagctacttgggaggctgaggcaggagaatcgcttgaacctgggaggcggatgttgtagtcagctgagaccacgcaactgcactccagcctgggcaacaagagcaaaattctgtcttaaaaaaaaaaaagaaataacaaaccaatcaatcaaataatcacctaagttttcattatgaattcgtcttttttttttctttttgagacggtgtctcactctgtcacccaggttggcgtgcagtggcagaatctcagctcaccgcaaactccgcctcccaggcttaatggatcctcccacctcagcctcccaattacgaattctttgttatgctaatgaaagatgtagaaagaggagagggtgctttggatgagacagaataatctttttatttctcatggagtaatgttaatctaatgatatgaaggtataagtattaatgctgaaactcagaatgccatttcatagactcccttttttggtgattttttgatatttactaaagtactaatttagatgaggcaagtatatgaaaatcctttcatataaataggccttgtataaatatcagtgtttctctttaacttaaaaagaactctgaaaatgatgctacatcttgctatattataaagttccaagtttgacttggacaaatctaaaaagcctcattaacagtgcttttaaacaaagcgcacttgttctaacggaaagcttgttatgtatatttgcattcttggttggtaaacaagtgttaaatacgcgtagagcataattgttgctaatttacgggtcctggtaattttagaggcatgggaaaagcctgattgacacgtacgatcgttggatataactgtagatgcatttaactttgccaaacaaaataagagaaagatgtcagcatgcagcatttttaagggggaaaggattcatccctaaatccaaaaagataattccccgaagttcttagcacataatgtgatttgaaacttcaaagcagcttctacttccgggcgttaacatgggaaaaaaaatttatctcacttcacaggacttttatgtgggtttttttttcttgtttatgttgtctacatccggtccctactctcttctttcaatcctctcattatctccctctaggggtttaagtttgttttaactttatgcttttatccttattagtggaaaaaagtgggtcagtattactttagtttgtcttcactgccactctgctgttcattcctgaactagcttttagcctctgggaaaggagaaagtaaaaacagttgcagaaactgggccaacctctcgcggcccgcctcccccaagaaaacaaaacctaacccgtgcaacagtagtcctttctgttttcatagcaccttgtatttctccgctcataacgttcagatttttatgatagttattgatcatctttcatcccagctagactctccgtccttagaggactcagcatattgccgggcacatgataatatatacaaaacactgtactgtagtttaaatgaatagatgccgtgtgtgtgagagactgcggcactagtacccacgtacccacacacaacaaaggagaaaagttgcagccatcaacatctttcagtgtgggtcctttgacatggactctctagaaagtcagtggagaactgtggcatggacaccttgtacagtaattacttgtataactgaagcacgagttttggtttggtagcgggaagttgaggggcagggggatgttggaggggctgaattattcacataatttctcccccagtcgctgcggacaggcactcattccggtggggtcccctggccccctccgccgctcccccgacgcccgcatttcggagcgggcagtttcccggggacacccgccccgccctgcaggccccgcccccggccgccggccccgcccccgcctccgccgccgccggcaggggtcgcgctgcccccggcgagccgctcaggcgggggtggggtaagctcccgcggccggtcgcttttctccgccgccgctggttggatcgtttcaataaaagtgttttttctcttgcactcgctctcctccggggaacaggcggaggcgtcaatccgcagccgccgagtgtgaaagcgacgcacacgcaaggagcgaacgcggccgcccgcagtctcctgagctccccgcgggccgccgcagagccgcggagaaggagccagcgcccggccagacagtctcagcccgccgtcggcgcccgccgcgctcgcgcccggctgctccgaggggattagtgggccgtccgcgcggctcgtcggcgcgggagccatgttgaccgagggacttggcaacgcgtgagacacccgcggcccctcccgaggctccggacccgcggcgagagccggaaggcggctgtggcggcggaggcctgcgctcggaagcgcctcacgtctgccggccgctgagacccggacttgcatccggtcgccgcgggcgtccgcggagcagcttccccccgcgcctctcttcgcctcgcctcgggacccgcggtccccgctcttgctggtgagttggcggctggcgtccgcgccgcgctttcccctggtgtcgggtcggccgcggggccgggaggctgcgtgggacagaggcgggggcgggggctactgggggcgcgggtggctcaggcccggtcgggaagttgagcgaggaggcgcggcgcggggggctagcgtgcgcctgtcacctctccggtccagcgaggaccttgggtcgcccggggatttccggggctcgggtggggtgtgagtgtctgcgagctgcttcccaggaggcgccgacagatatagacgccgccgcctccggtgctcgctgccgctttggtctgcgggggaggccggtctcctcgcgaggcggaggaggggaaagaggcagaaagtcccccgagacacaaaggtcccctcggcgggggtggagctggaggcgcaggcgacgctgcccgggaggggaaggaaggggcgcgggtccgcgggaggtgggcgaggaggcggcggtcgcggcgcctgcagctccttggagacgctggcgctgtgcgcgggtggggagcgcggaggaggaggaggagcccgcgcgtgggagcgggtagagacaaagatcagggcagcctcctgctggcgggtcacaccccggagtgttggtcaagagcggaggtagagggaaggtgggaaacccagcaaaccgatggggaggggaaaatggggggaggagggtgcctagtgctgtctccgtcgcagttgcttttctcagcatttttgtgcccgatgctatgcccgatgcttttgctccccaactcagctggatagctccagattccctccctcctgtcacccccacactgccacattgactctcctgtggtttttccctcgttctccccctacttttcacccactccttttcgggtaagcagtattttgctttcagcttggggaacatttgttaatgacaggatgtctgagcttgttctgaccctgaactgccttgaacttctctctcttcctcccaccctttccttttctgggatctataatgtcacatggccgttaacaattagcttttcttttgcaaaagtggcaaaaagcgtttagctgaaatctgtggctctcgcctcctttacatgaatatgtccaccaaagacacctcgttggtcatgttctatcacctcttcgtcaaattgacatcaggtcctaacaggtcactttcaagatacagaagaggcaaattttgttttgagacttggccattcctagggtcagcaaagtgtattcctggcagccagaccttcagtcacttatcaggaaatgcttgacctaaagacagacaattctttccccaaactttgctgtttcttttttgagtctttgttgaaagatttcttttaaaaggcgttcgtgtgagaagatcacagcaacaaatctggcttgttctgttttagacttactttcttaactcttgggcagaagaaaatgaatgagatttgaagacctttgataccttgagtagacaaagcttgccttgaaactagaaataagacgaaactagattttaaggggaaaaaatttgctagtggtaatataattggttttgtttcatttttttatgagtctgaggagttgacattaaacgttgggatgttgctttgttaatgaagtcatttcaatttttgcaactcttaacatctgcatgcttccataaacagtgggttggaacaaaagaaaatgtgactaagggatattccttaaattcttttttatgttatgagagagaatattggaatataaagaatgttactttatctggtaaaccatctcataggccagaagcactaacagtttgaatggttggcttaaaaaaaaacgggagtctttgaatttaagcttatgtaaaattactatgcaaatataggttattatttatttttacagtgaaaataaaacactattgaagtataaatggaaagaaaataaaagcaaagcctgtttaatatagagacattaatgttgatatcactgtacgaacagtcatagcttgctgctcactgccgttaaagggttgacatacaaacattgtggaagagatttcagtttgagggctagtgtctgaattatggactccttaccctactccaccacttaaaacattttagagacttttgtgaaattaacaggtcatataattaataattgttgttttatgtacatttattgaaaggccatattgaggctccattgattttttttcctgcatatttatcagtatcgaattagaaaattgaaccttcagtgttactagatggaaatctaccaaaaagtagcaaggtttacgaatggtgggatttattggtgattaaacatttttttcctgtattttataagtttcacattacatttacaatgagaaaaaaatgtaaatgtagaattaaagtcttgttaatatcgtaatttgcctattgctgtactaaaagaagcttctataaaatgtatcattctcatccttagattcaggccagaaagtaactttcagtgttaggtatttgaaataatgcagcctgtcatatgtactctggttaccagaatgaaaaaacaaaaagagatacatacatagtaaggaaacatgaaattggaggaattgatccccatgtgtattgcagcttcatataccagtagtctctaataagtcattgctttaataaaaaaaaaaatagaaaatttaaattttatttgcccggtagcacagggatagctatgttgactaagcgcagattttaacgtatatgtttgttgatatatttagttttcagataccagttcagtcctacaattatggcgaaactagatggcatataaaatcattttgttgctttgttgaggcttgtttttttccttattttcagcaatattttccttctttcctttcactgaaaaacaatgcaactattttattttgaacaatggaagctgtaatggcaactggggtagctattcaaaagtggagatgacgatgtcccttaatattataacagttatctgtgaacacaaaaatttttaccctatgattttctttgttattgtctactaatgctgaatatttataagacattacattttgaatctttattgatgtttcctagtctttagaaaattttaccgtcatgggctagcattcttttacatggcatttagatttccaggatgttctttgtattttttgtttgtttgtttgttttgtttgttttagactttcaggatggataattactttattgctatattgtaaaaattatattctctagggaattttacctgtttaaaaaattgtctcagttttcatacatgggaaggatgaatagttttaggttcttttgaattttgaatggataatttttgcctaaacttttaaacaggaaatcggtatttaaagtatatttcataaagtgttaatggcattttgcattttaaatgcagaagataaacaataggtttatggcatttaaaaatgtgctttatgtagcatttttgaagttaaaaaaactgcctgtaatagcgaacctagtgtagttcactagcattcaatctacaatgttggcaatttctttgaactgatggggagaggaccagttagactggcttttaagaatttttattgtcatcagtggattctttgtcattattttgcttccaatatagttagttggtggttacttttgatatctgcaaaatattgacctggcaagaggaattgccaagggccagagaagtgtattgaatatacctcagtgtagtttattgttcccagcctgtctgcctctccctgttggccaacatggaaaatcaatagacatctaccagtaaatctaataagtaatgttaccgtgttctgcagtaacctgcaatactgaatactgtttgaggatgtagatttacagatctatggcatattgggatgaggtgaaaattatcttgctctccaaagtctccttttgaaaatattttttgatatcaccttattttacttggggtactataacaaaataccatacattgaggtggcttaaaacacagacgtattttctcacaggtccggggctggaagtctgaaatcagctaagcacctgccctctcagctgtcttctccctgggcactcttaagtcctttcctccctgtctgcaggtgaagtgggagggaggggagggagaggtgaggatgtctttttcttttctacttaaaagggcacaaatcccgtcatgagagggtctcactcttaggacctaatctaaacctaattacttcccaaaggtccacctctaatagccatcacactgggaggtttggacttcaacatgtgaattttgggggtacacagatcttcagtccataacataaactttgtgaaagaaattaacgttaattatttacctcctctactaggcactatgctaagtattattttgtgaaatcctcacaataagcgcttcatataggtattctgcctgttttcaaatgaagaaacaaagaccttaggttaagtcattgtttccagggaccgacctctgtggtaacattgacattccagtttaggcattcaaaccactactctacactgtctccatgaggatgagatgttaaaaagtcaatgttactgtctgcactctataaacaatgagtgagatattagaaaagctcatcaaaatgcgatttaaagtacattgaactggttttactacattaaaagattgcagtatataaaatatgtaaggtaggacatgttgctcaaaatgaattaaaaatcaagatgctaaaaaaatttaaaacatttatatgggcgaggcatggtggctcacgcctgtaatcccagcactttgagaggctgagccgggcagatcacaaggtcaagagttccagtccggcctggccaacatggtgaaacccggtctctactaagaatacaaaaattagctgggcacggtggtgcatgcctgtaatcccagctactcgggaggctgaggcaggagaattgcttgaacttgggaggcagaggttgcagtgagccaagatcgcaccattgcactctagcctggcgacagagcaagactctgtctcgggggaaaaaaaattatagattttttgaataaataataaataaaaataaaataataaatattttttgtctaccttttttttttctttttttttttttgagacggagtctctccctcagttggcccaggctggagtgcagtgttgcagttgcgtgatctcaagctattctcgtgcctcagcctccggagtagctgggaccacaggtggtgtgagcttccacgtccaactaaattttgtatttttagtagagatgggttttcaccatgttggccaggctggtctcgaactcctgacctcaggtgatctgtgcaccttggtctcccaaagtgctgggattacacgtatgagacaccgtacccgtgcttctctaccttttaataacacatttttgtttctttttatgcatttgttagtgtaaatatgttcaagaatactctacattttgtgtacatgtttgtaaacaagggaaaaggacccaaagataatttctctttcattgtattctagttcagttactaactttggccttctcaagtcatattaatctactattcttataattgatgggtaatgtttgttattagtatgtgttaatattcaataatgtaaacaacgttggtaaatacttgtgagaaattttttttttttttgagatgaagtctcactctgttgcccaggctggagtgcagtggcgtgatcttggctcactgcaacctccgcctcccgggttcaagtgattctcttgcnnnnnnnnnnnnnnnnnnnngccttctatactttccccccatgcatttcacacacttacacctcagaatcattgccccccctgttctcccctcaaccaagaaccctgtggctctttgctgaagtcaaggtactacttttcctcaagggcaatatggttggcacctcccccatagaatcagtgctgtaatgaatccaatcacccttgatcattcttccaaattacttaatacctatctttcttagcttgtgtaaacaaaaggtgtcttgggatttcactattttatttacttggaatctctctagagacatcctgatgaaaaagaaagtcttcaactattaaggcatttggccctgtttaattggatttgactgcttgggcacacctgcacaaaagctttcaaatgaaatgtgcattttttttttttgagatggagtctcactctgttgcccaggctggagtgcagtggcgtgatcttggctcactgcaacctccgcctcccgggttcaagtgattctcctgcctcagcctcccgagtagctgggattacaggcgtgcaccaccatgtccagctaatttttgtatttttagtagagatagggtttcaccatgttggccaggctggtcttgagctcctgacctcatgatctgcctgccttggcctcccaaagtgctgggattacaggtgtgagccactgcacctggtctatacttgtgagaaactatcaagtaacagcattgaagcccttatcactccaaatttagacttgctcttctttaaattagttaatatgtgttttttagtattattttagaataaacattttttgaagtataacaacttagattttagtattttatattattgacttgtaatgttatttctggtggaaaaagaagcttttcattgagtatgtgtgtgtgtgtgtgtgtttgtgtttgtaagatacagggtctcactctgccacccaggttgattgcagtggtgtgatcactgcttcttgtagccttgatctctggggctccagtgatcctcccacctcagcctcccaaatagctgggactacaggttcagcgccaccagtcttggctaagttttgtgtttttagtagagatggggttttgccatattgcccaagctgttcttgaactcctgagctcaagcaatctgcctgcctcagcctcccaaagtgctggaattacaggtgtgagccactgtgcccagattttttactgattctgaagtaaaattggattccttagacttaagcaccttgagtctgacctattaaattagcttttttttttttttttttttttttttgaggcggagcctcacaggctggagtacaatggcacaatcttggctcactgcaacctccacctcccgggttcaagcgattctccctgcctcagcctctcgagtaggtggaattacaggtgtctgccactatgccctgctaatttttgtagtttttagtagagatgaggtttcactatcttggccaggctggtgttgaactcctgacctcgtgatccacccgcctcagcttcccaaagtgctgggattacaggtgtgagccactgtgcctggccttaaattggttttaagaagtggtcctttatgtctcaatttgagttaataaatttaatttttcaattaactcaggtttgcagttggtatttttaaagcatttgttacgtcctcaatattgtattagccgttatctgtgttgtaacaatataatttaatgtggcaatattgtaacatataagataacagcaatgttggttgtctgagtattctgtccacagccttctttccaggttttatgtgttcctggcaatctggtctatatttagggctttgttctcatcacccatatgcaataatctccacctctttatttctaatctagacctctttttctgagttgcattccagcttcctactcgatattgccttagtgctcccttacctaaactgaactcgaatcccctatttctgttcccaatttcagtgaatggtaccactgtcagcctagtcacgtaagccaaaaactttggcagcttctttcttacgcttttctgttatgctcatttccccttagtccagttagtcacaccaagtcctgttaattttaattcctaaatatcttttaaatttattttttcctgtgtcactttcttacgtaagggttttggaatgtcttatctgatttactggctccagttttgtcccattttaatctaaccatattctttctttatgtttatatatgtatcttattttatccttttttccgtactgccgtccattcatccatccatgtctgaagtacctgcctactctgtactagacactatggtaggggctaggatacaaagatgaagaaactggtatgttgatattacaatgctatgacacttgtagagaaattctcatttttaagcccaaacgtctctttctccaacgtgatctttgttccattctgacagttatggtggttctgctatatagtatttatgtatactgtagtacttaatatgttatgttgtaattaattattttcaggtctctccctcttttggctggcgttgtgctccagagaggccgtgttttttttcatttctgtatttcttcccgtattatcatactcttaaattgaataaagtgatggaattaggaggaacaacaccgagttggtaaattaaggtcagagtaggcttagaagcaatcaagaatacattttgatatagtagataataaaaagtgtaaaaggtttcaaatattggagctatacagttttggtggtatttgtgtgagagcaatctagagcagtttgtaggccaacttggagggacagtaacttggcattattgagactgtttaattgcatgtgagctgtactaacttgttagtgaaaatggagagaaaaggggtgtggccttcaaagattgttgtcttttagacaaaatggaaatataaaattataatgttaatatgtaaagaaagtactcatttctgaaggtctaaaaatattggtcagtgtatcaggagtaaaatttggtttaaccgaaaaaaactggcctgccgcggtggctcacgcctgtaatcccagcactttgggaggccaaggcggtcagatcacttgaggtcaggggttcgagaccagcctgggcaacatggcgaaaccccatctctactaaaaatatacaaaaaattagccgggcgtggtggcgcaggcctgtaattccagctacctgggaggctgaggcatgagaattgcttgaacccgggaggtgaaagttgtagtgagctgagatcacaccactgcactccaacctgagtgacagagtgagactctgtttcaaaaaaaaaaagaaaaaaaaaatcaaaaacaaaacaaccccccgccccaaaatcgtccttaatgaaatctagctatttaactgtgtagtattggcttaaatgcgcttactgcagtgcagaattgtactcaaaggatcaaacagtgcatttaatgttattcattctgctgtggtagtttatgtatacagttgactagaagctttgtttttcttttttttttttgagatggagtctccctctgtcgtttaggttggagtgcagtggtgcaatctcagctcactacaacctccacctcccgggttcagtaaattctcctgtctcagcctcccgagtagctgggattataggcgtgtgccaccatggcctggctaatttttgtatttttagtagtgttggccaggctggtctcctaactcctgagctcaggtaatccacccaccttggccacccaaagtgttgggattacaggtttgagccgccacacccagccttgtttttaaatggaattacagtaattaaataaaaactgttccatggtctacttttaaacttgaaggattttttttctttttcttttctgtctttttttttttttttttttttgagatggagtctcaccccatcgtccaggctggagtgcagtggtgcgatctctgctaactgcaatctccacctcccaggttcaggcgattctcctgcctcaccctcctgagcagctgggactacaggtgcacgccattgtgtctggctaatctttgtatttttagtggagaccatgtttcaccatgttgggcaggctggtcttgaactcctgagctcaggtgatccacccacctaggcctcccaaagtgctgggannnnnnnnnnnnnnnnnnnntccatctcaaaaaaaaaaaataattgagttttaaattatacctcttttcagccgggcgcgctgtctcacacttgtaatcccagcactttgggaggctgaggcaggcggattatgaggtcaggatatcaagaccatcctggcccacatggtgaaaccccgtctttactaaaaatacagaaatttgctgggtgtggtggtgcatgcctgtaattccagctactcaggaggctgaggcaggagaatctcttgaacctgggaggtggaaattgcagtgagccaagatcacaccgctgcactccagcctggtgacagagtgagacttcctctcaaaaaaaaaaaaacaaaaaacaaacaaacaaaaaaaccctcttctatagtaggtgtgttataagtaataaatttattttaaatattagttcgagattatggcttggtaacgtcttgtttgaagtgtgacatttaaaatgaattttcataatttgtgggagtcagtgcctttttaaattcctcagcttacacagtcttcttaaaacactttttgtattgagcttttgagatcatggtttattaaccaacatttatcatttcagaaacagtggggtattgtgtgttgcaataatttttgcccataagttggtgagcatggatttttttgttgatccctcccttctccagatatcatttccatttccattttgctctcatcccctttcttcctaagaagctataaaatggttgaaacatttatttcaggtacaattttttggaaaagatctgcaacttaggtttctattgtataaagtttagaattggttatatgttttcaattttcttttcataaagcctacttcagtaataacttataataaccatattactataagctcgttattttaactcttggctgggcaaggtggctcatgcctgtaatcccagcatttagggaggcagactgaggaggatcactggagcctaggagtttgaggccagcctgggcaacatagggagaccccatgcctacaaaaaaattaaaaaaaaaaaaaaattagttgagcatgagatggcacatgcctgtagttccagctacccaggaggctgaggcagaaggctctcttgagcctgtctcaaaaaataataataataataataaaaaaaagtgaggcctggtgggaggtatttggatcatggggcagatccctcatgaatggcttagcaccatccccttggtgatgagtgagttcatgtgagatcggttgttttaaagtttgtagcttcttctctgttctctcttgttcctgctctcgccatgtgacatgcctgttcccacttggttttgcaccatgagtaaaagcttcccgaggcctccccagttgccaagcagatgttggcattatgcttgtacagcttgcagaaccatgaggcaattaaacctcttttctttataaattacccagtctcagggattcctttatagcaatgtaagaacagcccaacacagcatgtaaaacattgattgtttttgctataactctttataaaataagaactattggtagtggtaataaaattgtttaatccattgcttcacattgaaggaatgtctaaatcagtgattcacaaggacaattgaatgaaaatcgtctctggctttttgaactttgcatatttcccagattttctaatatgcctctactcccaccagatttgagcgtaactgtagcagtgagttcaagttattaatgggtgtgtgttgcatccttcttgtatgtttgggggtggaggtggcacatatagacataccagtagactaaatagtctaagatgtgcattgttgtttctaatctaatgaccattaggaataaataggtcataatcttttgtaagcatatctgtaagctttccttagggccaaccaaatatttctttgaaccattttccctgttctgttccacttgtttaggcctgtgctttatcatttacttgacatcttaatagtctagacagtatttgctttccttgtttatgactcttgtatgtgactctagagtttttcttttcttttttttttatgtacagatgagatgtcactatgttgcccaggctggtttccaactcctgagctcaagtaatcctcccaccttggcctcccaaactgctagggttacaggcgtgagctgccacacctggctgattgtttttctttttctcttttattttattattatttttttttagagaaaaggtcttactctgttgcccaggctggagcacatcagtgcagtcccagctcgttgcatcctcaacctactgggctcaagcaatcctcccacctcagcttcctgagcagctgggaccacaggtgcacaccaccatgcccggctgattttttacttttttgatagagacagggtctcactatgttgcccaggctagtcttgaactcctggacacaagtgattctcgagcctcggcctcccgaagcgctgggattacaggtgtgagccaccatgccctgcctcacgtttttctgaaatcaaaatagagtaactggttataaagtttacccatcaaaagaagaaactgactttgcattttattctttgtcataaaatctgcctggatgcttagtattatattattgtttactattatatattattccagagtaatggctttaacctcaacttcagaatcattcttgttgactaaaataagaaaaaatctaaaggcatgcttgtaactgtgtaatctcaaactctgtttctgaatgagaatctctgggtttgggtttttaatgtttcagacaattcttgatagatcctggagttttagaaacactgttctagggtttagcacagtgttaagggaaggaaccactcatacattaaatttaaagtagattcatacttctagtgggttggtcggtccttggttgctggatgctgtgtgctattggacccaaggaatgacggcactgctaggatgaagctcatgagatttttgatgaaatggttcatgaaactgtaaccttgaattgaaaagtggaacacaggtctatggaacagtcacaggtgtggatgtcaccgtgatacacatcttaaagcgtgaaaatgaccctgaagacagagaacctgtacagttggaaacacaaatttgaggaagtaacattagatattttactctaccagacagtttacctctggatacactacttgtggatgttgagcctaaagtaaaaacctaagaaaagggaagctgtttgttgcaggaagaggccaatgcagaagaagaggtagaggaagagtacatggccatggcagagggagagggggtcctggtggtaatgtctcttaagattactgtttcaaggtaatatgtgatttgagatattttctgtataggttttcttcgcttatgtcaatttttatttttaaatttttttctatcaaaaaatttaccattatgcagtatgtccatgtaatatgtcagtttttttgttgttgttttgtttttcattttgagacaaggcctctttctgtctcccaggctggaatgcagtggcgtgatctcagctcactgcaacctccgcctcatggactcgagagatcctcccacttaagcctcctgagtagctgggacttacaggtgccgccgccatgcttggctaattttttaaagatttttgtggagagtagagatgaggtttcactatattttgcaggctggtctcaaacttctgggctcaagtgatcctcccaccttggcctcccaaagtgccgagattgcaggcatgtgcctctgtgtctggccagtatgtcagtttttaacgaacataaatgtggaaattttttgaagtgaaggcaaagtgattaaaactttctacctgggtgcagtggctcacgtctgtaatcccagcactttgggaggctgaggtgggcagatcacctgagcccaggtgtttaagacaagcctgggcaacatggcaaaatgccatctctttaaaaagtgttttaaaaaattggccagctgtggtggcacatgcctgtagtcctggctactcctctggaaggtaaagtctgcagtgagctgtgattgtgccgctgctccccagccagcgtgacagagttagagaccctatctcaaaacaaagcaaaaaccaagaaaccttcctgtcgttccatcttatttttccctccctttttttttgttctacttggagcgttttagttttaccgggagttggcagttttcttaattttatgtataattgtcttttgtttcaattattttatgttttttcctttagtggatgtttttgtctgactcttttagcttgtttcttatcagtgatactgtttcctatctgtatggtctcagttattagttttagaaaattatttttaaaatgtgagaatgtataatcatataaaaaatgtacaatgtacgttctctaacacagtggttactattttcaaatattatcttggcttttctccaatatgttttgtatttttgtttaagatcctttttatgttttttttaaggtaccaaataattgtggctgttacttttagtgtttgcaaaagatgcttaaccatttcatgttgtttgataattattacttctcatttttcattattttgttttaaaaataatttcaacttttatttttgattcagggcatacaagtgcaggttcgttacatgggtatattgcgtgatgctgaggtctggggtatggatgagcctgtcactctggtagtgagcatagtatgtgataggtagtttttcagcccatgcccccatttgccaaccccttctagtcatctccagtgtctgttgttaacatctttttttgttttttgagacagagtctcactctgtcgcccaggctggagtgcagtggcgcaatcttggcccactgcaacctccgcctcccgggttcaagcaactctcctgcctcagcctcctgagtagctgggactacaggtgcccaccaccacgcctggctaatttttgtatttttagtagagacggggttttgccatgttggccaggctggtcttcaactcctgaccttatgatctgcccgcctaggcctcccaaagttatggcattacaggtgtgagccactgcacctggcttttttttttttttttttttcccttgagaaagggtcttgctttcaccctgactggaaggcagtggcatgatcatggctcactgcagccttgaccttctgggctcaagtgatcttcccacctcagccttccacgtagctgggaccatgggcatgtaccaccacacctggctaactttgattttttgtagatacaaggtctatgttgcccaggctggtcttgaactcctgggctcaagcagtcctcttgcctcagcctcccaagtgctggcattacaggcattagccaccctgctcagctgttcctatcttacgtccatgtgtgctcaatgtttagctcccaaatataagtgagaacgtacagtatttggttttctgttcttgcagtaattcactgaggataatggtctccagctgcatccatgttgctgcaaagaacaaggtctcattctttttttatggctatacagtactccatggtgtgtatataccatgttttctttatccagttcaccatcagtgggcacctaggttgattccatgtctttgctattgtgaatagtgccgccataaacctatgaatacatgagtctttttgataaaatgatttgttttcctttgggtatatacccagtaatgggattattgaattgaatggtagttcagtttttagctctttgagaaatctccaactgctttccacagtggctaacctaacttaacttatattcctaccagcaatgtgtaagctttcccttttctctgcagtcttgccaacatctgttattttttgactttttaataatagccattctgactggtgtgagatggtattttgttgtggttttcattgcttttatctcatgattagtaatgttgaacatttttttcatgtgtttgttggctgcttatatgtcttcttttgagaaatgtctgttcatgtcctttgtctacttcttaatgggattttttttttcttgtggatttaagttccgtatggattctgaatattagtcctttgttggatgcatagtttgcaaatcttttctcccattctgaaggctgtctgtatactcttgataatttcttttgccatgcagaagctctttagtttcattacgtcctgcttgtcaatttttgttttctttgcaattgtttttggggacttagccataaattctttgccaatgctgatgtctggaagagtgtttcctgggttttcttctaggattttatagtctaatgtctttaattcatcttgagttaatttttgtataggacaaaaagtaggggcccactttcattcttctgtgtatgcctatccagttatcccaacatgatttattgaatagagagtccttctcccgttgtttatttttggcaactttgttgatcagacgatcagacggttgtggttgtgcaactttatttctagattctccattctgttccattggtctgtgtgtctgtttttgtatcagtaccatgctgtgttgcttactttagccctacagtttagttttaagtcgggtagtatgattcctctggctttgttctttctgcttagggttgctttggctatttgggctttttggttctgtatgaatcttagaagagtttttttttttttttttcttctaattttgtgaagaattacattgatagtttgataggaatagcattgaatccgtatattgcttttggcactatggatattttaatgatattgattcttctaattaatgaccatggaatgtttttacatttgtttgtgtcatcactgatttctttcagcagtgttttgtagttgttattctagagatctttcaccttcttggttagatgtaatactaggcacttcattttttggggggctattgtaaataagattgtgtttttaattttgctctcagctagaatgttgtaatatagaaatgctactgatttttattcattgattttgtatcctgaacctttactgaagtcgtttacagttctaggagccttttggcagagtctttagagttttctagatacataattgtatctgcagagagataatttgatgtcttctttctctattcagatgcctttgatttttttttcttgcctgattgctctggctaggactttcaagtactatgttgaataggagtggtgagagtgggcatctttgtcttgttccagttctcaagggaattgttgcaacttttgcccattcatgaagggatgctgggttttatcgaaagctttttctctgtctgttgagaagatgatatgttttttgtttttaattctgttttagtggtgaatcacatttattgttttcatgtgttgaagcaaccttgcaccccaggaacaaagcttacttaattatggtgaattaacattttgatgtgctgctggattccatttgctagtattttgttgaggatttttgtgtctatgttcatcggggatattgttctgaagttttcttttttcattgtatctctgccagattttggtatcaggctgatgctggctccctagaatgagttagggaggaaaccctccttgatattttggaatagtttcagtaggattggtaccaatttttctttatacgtttggtagaattcggctgtgaatccatctggtcctggactttttttggttggtaggatttttttttttttttttaattactgattcagttttggaacttgttatttgtctgttcaggttttcacttccttcctggtttaatcttgggaggttgtgtgtttccaggaatttatccttttcttctagattttctaatttgtgtgcatagaggtgttgatagtaggctgaatatcttttgtatttatgttttcactattttaaatcggtgctgtgacaaacttgaacatgcgatatccctttcccacccgcccacaccattttgcatttccttagggtagatagatgtctagaagtggaattcccaaaccaaagtctgtgaacccttttctgatatctctgttgtaccagtaccacgaataatgtgccacatctgtttttagtgatataattatctaaaatgtttgcttttgatcattggttttagaaaaatataattatatttgaatttctttgatttctgggatgttggtcctcctcccacccccattatccccacggattgctaaggaggagactttgactgctccctgaatcctggcatcttctttttttaattttttctgatatttggtttttatcaagttgttatataataaaaaaaactagataagttgttttggtgatccatctctttttatattcattccagcttatttttcaatgctttgtaatatattttaatatctagtgtggcaaaacacttaatttttttctaataattttgatattcttatatatgtatttttaattctactttagtaaatggcaggcaaaaaaatgtagatctatggacagtagtagagtttatgggaggaaaattgcggatgatcctttcagctcactagaagtctctatttttttcttcaaaactggtctccctgctataaaatttgaactgtaggtatgtcagtatatctataagagttgcctccgtaattgaaatagacttcctgttacccgttgtctaggttgtacactgtaaagagcatcttttttttttttttgtaggaaaaaatggttttgtacatgggatgaaacaatgtaaactcaaaacttacagataagggttagttgtatcactcatctctttgaaaagtttatatgaatatccagtcaaaaccaacaaggtatcgcccttgaaatgttatctatatggatttccaaggagaccataggactgtatactgtcttggaatgtcctcagaaggcttagagagcatcttgataaaaggttatgtggtttatgatagagtgtattagtttatttgtgttattaccaaagatgaacttatggttaaagatgaatttaggattaacatgacgaggaaagagtgacatttagctgagggtattaagtagatgtctcagatgaactgacactaaaggtaattagctttacaaatagagagatgagagaagagaaccacttcctaggtaggataaaagaacatgtaaaaaagggatatgaaaaaaatttatattcctttaaaaatgttattctctaccagcctaatgagtatttccatgtgatagaaatagagataaaggttgctcatagaggtagtggcaggaaatgaggtcaaagagggagatattccagtaaggaggctgttgaacactttttaggcagaatatcattgttttctatagtgaagccattgggaaagttgtgtacaattacagatgaacttctgcaagttaaatggacaaccttttgtgatgttggtgcttcagaagtactctcaaagggttgctttacaatattgaaaatgctaaaaaatggccgggcacagtgtctcacgcctgtaatcccagcactttaggaggctgaggcgggtggatcacgaggtcaggagttcaagaccagtctggccaagatggcgaaaccccgtctctctactaaaaatacaaaaattagccgggcgtggtggtggatgcttgggcgcctgtaatcccagctactcgggaggctgaggcagagaattatatgaacccaggaggcggaggttgcagtgagctgagatcgcaccattgcactctagcctgggcaacagggaagactttgtctcaaaaaaaaaaaaaaacagctaaaaagagctacttgtgccttttttgggtaattttttggttcacctcagagacatgagaattactggtttttcttttttgggttttttttttgtttttttttggtggggggacagagtctgcctctgtctctcaggctagggtgcattggtgctatcatggctcactgcaggctcaacctcctgggttcaggtgatcctcccacctcagcctccatagtagctgggactacaggtgcgtgccaccatgcacagctaatttttgtattttttgtagagatggggtctcactgtgttgcccaggctggtttcaaactccttggctcaagcgatcctcctgccttggcctttcaaagtgctgggattaaagatgttagctacagcgcccagggagaattgttttactgtctcttaggagcacttggaaatgtgtgtttaatttagaaactctgccatttttatcttccgatgaggaaatgtttcgatatgttagaaattggtttcaccattttgtttggggaaataagagatataaatagtagatttacttctggacacggtggctgatggctgtaattcttgcaaatttgggaagccaaggtgaaaggattgcttgagcccaggagtttgagaccagcctgggcaacatagtgagatccccgtctctacaaaaaatgtttaagaaattagccaggcatagtaatgtgtgcctgcagtcctagttactcaagaagctcaacctgtggaaggattgcttaatcccaggaatttgaggttgcagtgagctatgatggcactgcactccagcctgggggacagacttgagaccctgtctcaaaaaaaaaaaattagatttaaaaaatatagaaatgatagatgcttttgtttaactataaatatcagcatatcttataatcaagaatataaacattaattgtttctataaattgttttgcatttctttagcctttatctccctgctaatataggtgatcataaatcactttccatttaacagtaattcagtaaacttacatacaggttctgataatatgttaattttagcagctgtactgcatttcagcactttaaattcaactgagtttgacttgaaatacctccattttactaaatttagatttttttggtacataattgtccctaggtttgagctactctgtctcatagtatgtatttatgcttcagaaattaatatctttttctttcttagtatttgaaccttcagattcttccactattataaccattttaagttctttttaaaattaaacttatttttttgggatagataaaactcaagtatgtagaaagatgtacacaaagtcttatttcttcctttgcttgctactttattttccttccacactttttggtatcctgtttatccttccagtgttttccttttgtagttacaaacaaatgtgtattttattctggagatctttccatatctagataaagatctttatttttaatagcttcatagtattttcttatgtagatgtaccgtagtttagtcactcaatcctttgtggctatttgggttgttttctattttttgctgttacaatgccaaatgaataacaatatacatgtaacattttctatttgaacaagcaattgtagatctttaggtcaagtattttcttccactgtcagctgagagaacctagaagcaacaatatccctgtagcagtgagcacacctggtgcccagatcttggtttctaacaccattctccagtaaaaggaaccaggcctttgtggagaaatggctgattctaggactggggcagctaataaaactgtaagatcaacctggagtatcttgtagtgctggaaaggaaggaactattcaaacaaaaacacgaatgagttatgtcaaagggacacagccaactgaaagagttcccagtagccaatactggaataatttgagcaacaaaaaagtaatattgaattataacccaaagtataaaataatatccatgagttcatgctgatagaagtaaatgactgactaaataaataaatgggggaagaatagacaaatctgtgcataattagatacacagccctcaaggaagtataatacaactccccacctttcaagtgtgagctacatgaggtgacttcctgccaataagtaccatactaatgtaagatcttactagcggaaactgagtgtgtggtttaagggaactctttactatttttctgtaaatctaaaacgatactaaaagttcacttttaaaaaactgcttctgggccgggcgcagtggctcacgcctgtaatcccagcactttgggaggccaaggtgggcggatcacgaggtcaggagatcaagaccatcctggctaacacggtgaaaccctgtctctactaaaaatacaaaaaattagctgggcgtagtggcgggcgcctgtagtctcagctactcgggaggctgaggcaggagaatggcgtgaacccgggagggggagcttgcagtgagccgagatcgcaccactgcactccagcctgggcgacagagcgagactccatctcaaaaaaaaaaaaaaaacgaaaaaaaaaaactgcttctgtaattctgatgctgccagattgccattttgtactaccacctaaatgtgcaacaggcctgtttcccataacctcagcaactgaatgtgttgtcagactttttgagttttgcatttgatagatgagaactggtttaactcaggttattgtatttttctcattatcaatgacattggacattttttcatatgtttaaggggcattttacgttttttcccttctttgaattctcatgtcctttatttttctcttaggtcattggtctttgttttcaggaattttctgttgggagattagccctttatttgtgatgtgggttgcaaatatgtatattttagattatgttttttcatgcataactttcgacttttatatggtgaagtaattttttcttttatgtttttggattttgaaatatatttagaaaagtcttcaccattccaaggttataaggaagttcatccacattttcttctaatacttgtggttgtgtttttcacatttggattttaaaatttggatccttcagttcctctcaatctttgaggcattttaaatgcttaccccttgctttctggttatacctgcatcagcatggttgtggccatataggtgattcagatgacttatagtaaaagaaatacttaggcatttactctcagtaagaagtctcaactttctgattactgatcatgattattatagtaaatggaaactcctttagagtttcttttcactgttaaattgtatattttgtagtattttttctactgattatcagtattgtggattattcatgtatcaattggttttttccttatcctgtttcttataggattcctttttagattattaaacctgtctgtgatctgtttctcatcttccttagaactcctactggttttatggtcctctgattactaaactctattttataatcttcagaagtttaattagtaggccagtttgctgttttaactcattaagaaactggccagtagtgtcagtggatactgcctaatatagggtgatgatttatcttaaccttttataacagtattaatattttccccacattgcttgtgatgagactagtgtcactgaactgagcttgtaacagacatttgggaagctgtctggtggtactgcggaattttggctgctggaaaataccaccaaaaattatctgttgagtatattgcttataagcatttgtagggggccatgtgggtgttgataagaatggcaaaccagaaaggaacatcaaagttggagtgtttattattgatgttttggagtctggtttaagtatttcaaagctttattagaattaggtgaggatcatgatataatagtttgattggacagacataccaaggtaagagttttgaggtaagctttttcagtgtcttagaaagtgaacaatcatttgctactatttattgaaaaattgaatagtctgatgttggtttatatgggttttttgggaagttcctgaaatgaacaatgaagttttttgtagctcttatctgcctgagcaggagtttcctggaatagcaaagtcatgttgttgaagacagctgtataatgatagttaatatagattgtaaacttggtgtagacagtttcagttctcagtgtccatttagaaccacaagaaacttgaacatgtatttataaaaagtctgattcttaggctcatttgcaaagacaatgcattctcttggtgaatagtttgactttcaatttttcccctggggaatgaggcctgactttaacaattaggtgtcagacatgcccaagtaggcagttggataggtgagtctgcagcttaataaagaggtcaggatcactgtaataccagcagtttgggaggccaaggcaggtggatcacctgaggtcaggagtttgagaccagccgggccaacatcgtgaaaccccatctctactaaaaatacaaaaaattacccaggcgtggtggtgggtgcctgtaatcccagctactcaggaggctgaggcaggagaatcacttgaacccaggatgcggaggttgcagtgagctgagcccaggatgcggaggttgcagtgagctgagatcgcgccattgtactccagcctaggcaacaagagcaaaactctgtctcaaaaaaaaaaaaaaaaaaaaaggttaggatcagagatggaaatttgggagtcactgtgtgtagatgttgtccacccagaatgagcttgcctaaggaggaaacatagaagaaaaatgcttgtgccaggacttaggccacactggtgtgtgtgtatgtgtggctgagggtggggtaaaggggtggaataaatctgcagaggagtggccagagaggttggaagaaaaccaagatattgttatagagaagccaaggaaaatgtgtttaggataatgaaggactggtcaaactcctataattataggcaaggagcagtgaagataactggtgtaggttagttcaggaaatttctacctgaaagctctatgtttaactcatttttgtgtacatatgtatacacacaggcacactgtatgggttagggaaagggtcatcatataattgtggatggtggagatggtttgaagtagacattggggagagtaggagaccaagtgcagcagagaaatatagtaagattattggccagtgttgaggcccatttaggttcgctgatcaaactgttctgttgtgtgactgttcagcagtgctgagatgaactggtgctgatgtggagaaagtcttaggtggattaggattgggatggacaagaatatatttgtgcattacagtagatccaagtatatgtacctttctgcctttggagtggctgtagcattgtgttgtttcatttatttctgatgggctcttctcatgacctcacttgcttgaaagcttactgcttgactggtattcagcccatctgaacttactttacttctgtggagaagtaaattagttccccccttttcctggtttccacagagtcttgagatctctgatgttgcttcttaggaagaaggggcatttgactaaatttataaaggaagtataagaatttgccaagaggtcagagaatgggatgaaggggaaggggttaattgttcctggtagagggatatgcttgtgcaaagttaagaggcctgagcaaaacaccttaagggaatagaagctacaaataatttctttgaggcaatgaagcactcactgtgtatctctggagatggagctgaaaagtagtggggtcagaacacaaagttcttgtaaggctaggtgaagaatgacctgttggccccagagattaatttttacttaacaatttttctacgcatgtacaaaataacggctgttcacagaactattcagttcatgacattcttcacctaagaattgcctagtgggaaaatgtgtttgcagattagttatctgaatttgataatattttcatagaaataattttaccaatttggctgccgtgttgctccatgaaagttacttaatttctcattttggctgttaatggggaaagagggttagtgatatgtagcttgcaattttatatacagaacataaatcagatgttcataatttgggagtatacagtggcaaaaatagtatatgttaaatgcttactgtgtgctaggtacaatacatgcattctgatttagatctcacatccttttggagtaattgttttttgtttttttgagacggagtcttgctctgtcgcccagggtggagtggtcttcgctctgtcgcccagggtggagtgcaatggcgcgatcttggctcactgccacctccacctctcaggttcaagcgattctcctgccccagcctcctaagtagctgggactacaggggcacaccaccacgcccagctaatttttgtatttttagtagagacagggtttcaccatcttggtcaggctggttttgatctcctgaccttgtgatctgtccgccttggcctcccaaagtgctgggattacaggcgtgagtcactgtgcccagccattgaggtaattgttaattcttttctctctctctcttttcttctgagatggagttttgctcttgtcacctaggctggggtgcaatggcgcaatctcggctcactgcaacctctgcctcccaggttcaaagtgattcccctgcctcagcctccctagtagctgcaattacaggtgcctgccaccacgcccggctaattttttgtatttttagtagagacggggtttcgccatgttggccaggctgatatccaactcttgacctcaggttatccgcctgcctaggcctcccaaagtgctgggattacaggcactttgggagccaccgcagctggcctgttaattgccttctctgaagagaaaactaaatgcagttttctcagtgtcatacttctcactgtctctctagtgtttaaatgaaggaatcaggatttgaacctaggttaggcttaccctaggacttattctcagtttctcttaaagaaagtgaacttcctatgtgctataaactctttatcactagtgccaaagttgtgtgtaccataattaacatttcactgtaggtgttaattaaatgtagtgatgtgttaacctctaagcttttgagaagactgaataggtagtaagcaataatgaagcaaagagagaatctaggctcataaagccatcctttggttaactagaatccatttaattcacctaatggaaaattcagatagcccaaacaatattctgtttgtcagaattctggttaattcaaatattactgttttaaaatgcttttctatatcctcataggaaatctttcaacattttttaaaggctatcatttgtaatgtatatgcatattttaccctctttttcttcactttgtgttaatttctttattttttctatttataatatactgaggtttcctaaataagtaaaattagaagaatagagagttctgcaaataaaaatgaaaacctctgaaaaaaagtggctgtggagtattttttttcagttgattattcaggtacaccttttcttactgttttggtgaaaatctacaatttggcctttaccttagatcttataaagatgatagagtatgcttggaaattggctcattgttatgctcccttcctgttaggattggtatgtgaacaatttctaattttccacttagcaagtaatgtgatggaggattagagtgcctcccacccctcaccaaatcacaaaaaaagcttttctgaagataatggtagttttatagttttgagatcaattgattcggccctaggaagactctattttgaggccttttcaatatctttgaaattaactggccatataagagggagatttttttccttcacagctcttcttcccccaaagaaaacctttaccagaagattgaagaatgctggcatttttaatatgttgccaagtcttctactgttgccatggaaagttggccactacttagtagaatttgtcttataaaggctttaatagtgttagtttttaaaagatgttataactattattgtcataaattacagaatgacaaaatagcatttgtccagttcagatgcctcttggagagaaagactagaaagttgtacacacacacacacacacacacacactcactcacacactgtctctctctctccgtcccccctctttttaacatgataagcaaattcatatttaccttgtgccaagtatgctaagaacattcttaatgaaacctacatgaatatttagaaagtaggtgattttgtgagatttgcagtttaaaaacataagaggcaatacataatactatttgatcatgattgaaaaatatgtcatgtaataattcagttatttttgaagggaaatgaaatttcattctttttctttttattttttttgagatggagtttcactcttgttgcctaggctggagtgcaatggcctgatctcggctcaccacagtctccgccccctgggttcaagtgattctgctgcctcagcctcctgagtagctgagattatgttggtcaggctggcctccaactcctgacctcaggtgatccgcccacctcagcctcccaaagtgttgggattacaggcttgagccactgtgccctgctgaaatttcattcttacagtagctgtcaaatgtggccttttaaatatttaaatatatatttagttcttcctattaaaatgatgccccttaaaatgctgttttaattttttattgttggagttaggaggtggttaaagggtgaacaattagctgggcttcacgggatatctttacgtcagtgggtcatgatatgtcaccatgtggtgaagtctgatcttttcagctttgttctgtgacattcctcttcagttcattttgagataatctggtattgtagaatctcttatgctaattagaggataaagtataatgttaatttagaaatacacaatgagaaataatctggcttgatacaacagtgttttaagggggggatatgagtgatgcagtgggggcagggagggacacaaagattttaaaaatatgtttctttccttaaggagtttataatacgatgaaacccaggaagtttttatttacatagcccacttgatcctggtaagtaaaccaatttagaagatctgatttcagatctgagggttggttgagaatagctttagggtagtgagttttcaacctttttggtctcaggacctgtttatactcttaaacgtttcagaaatgatacgaaaacagaaaccttaggttacaaaaaattgtaatttacttaaaaataacaaacattacgaagttaacaaatcttaaaaaaactattttcaaaaatatgagaatagcattgttttacatatttgcaagtctctttaatttcaagctaaatagaaaacagccggattcacacatctgcttttgccttttagtttattacaatattcagtgtagtctctggaaaactccattgtacaccggtgagagaagtgtaaaaaaggcaaataacttagtattttataaaaatagtttttacctcaggatgctcccataaaggttccccagaccacacatacttggagaatctctgctttagagcaaaatgaagtgggttgcttatcctacttttgatcttgctctgaattgcatattcttacaggctgtttctgtcaagctgtagtaactcattaaattccattgtggaagttactcgcaggtaacttctactataaatagttggagccataggctttgattggaaaaggcaaggcttgctagctgtatcatttcaggaaaatgtattcacattttggaatgtttcctcttttgtaaaatgggtagagtaataccaactcataagacttcggtgtgaaccaaataaattaaagcaatatacagttgctaatcaaatcttgctgttagtaggagttttggaagaaaacattgcctgacacatgttccaattttctcacatacattttggttaaatttgcagaatatcctaaacacctgataagatttgtgtcttccttgttactctgcagtgactttttttatttttaaaatgccctccgttctttccttctgtccagctcttacactcgcggcttcttagagccagttccttcacaaataaatggggattttaaaacaaaaatagcaaaatatccttccctggggtgttcataatcttgtgcttaaactaaagaaacagttaaggagtttcaccatattggtcaggctggtcttgaactcctgacctcgtgatccgcccacctcagcctctcaaagtgctgggattacaggcgtgagccaccgcgccagacctattttatttatttatttatttatttttgagacagagtctcgcccaggctggagcccagtggccccatcttggctcactgcaacctccacctcccgggttcaaacgattctcatgcctcagccaccaagtgtagctaggactacaggcatgcaccatcacgcctggataatttttgtgtttttagtagagaccaggtttctccgtgttgtccaggctagtctcaaactttagacctcaagtgatctgctcaccttggcttcccagagtgctgggattataggcatgagccactgtgcccagccaacatttttttaaaaagaaatcctcaccacatatacatgagatgtatctatgacattattaataactggatgggctgatagattgctcaacacaattttcatttataagaaatacttaatttgtttttttcctttttcttagtgttgtcaagttttttctttacttttaaagaaatcaaccagaaatggtagagactgtgttggtttatgtaaagaattcctttcatgaatacaggccttcatctcacagcaaaaaatcagtgcatttgagtgttttaagttaacatgtttaaggtacataattgtaaagatatgtatatagatatatactttttttttcttttttgtgattgtttgaattaccaatttgattagtggactggtcctgagttagttgattcaccagattcttgttttttagtgaatacacctatcacaggcctactttttgaattctaacttgaaagtcagtagtgggactgaagccctttttcaaactttaacatggattttgtagtaaaattggaataatacagcaatttcatagtaccacttgtagcttccagcaactatcatgacattttatattcaaactgtttctttaaagaagactttgtagttacctagggtttgggactctgttgtgctcctttccagccttattcattgtgcccccccccccccccccccgtcttagagtagcttctttctaaatttcctcttccaaggaatcagctgatgcttctaaggcagactctggagccagtattatggtttcatatcaaagtgtcaaaatacttcattttctagtgaatattagacgaaaatgtggaacacttcaacaattggaatattaaaaggaggatatttcctacttagatttattttacttattagggaactgaaaatgccgtctaagaatgaggggcaacaagattggcctgtgctcaaattttaggaggcacggtgcccagagagggctccagagctcttttgctggctgcctcttctggagcagctgactggccagctgcagagcacattgatctggtcatgattgctttcatcctggagtagagcaagttcacacaatttaaatcaagagccacattagaagctcctgacctcaggataacctctcatttcctacctttgaaagagggaacaagagggaacagttcagtcacttcctaacatctagccacaaaaatacatgggaagatatagccacatctaaagattgtgatctcctgattttctttataacttaggtagattcagaataccatcttccagttttcccttggaatacaaggaacattagtcttaatctactgttctgtgttgaatagagaaataattccttcccttccacacactcttttttttttcctattgaacttttcctaggccattcatatagatgcagcctagatgaaatagacttggactgttcgtaaactcacccttttcttgaaatatcatactgcagtgtgacatttcttacctgtgttatatggcagaccagtgttttttgatgtatacgtttttaaatgcatgctttcttttggtaaatttaggcctcccattattctctgaatatccctaccagtcactataagggatttttttttttttttttaagtagagatgaggacttgctgtgttgtccaggctggtcttgaactctgggctcaagtgatcctcctgctttggcctcccaaagtgctgggattataggaatgagccactgtgcccagctcattaatataaaagttttactgaagtttattttctagagatttcaactttgcttctgctgtgactcacatgccaggataggtaatctcacatatggaacactgtaagttactggattgataagagggactgagaattgtgagcagttctcacttcttaagttgtaattgtactcttttctcccattcataactgagagtaatattaaataatagttctgaatctgctctagttcattaagtataattcacattttcttatttcgactgttagtaacaaattctaatgctcagaatgtgagcactaaatagtaattgaagaaattaacctcagacttgagaactattttactttataagatttccttttttttttttttttttttttttttgaggtggagtctcattctgtcacccaggctgaagtgcagtggtacaatctcggctcactgcaacctccacctcctaggctcaagtgattctcccgcctcagcctgccgagtagctgggactacaggcacgcgccaccacacccagctaatttttttgtatttttagtacagacgaggtttcaccatattggccaggctggtcttgaactcctcacctcatgatccgcccgcctcggcctcccaaagtgctgggattacagacgtgagccatcgcacatggccataagatttcttaataagaaagggaactactactttgctagaagtctccgtgcttgacttggaggacatactgagttacagtgaaataagtaagagcaaaggtctttagttagaaatgtcatgaaatgaggaaagaaaaggaaataaggaggttaaaatatgcgtaggtgttttataactattaaaattttactgacttgtgtagttgatatctttctactcagaaaaaagagaaaaagatccagatatttaggagaagtcacatatgtttgtgtaccttcctgataattgatggtattgagctatctataatcttggttaaatccttataagaccactgataacatattaatatttactacctctgattgtccagagttatgggtatattatgtcactggttgaaaatctgactgatttataaaaaaggatcaaactgtgggtgttagccttagtcaaacaatttaaacaagcatgaggtactacgaactgattttttaaaaaatttgggacagtgctgtttaagctgcttataatttcacttgtttttcagagataatttttacttgatgtctgtttgtcctagatactgtgatacactagatatagtaatgtatgagatatatgatagcggctgtgatttattatacctagaactaagagtggttttcagatggatattttactttcccttatatgagggactgggtcatactgcttacaaaagaagtgactaaaatggcctgctgtgtaggaagggtaacatctgtgttcatacaataaatggatgtagcctagttctctggtggaatgtctaacacttgccagtactgttctcaaaaagagtttgttaataattttaaataacttgatatcatttaaaaatacatggccagtctaggaaaggtggatagcaatggaaggtatttgctagaggctttttggccttcccggtgtctgaaatctcttctcagaagtgttgaaatgtaaccagcagtagaaaaattttccttactaattgtggaattgagtctggaatttgtcttttgattctgccaaaggagagagattcacaggcctaccaaaggaggaaggaggaatgcttataggtctcctgtagaagtactatttatagtattatctgctcatataaacctagtttttaaaaataaaaacttttttttaattgagacagggtcttgctatgctgtccagctggtcttgaactcctaggctcaaacagtctccccacctcagccccccaagtagctgggatgataggtgcatggcaccatgcccagcttctataaacctagtttaaaaatacgtaagagaaaaatcagataagttgacctcattaggaaataatttgtcaaacacattttggtagcatagtaagtgaaatttgttaactttcatataatttgatattgctaaaattgcttttaggtgtagtttttcttttgaaaaagattatcaagagggttctgactattcaagaatattgcttaatttcacaaaaattgaaaggaaaggcattttgtgtttccctcataatctacacatcaaccagcttatttgtgtgaggttagtgaaggaacacacaggatttgcattttgtcttatcagggtttactaaatagtgactcttgggtgagtcttaagttttgagcttttgttttctcctttatataataggaatggtaaatttatcttttttacttcatagaattgttttaagagtcaaataaaatgatggatgtaaagactctgtaaactccataaagctaggtatatagtgatgttattcatgttatttttaaattgatgaatgaattatcaactttgtggaataattattttaatgattggcatagggaagataatgtaccattatcaaatatctcatctttgagaaaaaagcaattttatttttatttaacattgaatatatatttaaggacaatttaaaactctttaatttttatggataaatgtacagaaaatattaatataatgtatagacattcagaaattattagattggcaaacctatttgtgatatatataaacagacaaaacttcagtgtctgaaaatttcctggtaaccaagtaatgcttttgccaagttctgcaccttttttatataccttgatcctgtctcatatttgtgaggtcttcctgagtccttgaatatactttattgcttttccatggtgcttgatgaaactaaaggtaggaccaaattcccagcccagtaattttgttttcaaggaaattgttgaagttcatttgtgaaacatagagaaaaatattttctgtttttagggactcaagtaaagagcaagcctatggaagtgatttcctgtagtatgtgccgtatttcttgatggtactcagctgagagtggttgttgtaaggaggatatatttaaagcacaaaggagaaaacgatgggaaaagaacagagcagccaaaaaccaaacagaacacagccaaatgattgaacataagtatgattggagtcctcaatgaaatggatagggggaaggacatgaaaagatgattggcgacattagtcaccaggaatatgcaaattagaattatggtgatatactgttcatcagagtggctaaaatttaaaaggtaatacctgtgtttttgaagatctggattgctggaacacattgctggtgggaatacaaaatggtgtggccattttggaaaaccaggaattctttagaaagttaaacatacatctgccatgtgactcagcagttttacttcagggattttaccccaacagaaaggaagacatttgtccataaaatgattatacaagaatgtacatagcaaatgtgtactcctaaggcnnnnnnnnnnnnnnnnnnnnattggcccaccatctgcatgggggagcggccaaaagcgtgatggatttgttaacaagcaaatgttaatgtgtcatatccatatagtggccggaatactcttaggcaataaaaataaagaaaccactgatacacagaacaacatagattaatctcagaattcttatgccaagtaaagaagttacgtgtataagagtacatatccttatgtgatccagtttatgtgaaattctaaagaggattatgctgtaagggactgaaagacagaagttgctaatggggctacttggttgccttctcgcactgtgaacctctagcattttgagatgtgtaaagttcaaaaaacagtatttatgtgtttgtttgttttgagacagagtctcgttctgtcgcccatgctggagtgcagtggcatgtctcagctcgcagcaacctccacctcccaggttcaggcagttctcctgcctcagcctctagagtagctgggactacaggcacatgccaccatacccagctaattttttgtattttttttagtacagacaggctttcactgtgttagctaggatggtcttgatctcctgacctcatgatctgcccgccttgacctcccaaagtgctgggattacaggcatgagccaccacacctggcccaacaatatttattttttaaagtcacaatctcttgaaaaagtagcacttcatagaatactagagttctgtggaacccctgcacagggggctctaattttttttttttttttttttgagacgaagtcttgctctgttgcccaggctggagtgcagtggcccatctcggctcactgcaacctctgcctcctgggttcaagcaattctcctgcctcagcctcccagttagctgggattacaggcgcccaccaccatgcccagctaatttttgtatttttagtagagacggggtttcaccattttggtcaggctggtcttgaactcctgacctcaggtgaccctcccgtctcggcctcccaaagtgctgggattacaggcatgagccagcatgcctggccagggggttctaattttaaaatgctaattgatgacttgttttcttactttcgtaactggaagtggtatgaactttgattagatatatagagtgtatatctgtgagtcatttctgtaattatctttgtcccttcaagtatttttttaaggtcaaagagctcatgaattcttaataaatgtgtgaggtctttcttctttcatcactgtaccttggatgctgagaagacacatctagaacatctgatttatggtgtagaaatcattttagtcagtattgaaccctccatccccctaactccaccagcagaatgataggtgaaatacattcctccaagaccaaaactgctttgatgtttggtgtcctctcattaataccatcattgctgtgggctacatttggactgcttgctttccaaaataaaaaaattgtatgtggttagagccaagggccaaagatacatctctagagctaagaattgctttacatttttgaaggttgcttaaaagtatttagcagagactgtatatagcccacaaagcctaaaatatttactgttgggtgatttacagacgaagttttacagataggatattagagaatcctctaatatagttattttcaaaaccaagattttataaaaatcaaagtggaggctgggcatggtggctcatacctgtaatcctagctttttgggaggctgaggcgggcatgtcagttgaggccaggagtttgagaccagcctggccaatgtggtaaaactccgtctctactaaaaatagaaaaattagccaggcatggtggtgtgtgcctgtaataccagctactcaggaggctgaggcaggagaattacttgaacccaggaggcagaggttgcagtgagccgatgtggggccactgcactccagcctgagtgacagtgatactctgtctcaaaaaaagaaaaaaaaaatcaaagtgtgctgtaactatcttatgttcttatcatcttattagttatttgactaagttttaaaaagtccatgaaaggacacatgaagtcatagtttaatttccagcattttttctttcgtttattcagtaatgctatattctatagatttggtgaaatgtggcctgtttgtttcaagataaatattaataaaaagtcaactattacagagaaagactaagtacatctcaggcaataaaaatatcaaaatcagttactagaagaagatttggtctaaagaaaaaagctatttatatttgaaagtaatgaaatagcattcatctaaaattttagcaattcagtcctttcactaatccacattaatcttctcttctgatgatttttgaataagtgagagtttcaagttttcacataaatgccaattttccatctaggtatgcatggatgtgggaaaaatttttttcccccaattcttaaggtcttgattccgttttgtaagatctgtatattgcctttattatagaggacagaagggtcattctttcaaagtttggtgtattaaaatagataccgttattttggtattgattatttaatttcctcataagtcatgagaaaactcaaacagcctagtttaactagattttgtaactctaaatatttgcaaaatattaccttaaatatttaaaatggagaaataaaatcatacaggtattaagctattttccttcagcttcagacttacccattgaaactgctttgcgaggttggagctgagatcctacagactatatttctcttttgtaactagtttcctgttagattttgccaatagatggtaccaatggagataggaaagtaaaagaggagggacaaaggacttttctcctttttgtttgctgcttcttcctgttcatgtctccacagcaacaaagcttcaccctggtaggaaaaggagtggcaaatggttccagtttgcagtttttccacactcataaaaccatcttcatcacatcccctcagagatgccagcatcaactagccatttcctccctctgaaaaatctgggttccagctttgcagggttccccgctccaagctcttgacacgtagttttcttttcggaggtctggatcccagtttcatagggtttctccttcaagcctctgagttttcatagttcctacgacttccctttgttcctctcagctctggtattgacagttgctttttgcatttactatgtctgtgatacatgtctgtcctcctttttgccttttcagttctccaattttcctggttagcaacttttattaaattgtctgttaaaattacaggtgtagtttctgtctcttgactgaaccctgcctaatacactggtcagaatactaggcctttgccagccaaagtccaggagatcacattaatagctactgagcctctgcaatgtgcagagcctttccctgttcttggtatcctgttggatgtcttctgtggtcccagagctgcctgggtatacgtcattatcacactgcattgttgtctgcttttctgtagtgtttctcatcttgaggccagtgctgatgtcttttgtctctctgtccttagttcctaacacaggattcatataaactaggtgagtcatgataaaattacctgatgaagggagggatcttattttgataatttttggcatctaaaattcttcagaaaatgagatgtttaaaccaaatcttaacctggtatcaaagattatgtgataccctccagaagtcacctacctgaggcttgattaggtttttctagttcagttgttaatgagattgaatatgcctcattctcactggcatatcttaccagctcttgtaaaactgttccagggaagaatgtaaatccatctatcaagatacctttcaaatgatcaggcctcttcccgtcaacccttccacctccattacgcttgtagagtgaaccctgtttccttcaatgtactttcttcattagtacctaaacgtatgctggatacagggtcatgctgagagtttccaagacttctagatattttgattgcagtatactttcctctccattatttagtggggtcaccttggcctgtataaatcccacttccagatcccttcccccatcatagtgcatgttataggctcttgtgtcatttctgtcttaataccttttagtgtaggttaccttcccctaagtataattaaacaaatctataattactatgtctgttcctgctttatttcctttatagtggagatttgttgactatagatagcttgaatgtctcggtttactttatagggatttttagaggaaaaagtaaatatttctttgaaatttctatgtacttatcaagggatatagataatttgttttctgtctttcagaattttgatggggatttggtttaaactttatctgctctttgagttttatagtataaatctttttaagaaattgtgtttatttttgtttactcttgaattttaatacatcatagtatgctaattaatatagtgtttgtctccaaatgccaaaatgttatgaaattgtgaaaattgtttagctatattctttttcttgggaatatgataggaattgctacctacttgaaattaggcatggccatgtgacctgatttagccaatgaaatctgagcaaaagtaatgtgtaataccccagatggacactttgagtgagtttgtatagacagtactttgccactgtttatcctcttgccatagtagcagctccttcagcctagatccttgaagacttggagcagagcctccagtcagtgctcagtggatgtataacatgaaagagaataaaatctttgttattataacctagtcaaatctgactgctacagttggtattaattaatgtcttctttaaaggaacatttatcaaataaacacatctcagataaaaacagttgttctcccatggtgtatgtatcttcatgtttgtccttagtggttataataatctgtataaattatgaagagaatctgctggaatgattagtaaggtgctttatttgtgggccaaatagtagcaggtattagatacgttggtgggccaagaaatgaagggaagccaagaatggagtgatacatcttacaaaagagaccaaatttcatacccgatgacatcaaattttatacctaatgatgtcaaatataggccatttgtttcaggaaaaaaaaaaaaaagccatctgaccagtcagttttggaaagtcatctgttgagaatatacggttacctagtggcaggtctgggaaaaagaaattcactcttttgactctagccatatatcccttttttggggtggggtggggtggggtggggtgggggcgggcacggaggccgagtctcaactcttgtcacccaggcaggagtgcagtggcttgatctcagctcactgcagccttcgcctcctgggctcaagcaattctcctgcctcagcctcctgagtagctgggattacaggtgtgtgccacaacacctggctacctttttttgtatttttactagagatggggtttcaccatgttggccaggctggtctcgaactcctgacctcaggtgatccacctgcctcagccttccaaagtgctgagattacagatgtgagccatgtgcccggcccctgtatcctttttattattaaaatatttgaccttgcacacttactaagaaacaggtaaataaatatatgtatacattttactgtcttaaaatctacttttactttttaattatgctattgtttttattcttttttccctaaacttttttttttttttttttttttttttacaagtttgcacagagttctgggcttatgacaagatcctcactggtccctgcataatctgcatatctgtgtgtgtatgtagttatacagcaataaaataattaatatctgttaacccaacttcttattgtcagtaacttaactttttatgtgcttttctccttgcctctccctaatttgtaactgtcatcataaactttattttaatcctttgtatttttaaaaagcattatatatagtttacctaaacagtaaatatattgtgtgtttttatttttataaaaaatactaaatgtagtcttctgggacttctttttgttaaagatcacattactaatatttgtccttgttgcatgtggttgtagttcattcatttttactgctgtataataacattctattctatgaattaccgtaatttgttacctattatctggtctgtaatagacatttaggttgtttctagtattatgctattacggacatgttgctgtgactatttctgttcatatttttgggtaaatgtgttacagtttctcttggatatgtacccaggattaaaatctcaggatacctttctcaggaagaatttgaatttactggcctaatattattactagttaacatttcaccagataaaataagctggattgctctcacagagaaggtagggcatgtacaacccagaggtgtaacctctcagtgcttgctttatcagttaaaaaggttggttttcaaatggctaggtagggtaatttgaatctcagaattatcagtagtctactataacctttctgtagttgtactttgagagacgcattacttatatgcacactcacgaccgagagtgttcatcacataactgagatgtaaaataattgccttctcgtctctcctgttttcgtttgtttgttttttgagacagggtctcactttgtctcccaggttggagtgcagtcacagctcactgcagccttaaactcctgggctcaagcgattctcctgcctcagcttcctaagtagctaggactacaggcacatgacaccacatctggctatttttaaattttttttgtagaattgagggtctcactgtgttgcctaggctagtctcaaactcctggcctcgagatgctcctgcctcagcctcccaaagtgctggaattatagccatgagccacagtgcctggcctgagcttccttttaatgggctttttccccttttgtatataaccatttgtatatcaaaatgaggcactatctcaagtggttacagttgctctcttggttctattctgagtaagaccattattatcaaaagcatcagatgacatttctaatagatcactatctgaattctctgaaactgaacagctgtttaaaacaaatgccctttctgtggggatttatcatctgcaaatcaatttattattcatgatggaagtatctacattccgagtgacatttaaatcagattttatattttgaattttaatttattgcccagcagacaatgtatacaaaaatatgtttaaagaaaataatgaaaataagtttcagttgaaaaatattatcttgtgaaagtcagagggatctgggggattatttatacaaatgatggtgttgagaaacaaccttaataaacctgtttgaagcttctcagctactggttatttttgtctaagttcttactgaactcaggaggtaatggctggtatcatttcatgtaggggttccaatatagtgaactataatgtcttgatctctacaagcttaataaaggcagccaattaaattttaagacttagcacagtggctcatgcctgtaatcttagcactttaggaggcccaggtgggaggattgcttgagttcaggagttcaaaactccatctctacaaaaacaaatattagctaggtgtgatggtgcatacctgtaagtcccagcgacttggggggctgaggcaaaaggattgcttgagcctgggcaacagaggcttcagtgagccatgatcccgttactgcactccagcctgggtgacaaagtgagatcctgtctcaaaataaataaattttatatatgttgtcacatggctcaaacagttttcatgtaaagttcactttgagtatgtgggctattatttgaatttttggcctttgaaataattatgaaaacattcatcgttattatcctggagtttcactcatttgcagaataacttcattctgaaaatgatataacacctcccaagactaagtaatattaacagagttaatattttatctttttgccctcaatgcctcctatattgctggggacatgatagggcctgtgtgtgaatgtttgttgaaatgaatgaataatactttttaatatataggagaaaacctaagcacagcagtttgtgtgagacagtgatcagaaactttgccagttaatagattgacttcaatcagggagacagagcctaagtcaaaaaaatgactaatctctagtactatgttagtatttgctatcattccttcattctgtaggtatttatgagcacctgttgagtgtcaggatttgttctaaatgctgaggatacaataatgagcaaaatatattaattccctgttcttaaggagaccacattctagtggagggaatcgacaatagaccaatatatgccgggcacgttggctcacgcctgtaatcccagcactttgggaggctgaggtgggcggatcacaaggtcaagaggcggagaccatcctcgccaacatggtgaaaccctgtctctactaaaaatacagaaaaaattaggtggacatggtagcgcgtgcctgtagtcccagctactctggaggctgaggcaggagaatcgcttgaacccgggaggcaggggctgcagtgagctgagatcgtgccattacactccagactgcacaacagagtgagactccatctccaaaaaaaaaaaaaaaaaaaaaaacccaatatagaatgttagacagcaagactgtggagaaaattaaagcagttaaggggaatagagtgttagctgcgtgtagagttctcactgttttgtacaaggtgaccagggaagtgatatttgagtagaacctaaaaggaaataaggaaatgagccattaacatctggagaaaatgcattccaagcagaggaagggcaagtgcaaaaaaagagacagctgctatagtggaatgggtaggagcagaatggcagaaaacgaggttaaaaaggagatgggcaggccatttatgaggcttatcaggacctcataaaccatttaagaactttgagtttaacagtttagtaagtgccagtcattgtagggttttgaagaagagtgattatgttatttatgatttaatatgtttgctctggctgctgtatagaaatacactatgggcagtggggcagggagggcagaggtgttgcggtgggagcagtaagacgagttaggatgctcgaaatttttttcttaagagttggggtctcactctgattcccaggctggagtgcagtgatgagatcacagctcattgcagtctcaaacttctgggctcaagtaatcctcctgtctcagcctcctgagtagctggaacttcagacatgtgccaccctgcctggctaatttttaattttttttcctaagaggaggggtctcactatgttgccaaggctggtcttggaactcttggcctcaaacagctctcccgcctcagcctctcgagtcactgggattacagatgtgagccaccatgcccagttggatgctctaaacattaaattctaagcaaagagatgatgaggctgggcttggatcaggatttgagcagttcatgtgatcagacttgatacattttgaaggctttggtgatgcattgattgtggaatgtgagaaaaggaaagacagagcaaatgttagactatagttaccatccatttactgccatggtgaagactgcaagaggagcagagtttgaaggagtagagatacacgtgctattttcttgctgaaatctgtctcatgctagattttaattcttcagtagttagcaggtaagagagttgcttcctaactctggaaatttgctactgtggaaagaaaattgagttgggatccctaaggtgaaattttaagacctgactctctcactttcagagacttggccagatcacttcacttttttgagcctcttcaggctctgtttctttaatcataaaataaattgcttggcccaggttgtctctaatgtttcttcacttgtcagaattgatgtctctatccattctgtttggaactgggttgattacactttgcccttgtctacttgttaactttaagtattcgtcaagtttctgaccttccctcttattacacataccctttctggcttcagttggttttatataagtgcagctctcagactcacactttaaacattgactttttttctgagttctagattaaatttgttccaataggttcaatccttaatttacttttttcccccaaacttacttcctgtgctcagcaattagtaattttgattatggttactattattactagttattacctttcttattgaattattaatgttctgtttgctaagataggttaattgaaattcagcttgggaaactaacctagcaaatctcacagtgtgatttgtgatcctgagaccctttcagaaagcccacaaggtcaaaacttaatttttcataatactaaaatatttgtacccgcgccccccccccgccaccttttaaactctgttgacatttgctctggtggtacatatgcagtgtgtgtaaaacttctggctccttatttcaaaataatggcagtggcattctttacttcacacatacagggaaagaaacagaaacagtttcacttaagaatgttcttgatgaagaagtaaaatgtattaattttattaaatctcaccatgtctgtcttaatgtctgtgtgatgaaacccaaagcataagacatttctgctacatagtatagccatacaatggaatagtaaacatccatttagaaagatgacgtatagctacatttatttatataaatggatctccatgaaatagttgaggggaagtagctgaaatgtaatacttcatgggaaaacagcctatgaaacagcatgtatggcctgatggaattcatgtgaatgtatttatatatgttttttggaacattaggttttgtaaagtgttaaaagtgtcattgatattacatggccaaatatatttggagtgtcagtaatacttattagtatatgaagtctctgcaaaattttatagtttttctactttatttgatttagctttccagatttgaccaaactattaatagtagtgggacaggtggtttctatgttgtatgaattctgtacaccacttttaatacctttatatggaaaaacaaacagtatttattaccaaaaacctgtgtctgatccaattaaactatttcataaactctaatactttaaaaaattgtcatctatttgagtagcaaaatagccataatttgaaatgttgtcactgaaagacttcatattacatctttgctcttgattatgggtcacatttttctgtttcttggtctctgattttttatttgctgtcagacattgtgaaaaaggacagtacagactgaagtattctgtcaggtcactagtgttaggggctgagtcagttcagtttgggatgggaccttgttgcagttttagttgtctttagtttaccactggtatcagatgttgtgaaggcaggatgaggacactccctttattagagtttgccatctgagtacctgtgagattcaggcaatctcgccatcctttatagcccaccccagcctttatagcccagtttgttgtactgtgggagatccctctctgtttcacagcacagctgttggcatttggagcagctgggacatgttttttttttttctctctctctagccccacttctggcttcggtccttacctctggagagagcactgaactaataccctgccaccttcctttggccaccttacacttagtgtgccacttgaacaggggtttctctcagctcttctgccttgtcctcagcattctgtggtcccatcgcctcaccttcccttattcagcttcaatacttggaagggatcctattgggaaagtgcagatttgctttgtgaatgagatttctgagattttaatctatcttgcccccgtgttccccttgaaaagtctgttaaaagttggctggtttccccctcctattgcaggttcacttctcctttcaccatgatcccagccctgttttcttttccagaaagggcttgttcctctagaatttagttgatttattttctttgcatcctcagctttctgagtttaaaaaactatgattttatagtttgtctggctcattcttactgttaagctgggagcaacaacagtcttttgtgagcgtctatatcataaccataaagcgctaatcctgatatattctgttgtgttcagcataattggtataggtcatattgaaattatttagccaattatttcagtaaagctccactcaaatgaaatattgaccatatttaggcttgatggaaaactgatataaatgcctgctaacacgacagttaaaatgtttttattgtgataaaatatacaaaacaaaatttgccattttagttatttttaagcataaagttcaacgacaattaagattgaaattttgtgtaaccatcacaactatttctagagctttttcatgtaagtagaatcatataatatttgtccttttgtgtctgacttagttcccttagcataatgttctcaaggctcatctgtgttgtagcatatgtcagaacttcatttgtttttatggcatcgtatgtatatgccacattttgtttatccgttgattggcagtttgttttcaccttttggctgttgtgaataatgctgccattaacattggtgtacaagtatctgtttgagtccctgttttcagtttttttttttggtatatccctaggagtagagttgctgggtcatatgattattctgtgtttagttttttgaggaactaccagtttttcacaatggctacaccattttacagttgcatcagtgttccagtttgtccacatcctcactgacactgctttctgtttgatagtagccatcctagtgggtatgaggtggtatctcatagtggttttggtttgcatttctccaatgagtaataatgttgagcatctttttatgtgcttataggccattggtatatctttggtgcgatgtacattcaagacctttacccatttttaaattgggtgtttgttttttgctgttgagttgtagcagttctttctggatattaaactcttgtcagatatatgatttgcaagtattttaacccattctgtgggttgtttcactctctttactatcattttaaatttaaagtccaatatgtctgtttttgggggtcttttttgttgttgcctgtgcctttggtgtcatatttaagaaatcattgtgaaatccaatatcaggaatatttcttctaagagttttacagttttaactcttatatttaggcctttgattcattttcagttaactcttgtatatggtgtaaggtaatggtccagtttcactcttttgcatgaaaacatccagttttcccagcaccatttgctaaataaactgctccctccctattgaatggtcctggtacctttgtcaaaaatcaggtgtgagagtctgtgtttgggttctcaattctattctgttggtctatatatatctattcttatgtcaataccataatgttttgattattgtagctttttatctttttattaggtcttgaaatggggacacataagacctccacctttgttcttctagttcaaaactattcaaggttccttggaattccatataaattttaagatatcgtcgttgtcttgctttttttttttttttaaatttgagacaggatcccactatcacccaggctggagtgcagtggcataatcatagctcactgtaaaccggaacaaattttagaccatgttctttttctgcaaaagagcaccattggaattttgatagagattgcattaaacctgtagatcatttggataatgttgacatcatattaagtcttccaatccatgactatgggatatactttcatttatttaggtttctttaattttattcaacaatattttgtaattttcagcatataagtctatcactgcattggttaaatttattcctaagtattttactgtttttgatgctattctaaatggattctttttaaaatttccctttcatatagttcattgctaacctatagaaatacaactgatttcatcatggcagttttctttctacatcttaaggaaattagtttattagctctaatggggttttatttgtggattctttaaggttttcttcatataagatcatgtcatctctaaatagggatagttttattttttcatttcctatttggctgccttatatttctttttcttgcctaattgttctgactagaacttccagcacggtattgaatagaagtggtgaaagcaggcatctttgtcttgttttttatcttaagagaaaagctttcagtctttcaccattgaatacgatattagctgtgagtttttatatatggccttttcatgttgaggaaattcctttctcttttgtttattgagtgattttatcatgaaagggtgttgaattttgtaaaatccttttttttttttttttgctaaatcaattgagaagttcatgtggtttatcttcattttgctaatgtgatgtattacattagttgattttctttttttttgagacagggttttgctcttgttgcccagactggagtgcaatggcccaatctcggctcattgcaacctccccctcctgggtttaagcgattctcccgcctcaacctcctaagtagctgggattacaggcatgcgccaccatgcccggctaattttgtatttttagtagagacggggtttcaccatgttgtccaggctggtctccaacgcctgacctcaggtgatctacctgccttagcctcccaaagttctgagattatgggcgtgagccactgcgcctggctacattaattgattttcttatgttgaaccaccgtcgcattcttgagacaaatcctggttcattatatacccatttggtataatctttttaataagctgccgaattcaatttgttagtattttcttaaggatttttgcatctatatttataaaggatactgacttgtaaaattttcttttcttacgatgtctttgtttggctttggtgtcagggtaatgttggccttatagaagtcaagaagtgttaccccctcttcagttgtttaggaataggttgttaattcatctttaaatgtttggtagactttaccagtaaagtcatctggtcctgggcttttttggttggaagtgttttatactgattgtcagctcacttcttaggtatattttggttgtctctttcttcttgtgagttttgctggtttgtgtgtttgtaagagtttgtctatttcattaagctatccaatttgttagcatataattgttcatagcattcttttataatccgttttatttctgtataattggtagtgatgtttccactttctgattttagtcatttgagtgtgatctcttcttgttagtcagtctagctaaaaatttattttgttgattttttttttcttttttgtttttttttttttttttttgagacagagtctcgctgtgttgcccaggctgcagtgcagtggcacgacctcggctcgctgcaacctccacctcccaggttgaagcagttctcctgcctcagcctcccaagtagctgagattacaggtacttgccttgacgtccagctaatttttgtattttagtagagatggggtttcaccatgttggctaggctggtctcaaactcctgacctcaggtggtccacccacgtcagcctccctgtgcccagcctattttgttgatcttttaaagaaccaactttctgttttgttttttctctattctttttctattctctattttgtttatctccaatttggactttattattttcttctttctgctagctttgagttttgtttgatgttctttttctaattctataaagtgtaccgttaggttattgagctcttttaatgtaagcttttatagctataaacatcctctttacacttctttagctacatctcatatgcttatgtatgttgtgtttttgttttcatttgcatgagggtcttttttatatctcttgtggtttcttctttgatcagttgcttgtttgagaatatgttgcttaatttccacatatgcacaaattttccggttttccttctgtttctgatttttagtttcattccattttgattggaaaagagctttttatgattttagttttttaaagtttattaagacttgttttatggcctgccttatggcctgtcctggagaatgttccatatgcgcttgaagagtgtgtattctgcttgttaggtggagtgtactatgtatatctgataggtctaatacaataggtatatagtgctgttcaagtcctatatttctttcctccccttcccctcccctcccctcccctcccttcccctcccttcccctcccttcccctcccttcccctcccctcccctcccttcccttcccctttctgtgagacagagtctcactctgtcgtccaggctggagtgtgatcctggctcacttcaactctgcctcccaacttcaagcaattctcctgtctcagcttcctgagtagctgggattaccggcatgcaccaccacacctggctagcttcttttgtatttttagtaaagacgagttctcaccatgttggccaggctggtttgaaactcctgacctcaggtgatctgcccgcctctgcctcctaaagtgttgggattacaggcatgagccaccacacctggccctacattgacttttatattttaaaattaacttttaattacacaagtaatacaggaaggtctttcttaaacccgcatgacacatgtttacctatgtaacaaacctgcacatcctgtacatgtacccttgaacttaaaataaaagttaaaaaaagggaaaacaatacagacaagtttaaaatctcatttgatcctatattttcaattccagttcattccaaaatgtaaccactgttaacaatgtattgggttttctttcagaacttctcaacacatttattttcactctcatttttgatctctctctcttttcttccctctctcataatacatacaaacatacatataaacacaaatattatagtatcatttttgtggtacatatagataaatgttggcgtactgtttacattatattgcaatnnnnnnnnnnnnnnnnnnnnagtctcactctgtcgtccagactggagtgtgatcctggctcacttcaactctgcctcccaacttcaagcaattctcctgtctcagcttcctgagtagctgggattaccggcatgcaccaccacacctggctagcttcttttgtatttttagtaaagacgagttctcaccatgttggccaggctggtttgaaactcctgacctcaggtgatctgcccgcctctgcctcctaaagtgttgggattacaggcatgagccaccacacccagccacgtcctgtatttctttataaatctgtctggttcttctgtccagtacttaaaataggatattgaagtctccatctattattgtagagttgtctgtttctcctttcaattctgtttttgcttaatatatttttagtctctgtttttaggtgtgtaaacgtttataattgatatagcttaatgtatcgaaccccttataatatatgatggccttcgtgtcttgttatcatactctgttttgtctgacaaaaacatagctacacttgctcttttttggttactatttgcatggaatattttttcctatcctttcactttcagtttcttagtgtctttgtatccaaagtgcttctctctcttttttttttttgagacagagtctccctccctcaccaggctggagtgcggtggtgtgatctcggctcactgcaacctctgcctcttgggttcaagtgattcttctgcttcagcctcctgagtagctgggactacaggcacctgccaccatgcccagctaatttttgtatatttagtagagatggggtttcaccatgttggccaggatggtcttgatctcttgatctcatgatccacttgtgttgccctccaaaagtgctaggattacaggcgtgagccaccatgcccggccttttttttagtggagttttgctcttgttgcccaggctggagtgcagtggtggaatcttggctcactgcaagctgcgcttctcggattcaagcagttttcctgcctcagcctcctgaatagctgggattataggtgcacgccactacgcctggctaattttatttatttatttatttattttttgagatagagtctcactctgtcacccaggctggagtgcagtggcatgatctcagcttactgcaacctccacctcccaggttcaagtgattctcctgcctcggcctcccgagtagctgggactacaggcgtgtgccaccatgcccggctgttttttagtatttttagtagagatggggtttcaccatgttggccaggctggtcttgatctcctgaccttgtgatctgcccgcctccgccttccaaagtgctgggattacaggcgtgagccactgcacctggccaatttttgtgtttttagtagaaatgggatttcaccatgttggccaggctggtcttgaactcctgacctcacacgatccacccacttcccaaagtcctgggattacaggtatgagccactgcacccggtctcttatagacagcatttaggtggattgggtttttaaaaaatccagtctgacaatctctgccttttaattgaagagtttaattcatttacatttaaaatactgataaggaagaactaatttttctagttagctattgttttctgtatgtcttatttgtttctaactccttaatttttttatttttgcccttttattgcactttgctaatttttaaaatagcataccattctaattcctttgttttttttcttttctgtaatattttatagttagttttttagtggttaccttgaggattatagttaacatcttaaaatgatagtaacctcatttgaataataccaacttagtagtatataaatagtctgctcctgtatatctctgtctcttcccttttatattgttattgtcacagattacctttttatattttatgtgcccagcagcagatttataattttttttaccttttaagataaatgcaaatcaaaatcacaatgagataacatctcacaccagtcgaatggcgattactaaaatgtcaagaaacaacagatactggcaaggttgcggagaaatagggatgcttttacactgttggtgggaatgtaaattagttcaaccattgtggaagacagtgtggcgattcctcaaagatttagaaccagaaataccatttgaccagcaatcccattactgggtatatacccaaaggaatataaatcattctgttacaaagatacatgcatgtgtatgttcattgcagcactattcacaacagcaaagacatggaatcaacccaaatgcccatcattgatagactggataaagaagatgtggtacatggacaccatggaatactattcagccacaaaaaggaatgagatcatgtcctttgcagggacatggttaaggctggaaaccattatgctcagcaaactaacacagaaacagaaaaccaaacacctcatgttctgacttataagtgggaggtgaacagtgagaacatatggaaacagggagggaaacaacacttaactgaggcctgtcggaggagggcaggggtagggagagcattagggaaaagagctaatgcatgttggccttaatacctaggtgatgggttaagtgcagcacaccaccatggcacatgtttacctatgtaacaagcctgctcatcttgcacatataccccagaacttcaaaaacaacaacaataaaataattaaaaaaacaagaaaagcaaaaagttaaaaaccaaaagtgcgttaatactctcttttataattacctgtgtaattacctttaccagtgttatgtcttacgtcctttcattatagcctgaaggtttccctttatctttcttgtagagtaggtctactggtaacatacttccttggcttttatctggaaatttctccttcattcttaaaggatagttttgctgaatataaaattcttggttgactttttgttttctctctggatttaaaatatgccgttcctattgctgcctggtcatcacagtttatgatgacacatcagctgttaatcttactgaagagcccatgtatatgtctagttgcttttctcttgctgctttcaagatactttatttgtctttgggtttctacactttggatataatgtgtctgaatattgtatctcctttgaatttattcttggatttatttgaaatttttggatgtatgtattcatgtctttcatcagctttgagaagcttttcaccgttatttcttcaaatatttccccctttcttttatctttgggggctcctatgctgtgtaggtgggtacacttgatagtgtccctgtccggtaggttcatcaggctctattcatttttcttcattcttttttctttgtatccctaagactggataattttaattgccttgtcttcaaatttgctaatcattttttctgcctgttcaaatctgttgaaccactctagtgaatttttaaattgtagttattgtaatttttagctttggaatttttgtttgattccattttataatttcagtctctttactgatattcttgttttgctcatacattgttttcctgatttccttcagctctttgagtatatttaggacagttgatttaacatttttgactagcaattccaaattctgtgctgcttcaggtttctgtcaaatgctttttttcttaatgggccatgctttcctgtttgtgtgctttgtggttatttgttgagacctagccactgtagtacaatgtggtaactgtggttatcagattctcccactcatcaggcctttcttggctagttgaaggctgttgtcatccctttgtgactttccaaaaccatttttgcaaactgtgtatttcttgtgtgtatagtcactgaagtttctattacattatctctgtagtaagtcagtgacctgacaatgatataacaatatctggtttaaagaagaaggtgctgtcttattagatcttccagtagatgcaggtgcgcctcccctgcccggtagccccagagggcctaaataaaggcaagcatctgcctctgtgcctgtctctcagtgatctgccaaactgaccaaaatattcaaacttgaatttttggaggacaaaattctcccactgcctgctatggcactaataagtcgctccagagatgggggctgctattccttactgttgtggcaaagctgagaaatggggaatggtagctactggtttgcccatgtgagtcaagatcagcagcctctgcatgaagcactttcctggttgtttttagtgtctaattaggttccatacttggaagatagttgattcttgttgtttttccagtttactggttgtttttggtacaagaaccaagctctagagcattcttctctgacattttacacctcaagtgtcataataaactaatattgtctttcttatggtatttttgaatggaggaaaatctttggtacatttctttttttctagtttgtgtgtttcactattcatactatcaaaagaaaagaatcagcctcagatttgaacacatcaaggattaatttttttttttaagacagagtttctctcttgttggcccaggctggagtgcaatggcacaatcttggctcactgcagtctctgcctcctgggttcaagcgattctcctgcggcagcctcccgagtagctgggattacagcatgcaccaccacacccagctaattttatatttttagtagagacggggtttctccatgttgatcaggcggtcttgaactcccaacctcaggtgatccgcctgccttggcctcccaaattgctgagattacagtcgtgagccaccacacttggccaaggattaaaaattttaagtgtttgtataaaaaacctatagcatgattgaaattttaattcagtgctctgtcagtgttttgtacaatcacttcatggttttgtttgtttgtttgtttgtttgacatggcgtcttgctctgtcacctgggctggagtgcagtggcatgatcttagctcattgcaacctccacctcccaggttcaagcgattcttctgcctcagcctcccaagtagctgggattacaggtgcacaccaccacgcctggctaatttttgtattttactttgtgttttatgcaaataacaacattgtctctaatgaaaaaagtttaagttttaaacactggttattcctcattctgtatgattagcttacatgtcctagagtgtgttgggtatttgtcatggcttaattattgtggggaaaataacagaatatttgcttacatgccacttaatgagttcactttttttacagtagtttttatttatagtcatcgttgctgaaaatgttatgaagaaataaatctgtctttatctctgtttgatatttcagaaagactgacaaaagcaacattacgtggaataatcttagtttcccaataaatcctagattttattcttcacaatacttgatttgttctacgtgtatgttttgcttatttacctaaaggaaagtcatttagtcatttaaaaacaatatttagccttttctttaatattttgcaattattaacaaaaaattgttttaagaatatttcaaaaacataaacagtggattgccactctaataagtccttttatattagagtagcttgactataaggtgaaattgtatgcaaagagtttcttactgcaagtgctgagaaaaccacactataacaccatttttacaagtaaagactcatactagaacatctagtttgggagtatttatagctgttatcttcttttaaaacagtgtatggtatgcatatttttctattcctaaggcccaaactgagttggcattctagaatcattatctatattccttaagtaaatagaattcttacctttccttaattgtatagcagataatccaagaacaagtttagcccaaggcgaagtaagataattcattatatttgcatgttccttttatgtacttattgttgataactgatttttgaacattttcaactgtctttaaatggagagttatatgctgtcattctgtaaccctttactgcccttttaccgttttaaatttgatctaagtattacaaaaagctagaagtgtttttgacatctagaaaaacattagttttgcagtacacacacgtacatatatgagacgtgtgtgtgtgtgtgtgtgtgtgtgtatgtatatgataagtgctatgagtaaaaactaaggatagaggaatagagtcagaaaagggccctctgaagaatgacatttacactgaaatgtgaatatttagtcatttaccattaagtcacactgtttaatctatcttaatattcatagaaacaatagcgtaggatgatggcctccagattcatccatttattctaagcaaactaatgtaggaacagaaaaccaaatactacatgttctcactcataagtgggagctaagcaatgagaacgcatggacacaaagaggggatcaacagacaccggggcctacttgagggtgaagattggaggagggagaggataaaaaaactacctattgggtactatacgtactactttggtgacagaataatctgcacagcaaacccccatatatgcagtttacctctataacaaacatgttcatgtactcctgagcataaaagttaaaaaaagaaatgatagtgtaaagatcttcataatctcaaaaatttttattaaactgataaaatattttaaccaaactcttgagtgttccaattttagataatcagtaatttagcactgccctattatagtaaatattaaagattaaccttaaagccagtgtaagtagtagtttttatgtcacaaaaggtgtttttagtttagcatatgtgcctttgttctcagctaacgaaaaaagttgatatgcacagttctacttaaagataattagaaatgtcagggaacctatttcatttgggaatattttttctttaataatgatctaggctgtggtaatgaaattctttattatctgtgtttacaaatcattgtaacttaattaaaattttacaattataccacagattaaaaataggaacaatttgaagatgtgattttatttgaaaattttatagtaaggtttagctttataagtatttttctcttgcttttatgaattagaaatatctttcttactcctgacagaatataaaataagtatagttaaaattactttatagaccaggattttcttcactctttgatgatgaaataagtgccatgcgtattattctgagttagaagcgcatagaatgtcccctgatacattgttcaaatgcactatatgaagaaaaggttaaggtttatgtgattctatttttttctcttagactctcttaaaaccatgctgacatagagcatataaaatgctctatgtcagcattgtccagtagaaatgtaatgtgcaccccatatgtaatttttaagatttttgtaggcatattttttgaaaactttttaaaaggcagagttaattttggtgatttttttacttaaacatctaaaatatttttcaacattattttattttattttattgattgattgattgagacagagtctctgtcacccaggctggagtgcagtgacacgatcctagctcactgcaacctctgccccctgggatcaagtgattcttatgcctcagcccaagtagctaggattacaggcgtgcaccaccatgcctggctaatttttatatttttagtagagacagagttttgccatgttgaccaggctgatcttgaactcccggcctcaagtgatccgctcacctcggcctctcaaagtgctgggattacaggcatgagacactgcgcttggccctcaacatgttattaatataatagttattaacttttttttggtgagggataataaatgttattgtctgaagccactaaggtttttttttttaatttttaaaaaagttgtaaaatacacatagcaaaattcactatctttaccatttttaagtgcagttcagtggtatttatttcatattgttctgcatctatcaccattttccatctccagaattcatttcatcttgcaagatgtaaactctgtacccattaaagaataacttcccattcctgtccttcccccagcccctggcaaccaaagtccactgtgtattttacagctgcagcacaactcagtttggactacgtacttttcaagtgcttattagcctgctgttggctacagttttggatagctcagttctgtgctgtaatagatactgaatccatttatagttactctgtgttacagaatgttactgttatatgaattaattctgtaataacatttctataatactttgttatttttgtccttatttgtcatccagaacaataggcaggtcccgtggtcagcaaaatagcaaaagggtcattcaaaaatggtgtggcaagattctgaagtggtgatgtctgtatagtcggataatgcaactgtaaaatacacagtggactttggttgccaggggctgggggaaggacaggaatgggaatttattctttaatgggtacagagtttacatcttgcaagatgaaatgaattctggagatggaaaatggtggtagatgcagaacaatatgaaataaataccactgaaactgcacttaaaaatggtaaagatagtgaattttgttatgtgtattttacaacttttttaaaaattaaaaaaaaaaaaaccttagtggcttcagacaataacatttattatcgctcaccaaaaaaaaagttaataactattatattaataacatgttgagggccaagcgcagtgtctcatgcctgtaatcccagcactttgagaggccgaggtgagcggatcacttgaggccgggagttcaagatcagcctggtcaacatggcaaaactccgtctctactaaaaatacaaaaattagtgactagatgcctgtgtttgaaaaagttggagtccgaaatgttggtagttatgagctaccatctcttaggactttttgctggggcacgtagatttcttggagtgtgcgttgggaatccccaagaccaacccatcatgcttgatgatttgctcgaaggactcatagaacttaagagaaaagctgttaaactcatggttatgatttgttatggctaaaagatgcagatgaaaatcaacaaagggaaaaggtatgtagcttgaagtccaagaggatccagatgtgagctttcatttgccttcttccagtggagttgcatgggctatgacaacatgcaaagagcttcaaccagggaagttcacctgagtcttgttgtgcaagaaaattactgtggatctattagataggcatggagtgctcatatgactgactttagttactcagtctccagcctctcctgcaggtccttcctcacctaagaaatcaaactgatatagtgtgggccagagccccaggcatacaaaaacaagcattaaccataattcatattgtttatatagattacctgatatgatccaaggtgtcagttatgtagagacactcttatcaggcaggatattccaagggctcggaggttatctcccaggagcctctcacagactagtgcttttttcagaatgtgcagagttagagtaccccaagcctccctagttatttcttgactgcacaggatgatttgggagcctaacaaaggaagatgtctctagtgtaaagtagtgtaaagtcttacagaaacaaagggtagatgagagtggcaatagctcagtacaacttaaatatctagtgtgtttaaacaaatggcatgagttactgactgtcaaggtagagctataaaggttgactatcagaagtaaagaatagcatttagagtaaccctacaattaacaggtttcttaattggaatgaacttcatggtttactttctcctttgcttgggaagtgcatatattatctcatctaatccacatcaaaacctccatttctgcctatgatggagtaacttgtaacagactaaaactgctgaaaactagaaatgctaggggaaaaaatcattttgaaggcattgtaaagcttctcagtgaatcaacacttgaagagtcaagattcaggagagaagggagacagacacactctgtgctggttttcctcttgatccattttccagctcttaagctattgggggtaagaagataaaagctgagcaaggcataagagatgagcaaaaaacgactgaggaagttgaatggagctttcaatagtttgttgtggtgttgttctggccctagtgaagagccacaccatagagtgaggacaaatcagaggcctacctatctttgtagtgtctgaaactcagtctcaagtcagctcagtcccaattggattgcatcagtctgctcctacagagactgttaaaaaaaataaaaattaaatcctttctggaggaaggtaacatcatctggaggctctacgttttttccgtatacatatgcatatgataactcacaatgtcttacatacaataaaaaattactaagcatacaaaaagatcaagagaagaaaattgacaagagaaacagattgatagattgttcagactttggagttaaaagcaggggctttaaaatactgtattcggttcatgaaaatagatgctgaggtggagaatttcactagagaactggcatctgcaggaaggagtcaaatggaaattctagagctgaaaaatatagtaactaaaactaagagcacaacagatgggtttaactgcagattagacacagctgaaaagaggatttgtgaactggaggatacgttagtagaaaacattaggcataaactcgactttaaactgagctaaggaatagaaacttttcaatatctcaccaaagtatgtctcttattttagagcatgtgggtgaaaagagtccttattaaagtgcagtcgcaactcttgctattttaatgtgtatttagtattttttggtatttttattttagtggatttttaaaaaattattaaaaaacattatttaagagagcatcttattctgtcactcaggctggagtgcagtggcacatttgtagctcactgcagcctcaaattcatgggctcaaagtgatcctcccaccccagtctcctgagtagctgggcatacaggcagatgccaccatgcctggctaattttctttgtttttttcagtagagacaaattctcgctgttttccaggctggtcttaacctcctgaccccaagagatcctcctgccttggcctcccaatatgccaggattacaagcatgagctactatgcccagctggtttctattttaaaatataatatgaaagtagtaaaatataaaattattacttatgtttatttgtgatacctccccccccagcttttaagcaaaaataaattattctataactaatatgcatagattacctgttcagtaaactcagttacttagaataaatccttagaatgagaaaataagcaaaacatttacagctataaaatagatatctggagctggatggtaaaacccctgtactttaatatagaggagttgtacggcccttactcttggttggttgggataatggttatagtgtgcatggcaatctggtaagccagctcatcatagaaataccaagttagaaaggaaattgtgggtcaagaatttgggtttggcataagtaccttgtttcatcatatccaagactctactatgaattataccattaatttatgtacctgtaagaaaaaatactgtcagttacattttgacatcacattaattgtgagatacattctgatttcaaagatgttaaagtgtgaaggaaaaagtaaatggtaattctggttttaaatctcagttctgtcatttatttgtttgacatgagtcagggaacttctttgagcacgtttcctcatgtgtgaaaatgggatagtatactttacctttcagaattaggaagacacaattagagatatgaaagtgtctgctgtgtggcaggcattcagtacccgctaatttggctttcgtttcttccttctaaagcttggttctcttaggatgaaagagacacttgaaagcctaacaagtaaaaacaaaaccaaactctaatgtactggctgtgtaagagcgtaaaaaggaaaatttcttgttggagctgtttaattgtcaaacattgttctttgtcttcctccattacctcacccgcctccctgttatatctgaagatatcactggctggttccaatataatgattgatatttatgttatggaacctaagcatcaaaataatattgatattttactataatggtttttaaaatacacattttaagaaaatttccaatccttctaaacttatttgtgatgcttaaagtcccactctttagttacatggaattcctgctcttctgatgatgccaaataaatacagcattattcggagtaggtgaatctttttaaaaaaggggttggatttggtgatgtttggcagaagtgagaattcctcattatattcctattttaaagatttccagtaaacccaggcggtatttttcttcagtggtaaaatatttatagctttagttttgtgtttattcttttctttcaggatttttcaagccacattcaattgataggatgaaaaaatttaagagaaggctatccctcacactccgaggaagtcagactattgatgaatcattgtctgaattggctgaacaaatgactattgaagaaaacagcagcaaggataatggtaaatatttggcatagggggagatgcttcctccttttaattactttatgaatagaatgtaaatttactttttagataagttcataatagcttccctttgtttatttctgtctcattccatggtttcttaggaaattgaagactatataacttttgtttggttactaactggaatatttccctctcactccaacattacgatacctggtctcaaaccctgatgaattgttctattccacatatccttccatttttcactagttcttaaagaagaatgcattttataatattatcttgattgttaaataactattaattttttttattcttataacccaagttaatacagcttaaaagtgcataggaagtctgtgaaatttctgtttgtggcttcatcagtttcataatgtttcatgcatttgacagtgctttttacaacataaagtagtagtatccagatgttaaaataaaaagagcttgttaagtgtgttaaatacaaaatcctggtgaaatttctagaggaaggctacatattcaaatctgaaatagccctagggatgtcatagtagtaactgggaaggaacttacgtgactggctttcagtgtgtcatgatgtgcagagtatctggcagatcttccttacctgtgcctgaaattctgctgttagagatttgtggcagtggctggaaagcatggacacccttaccccttccactagaatgcacatacttatgttttgagagaggaaaaggtatagtggagtgggctctggactttttaaagtcataggtttggattttggatacacttaaacacttcctagttgatgactggctaagccgtttattctacccaggcttcagttttcttatttcctttactcagaagggtcattatttgctcaaggttacccagctccagaaccagtactttagaacccaggtttcttcacttcagagtctataacaatgctactgttctgcaaggaccctttcattcatttgttaaggttttccttgataacatctaccttttttttttttttttgagacagtctcgctctgctgcccaggctggagtgcagtggcacaatgttggctcactgcaacctccacctcctgggttcaagtgattctcctgcctcagcctcctgagcagctgggattacaggcatgggccaccatgcccagctaagttttttattatttttagtagggatggggttggggtttcaccatgttgaccaggctagtcttgaactcctgacctcaagtgatctgcctgcctcgacctcccaaagtgctgggattacaggtgtgagccaccacgcctggccttgttttgtttttgtcatggtggggaggagagagggatgggctcagtaggaaatttaatataataatttggatataattatatgtaggaggggaaaattgtacatttgggtcaaatctcaaacatcatgattttactgttgttcctcttgccagaggacctattctagatacacagagcaaaatccttaattctcttttagaccccctcattgaatttttggtgggacccccccccattgaatttttggtgggaagcgcagtgtgcctactcttaggatagaagggtcttgccaatgtgtttgccaatgatgatcaggaataaaataaacacagtatatatcttagtggttggtttctgggacatatttttagtatttgactacaagacaatcctcttttcctaaagaaaagatatgagtcaaagaaaatgaacgtatgttttagctaatattttagaccaattgcatattttctagaatattttggtattaactatcataaaacatgctttgtttttaacaaatggtgaaagattaaaaatatttgttttctcaagttgtatatgttttttaaaacttattttattacagtagtaacttttaataggtagtaaataagggcaaataggcgatctattgagtttctccttgaccttgaagtaatacttcaagacgtcataagagacattgattcctcttgggttacaaagattgctagtagcataggctaccataatctactatgcttattttctctctgtaatagcacatggatttcaccaacagctttcacagagattctacacctttttggtcacctgtcagtgcctgatagctgattccaacacattcttttcttgtggaacatattttagagtataaaagctgttagacaggtcacatacacagacacagtccatgccagaatacagagaatatagcataatgaatgacacgtatatacttttaaagttatcttctcacatacaatgtaagcagtttatgaagcaaaagtgagctttaatgccaaatagtagcataatgctagctgaaggagtaggaggaatatacagtcatgcattgcttaacagtggggatgcattctgagagatacgttattaggccatttcatcattgtgcaaacatcagagtatatcaaaactaggtagtatagcttactacacacctagcctacatggtacaacctgttacttataggctacaaacctgtacagtgtattatggtactgaatactgtaggtagttgtaacacaatggtgtttgtgtatctaagtgtatctaaacatagaaaaggaaatgcattgtgctactatgttacagcgggtgtggcatcactggcatcactaggctataggagtttttcaggtccattataatcttatgagaccactgttgtatatgatgtctgtcattgtctgaaacgtcacatggcacataacagtagtttataatttccctgaataaactgcctttggaccaatttttgatcacttgtctcttgattagtcacaggcatgatcacagtcctattactcttgcatatctaggcacatggctctcatgcatactctagatccagaacacattaattgggggtaatactataaacatgttggagaaattatgggtatgatgcgtttggttatacttatacccataatctcactcatgcatgctctacctctatccaaatacaatagaatatcccaaatgagatattatctctcttattttgataactgagtcatatatgaaggtttttaactcagttataaatctataaatcaaattactttgtctatttatagaaactagtatgtttgcacattgacaggtgggttgaacccaaggaatgatgaatcctgaatttgtattcagtatgctaaaaaaaaaaaagttgaaagtttgcaaatttggttcatttaaggattctggccttaactcaatacacctttccctaaatatgaaataaaatttttgcagaaaaatttccaaactgaaatgtacaaaatatttttttctgtagtgcctggaagaaaaagaattttgagcccatcagttttctttttactaactgagaagtgtttaatgttcagtttttaaaaacctgtcaaggccaagcatggtaccaggcttatgcctgtaatcccagcactttggggaggccgaggtgggcagatcactggaggtaaggagttctagactagcctggccaacacggtgaaaccccgtctctactaaaaatacaaaaattaatggaatgtggtggcgcacgcctgtagtcccccacctgctcaggaggcaggagaattgcttgaacccaggaggcggaggttgcagtgagccgagatggcacccctgcattccagcctgggtaacagagctagactgcatctcaaaaacaaacaaacaaacacacctgtcaaaaattaatttacctcagttcttcaaaaagttaaacatagacttactatatgacccaacaattctgttcctaggaatataccccaaataattgaaacaggtaatcaaagtcttgtacacaaatatttatatttgtagcagcactattcacaacagctaaggtgtaaacaacccagatgcccatcaacagatgaatggataaacagaatgtggtctgtccatagaatggaatattattcaatacataaatgaatgaagagctatgtgctgtagcatagatgaactttgaaaactgaaaggagccagacccaaaatactctatgattccatttatatgaagtatccagaataggtaaatccatagagacaaaaagtagatgagtggttcccagaggctgatagggagaaaagactgaggagtgactggttattgtgtatgggatctcctttagcaatatgaaaatgttttggaacacagggaggtgatggttgtaccacattgtaagtatatgaaatgccactgaattgtatactttaaaatggttaatgttataagaatttcatctcaataaaaaattcagttcatctgagcttcagctttccctcataaacactcaatgtatttgatgtcttttttttttttgctgtcactgcagcagaacagatgtttgataagtcttaattctattttaagacttatcacagaaagttatatttcagaatcttgtgtttacatagccttgaacttattttttcttgtaatgggacgatatattgagattattgaatttgatgagaataggtgacaatttaaatgtgaggaagagaataaatcacagttgtagaaaggtaaaattatgttttattgcacatatactacttgagacttcttgaccaactgaaattcttcagctaatgtacatgttcccaagaagtgtagtcagataaacctaacagaatgtcacttatcatgattatttagcattagaagtaacaccaaaaagcaaagattaaaatgacctggttttcctgatattccaaattctcattcttaacagctccgtttgtacactggagcaatttgtcaagtttggagtcaacaaattccagttttatggatattgtgagcctctgtctttcacctaggtctctttatcttgctgatctcttacatgttagctgtgacagtttgtcttcgacagtttgtggttacatcataacagtaattgttttttacaacagtggataacatagggagtttaaggaggactaactccaacaaatagcacaagttccttgaaaggttgacgctgaaggcataaactccattggatatatgtaggatctagaatgggatcaggctagtaataatgtttgaaagagcaggtttgggaggagggaatggcttaggctacaagttgggctatgaaattgcatgttcctgatcatagttcacgtaatgaaaagatctagataaataagatgccaaataacgtttcttagtggaatcataatgattatcatgttgtggtggtaaaaatcattggaaatccttacttggaactaattatagagtataaaagatctgcaatttttcatatagatttctattactttttaaaagttatggtaaaatatatataatacaaagtttaacattttatagtatacagttcagcagcattaaatacgtgtctatttacattgcgtaaccatcactgctacccatgtctataactttttcatcatcccaaactgaaactctgtacccattaaacaatacctccacattccctcctctccccagcccctggtaaccaccattctactgtctatgaatttgcctattctaggtacctcatatgagtggaaccatataatatttgtccttttgtgtctgacttatttcccttagcatattgtcgccaaggtttccattactttttaaaatacagagtgttattatcttattgaattggccagctaattagtttcaagttctggaagtgttagaatattttattgtattttattgtggctctctcatgggccgcaatctcttctctgtctataccctctccttgggtgacctcctccaaccctacaatttcaactaccatatatatgttgactactcctaagtctgaatctccagttaggatcttcatctggatctctagattcatatttaaatgccttcttgtcttctccacatggatgtgtaatgggaatcttagacttcacatgaccaaatcagaattcttgatttcctttctccaaaatctgcctctactcaaactttgctcacttaaccagttactaaaactaaaaatctaggcattgtccccaattcttttctctcctttactttactgttgtctcctccctgcccccaacccccaccattgtagcttcctattttttaccacataaataacttacaaactcatgattatgatagtcatctgtatcagtggtccccaacctttctggcatcagggaccagttttgtggaagacagttttttcacagactgaggttgggggaatggtttcaggatgattcaagcatattatatttattttgccttttatttctattattattatattgtaatatataatgaaataattacataactcaccataatgtacaatcagtaagagccctgcccttgtcttcctacaactagatggtcccatctgaaggtgatgggagacagtgacagattatcaggcgttagattatcataaggagcatgcaacctagatccctcgcatgcacagttcacaacagcgttagtactcctatgagaatcagtgccaccactgatctgacaggaggtggagctcaagcagtaatgtgagcaatggggagtggctgtaaatacagatgaagctttgctcacttgccaactgctcacctcttggcctggttcctaacaggccatggaccagtactggtctgtgacccaggagttggggacccctgatcaatgtgactgatacacaattccagttatagtccattaacacatcatatttcatatatgtttaacagttgatctggtaaagatttaaaaatattttggggctaggcatggtggctcattgtaatcccagtgctttgggaggctgaggtgaggaggatcacttgagcccaggagtttgagactagctgggaaacatagcaaaaccccatctctaccaaaaagacacaaattagccaggtgtgatggtgtgtgcctgtagtcccagctatggtggggaggatgaagtgggaggaccacatgagcccaggtggttgaggctgcagtgagctgtgactgcaccactgcacttcagcctgtgcaacagagcaagaccctgcctggaaaaaaagaaaaaaaaaatatttgaatagatgtttttactataaatgctgactaaaagctgggtggtaggagtgtgtgtgaaactaatttagcagtcgtgtctgctggcctgttgcttctgcctttgtaatatgtcctaaatctgcctgcttccctccatcttcagtacagccaccctagtctaagccaccaacatttgttacttagggtactgtagtaatctcctccttttgctgttgattccctattgcctgtttttcaaacagcaaccaagatgatatcttaaaaaattattttcagtaattacaaatataaaggaagttacaaagattatatagaaaggacccatacttgtacccttctcccaatccccccaccattggttccatcttatgtaactatagaacccaggaaatagatactggaataaagtctaaatatagttctgtgtcatgtcctcacctgtgttgattcgtataaccactgcaatcaagattaagaactgtttcatcatgacaatagatctctcgtgttaccttttgtagtcttccctacccccttacctcctactatctttaacccttcacagtgatatttttgaaacatgaatcagatcatatcactctcctgcttcaaagctaccgtaactgcttccaatctgagaataaaattcaaacttttatggtgaagtataaagtgttgaatgacttgttccctccttacctctgtggtctcacctggtaccactgttgcccgcacggttaggtactatagctacacttgccttctttctagtcctctaacacagtggttctcaaagtgtgatccctggaccagcaatgtcagcaggacctgggaatttgttagaaacacatatttttagattccacaccagacctactgaaccaggaagtctgtgggtgagaccgagcaatctcatgttttacagatccttgatgattctgaagcatgttaaagtttgaggaccactgttctaacaagtcgaactctgccatatgtcggcttttcattagcttttttctctatctggaatatcctgttatccacaacttaaccatcttccctgactggctctttcttgcatttaaatttctgttaaaaatatctcagcagagagaactttcctcaatatacagtgtaaaataactagctactcatttccacatccctctattttagtcttttgcatatcgcctgtcattacctgacttcgtgtgtgtgtcttttccctgttaggttttatgcactctgagatcagtactttgttttgttcaccagttgatgcccagtgcctagaatagtgtttatcaaatagtatgtccttatgatccccattttttttctatattctccagaacaatcaagctgtattctccaggacagctttacagagcaactaaaatgttgtctgtaggcaaaagatttgcataatttgtttttaatatttgaatgttgtgatatttcacatgtgaaataacctagaaagagaaaaaaatcttcatttttcttttctctttcttgagacagggtattactttgccacccaggctggaatgcagtggcattatcttagctcactgcagccgcaaactcctgggcacaagtgatcctcccactctagcctcctgagtagctgggactacaggtgcatgccatcatgcttggctgagaaaaatcttattgtatgctgtagcctgtattatcccacattgtttgtaattatttatgcatttatatcagatagcccctcttcattcattattaaatcattgattattttgcttcacttaagatccccaaattctttatcagttaggtactgccagggaatgtacagatcacaggaaactttagacacatgttctgtattactaggtaggcatttgcccctacctccagtctgtctttgacccagattagatagcttggaccttgggtgagcctttgggcccttatgccccatccttcttatacccttttaggcaaccagtattcgtagaggctcaggccacatggccttcttggcccatttctctggagcccataccctggtcctgttctgcggatcctaagattttcttgtgagagaagcctttcactttaaggcttgtagccaactcctgtcaacctgtccttagttgagaaaccttagttgagaaacaggtagaggaatcccctgatcaggaggtatccttatgcctgattgttaactgcagaagaatagttggcttcattttaaaaaggaatcccctgatcaggaggtatccttatgcctgattgttagctacagaagaatagttggcttcattttaaaaagaaggtattcagagcagcccagttctttttaaaactccttggctgctatcagtaaaaacaaaattctaatatagaagactaattgtgtatcacaagacttgtatctttaacctgtatcagagctcttctttggaggtggaaaggagtcaagagattcctgataaacattacaaaacagtttctcccccatgcataattaaatagcttttaagtattatatttttttaatgtttctgcttggttatgggtctgtgattgtttaaaaactctttatattaatcccaaattcaggggaataaacttggagcctctgtattgatatgtatttaggtacttcggttttattcactaattgacataccattttgaatgtccagcaaacagggatgtaaattcctttaggccgggaccatgtcttttatattctaaagcatgcttaatttctttttttttttctttttgagacggagtcttgctctgtcgcttaggatggagtgcagtggcgtgatcttggctcactgcaacctctgcaacccgggttcaagcagttctcctgtctcagcctcttgagtagctgggactacaggcgcatgccaccatgcccagctagtttttgtgtttttagtagagatggagtttcaccatattgatcagactggtctcaaactcctgacctcaggtgatccgcctgcctcggcctcccaaagtgctgggattacaggtgtgagccatgcacccagccaagcatgcttaaaataaggcacacaggtagtcaataaatggaggagtggtatggaaacaatcttgagatacactaaaataaacaaatggatgaaaatttggttgggtatattagtagttttgtggttcttagccacttttgattatataagaaatagatggttattagaccaacttaaaatattcaagtattttcttaagtattttttcagagaaactattttaattttaatactgtgtatagttaagcaaagcaatgaggctaaatgtactaatctctgttacaactttttgttttgctttctgaatccttctcatgtgatcctggatcttggactgatgatggaatgattttcgaattctatgaaccacagagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattaggtaatttgattacttgtctgttgtgtttacctttctgattatacgtcatgcacatagttaagttttaattaagcaacttttattatctcgtttcttctgtcagataaaaatcaagttgagatcaagaggaatagcagaaggatggaaagttctagagaggtagtagtgctgacaatacagggaagtaatatttgaaaaacctgtccatcaggagggaaatgaaacccataataaatggatgcagtatttcaagatgaatggcagtttgggatggtgtttattttagggtaatgcctcagtaacttttcagatcatcaccatataaagcctattgtaatgaatagtatatgtggttatcacctgaattgtttcttcttctgtcattatgtctttaaatatccaagaaaaaagaattgcaagtttctgtttattcctctggccttttttgatgatgccttatgtttttatttttatttttattttttttgagacagtgtctcactctgtcacccaggctggaggggaatgcagtggtgctattgaagctcactgcagccctgacctcccaggctcaaatgatcctcccacctcagcctcctgagtagctggaactacctgtgcatgccgctacgcctggctaatttgtttgtttgtttgtttttgttttttttttttttttagaagacggggtctcactgtgttgcccaggctggtcttgaactcctggactcaagtgatccacttgcctcagcctcccagagggctgggattacaggcatgagccaccacacctggcctattatgttttgatttttaaaatcacttcaagtacaactattttatagtcttcttagataattatatttactgaagctcctaggggttttattctactgctcgttttatgtgcttactcttggaatagtatattatttccaaatgtgtttctttaattttgggagtatgagcttatctacagtgagattttttctgtgagaactgcatatagcctttatctctgtaggtgtgtctctacagaatggtatgctggagttggctcacactagttcataagagatgattgttaaagtttcaggaactttgcaaactggttgttaaacatagctattaaattttaaattatataagtttacaaataggtaaactaaattaaaaacaaaggtaatgaatatgcaaaagtcattgcttcctaattttttaccacttttaactattatctatgccaccggcgttatttttttctgttctagttatagtcaaaaacactatataatggtatgctactgcacatttcttcccaaccatatgttcagtgttgtcatgttggtagcctgaagttgtccatggagagagaagtcagaaaacactacagatcaggccctggcttattgttttcttgtttgtctagaccagggtttgttttttttttttttgtaagggggcagttagtaataaatattttaggttttatgggcatacagtctccattgcatattcttctctgtttaataatcctttaaaaatacaaaaaacatttttagctcatgggccatataaaaagaagccacacttgttctagacccttgttctagaactaagacagtgtattgaaaatgttagtaacgcagattaaatttaaagggtattgtgctggaggagaaaagtatgttgtatctgccgctgttacattacctgatcagcagagagatatccctcttccccccttgacagatgagtaaagttctgacaagccatcattgtttcacgtttgtcttgatggaaatgaaaataccgactggtagtcatgtcagaactacacttgtttgttaatgacgtgagtaatttcttgtttgggtcagatggtactcaagtatttattcatagtctgagattagtaagctttctttgtcgtccaattccttgtgcaacaggacagatttttttttaagtgtgaattttttttttttattatactttaagttttagggtacatgtgcacattgtgcaggttagttacatatgtatacatgtgccatgctggtgcgctgcacccactaactcgtcatctagccttaggtatatctcccaatgctatccctcccccctcaccccacccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggacatgaactcatcaatttttatggctgcatagtattccatggtgtatatgtgccacattttcttaatccagtctatcattgttggacattctgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatgggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgcggtgttatttctgaaggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagtttttcccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtacaatgtataagatttttgtacattgattttgtatcctgagactttgctgaagttgcttatcagcttaaggagattttgggctgagacgatggggttttctagataatcatgtcgtctgcaaacagggacaatttgacttcctcttttcctaattgaataccctttatttccttctcctgcctgattgccctggccagaacttccaacactatgttgaataggagcggtgagagaaggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttgttgatttgcgtatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcaggcctccttgagctgtggtgggctccacccagttcgagcttcccggctgctttgtttacctaagcaagcctgggcaatggcgggcgcccctcccccagcctcgctgccgccttgcggtttgatctcagactgctgtgctagcaatcagcaagactccgtgggcgtaggaccctccgagccaggtgtggtatatagtctcgtggtgcgccgttttttaagccggtctgacaagcgcaatattcgggtgggagtgacccgattttccaggtgcgtccgtcacccctttctttgactcggaaagagaactccctgaccccttgcgcttcccaggtgaggcaatgcctcgccctgcttcggctagtgcacggtgcgcacacacactggcctgcgcccactgtctggcactccctaatgagatgaacccggtacctcagatggaaatgcagaaatcacccgtcttctgcgtcgctcacgctgggagctgtagaccggagctgttcctattcggccatcttggctcctccctctgattttttttttaaatgtaccctgtaagtctcaaaagtgtagcactttgggagttgagcctttctgtgggaaggtctcacttgtaactcagaaacccagggcttcattttttatcccaatgtggaaggtaaacccagggaccttctcatcaacatcagcagcctctcctaagacactgatagagtcaatttatgtataacagctttgggttttcagtcctctctttgtttttgcttcctaggtattaccaatacattcttgcacatttagctgtgcattttaaaatattgtattttagtcaacattttcttgaggaaagggagattttcatatctcactagaaatggaagccatgattaaattatttttaacattttgaaggtgtgacagaaatgaatacaggaccttagatgtgttatataccaaattttaagaggttaggaatcaatcaccaatacattacttttgctgccaaattaattttttgttcacatatcaccataaaatttctatggaaatctcaacataactgaagtgtattcttagattacatattgagctattaaaaatccattaccatttgcaactgcttatgaatattaattggagttttcttaatattgagttaaccaagacaaaaatacagacataaagtgagttttaagatagagttgatataagacccttgagttcaaatttctccttaatctaagcagtcctcatgattttatatgtaaatattattaaaagttaacatttatacttataaaatacaattgtctcacacattgatattttatataactttatttgaaaaagagatctagttatctaggccattccttgattgttagttaatatgcagttcccttgaatacttgttaagcaccttctgagtgccagacagttggttaagttctggaaatagaaaagtgaacaagctaaatcccatccccaaggatcttataaaatcacatgcaccaaaaaatgttcttcagtgcagtgggtgggggcacagtagtcaactgtgtctgagattagaaaagacttcactgagtgatgacacatgagcatagtttgaagactaagcctgatctcacaaagttgataaaataggaaaaggcatcttttaaaaacgagaaaaaaagtgtgttaaagcactgcagcatgaaacaacatgcttctttctggaaaatgaatacgtgtatagaaagtaatagtggcaagagaggagttctagagatccagcatttgtttcctagtacactcttcttgctgggttattagataatgactgacaaatgcaggtatatgagtatacaacttggccagatgtggtggctcatgcctgtaatcccatcactttgagaggccaaggtgggtggattcctgaagttgcagttttttgaatttttgcaatcagaccttggtgatgaccttgagcagtaggatataagtagctcccacatgcttagcttccaataatggaacactaggcataaatggctacaagttcaagatgagcctgaacaacaaggcaaaaccttgtctctacaaaaaaaataaaataaaataaaacaaaacaaaacaccagatgtgatgggtgcctgtactcccagctacttgggaggcaggaggattgcttgagcctgggaagtagaggctgcagtgagccatggttgtgtcactgcactccagcttggccaacagagcaagaccttgtctcaaaaacaaaacagtatatgtctgtttttaatattttcaaatggaatttatcttcctccccctacttccatttaacttttatctctattaagcatgccataacccaccttttttgtagtatgtttttgctctgaacagatttttgagtatttgaagatcataaacttgtttttgtagttctggtacaaaatagatattcagtgaataattttttattgttttatttttaacattgggggtgcagggaggagaaactgcattagaagcttttaagaggtgttttaaagaatattccaagaattagctccatttaaccatagacccagtgacacattatttaattgaaagaatactaaataagaggcagatgaccaggtgtctattccagctctgcatctaagctttgtgaacttttgaaagtcatttaacctttcaagtctcagttcccagatctagaaaatgaaagaactggctcattctcagagatattatttccagtttataattttattactcaacccttgataataacttgaatgttaatttttttcataatttgaaagtgtaaaaagatttcatactattttaagacatttgagtcatgttttcatctattaactgcatacctgtggcacccagaatgtaaatgactttttatgctgtgatttttactcgttggccttctatattttacccatagtgataataaattatatattagaatataatgtatctcttttaatgtctcattttttgatatagatattgttcatgaaaatctaaaaatgggatcagatggtgagagtgaccaagcttctgggacatcatctgatgaagtccagtcacctacaggtgtttgtctcagaaatcgtatacatagacggatctcaatggaggtaatcatttaaaaaatacaaatatacttgtgaatatgtgtgttggtatatgttaatacacatacatatcaagtggagtaaatgcccatttaaaaattttcatgaagacacgtgacacttgtaagaaagttacttctttgcattcataaattgcagtctgtgaatatttcctcttttttaatttttatcccaatgtagatatgtaatatagttgttcgcattctgtgaaacattttattttaattttttgcgaaacgttattttaggttatccattaaggagaagtgaattttcaaaaattctggaaatacagaatgatacattagcaatgtcttctttttagaaaatacgattttaatgatatttttgagattcatctggataattagcattttattttctctgtttcaaattttaagaggtataaataaacagcttttttttcttgcattatattataaaagtgggtgtcctttcctttgtggttcactgtacctactgatctctgaagcacatttatttctccgtgtaaaaggatgaagaattcattttcttttctttgtaagtgttgtggtataaccttgaggacataagttgatcgtgactgttatttcagtacgtactgtaaactaaaataggtttctgcaaaaaaaaattgaacatgttttgaaatgaaagtattgttgcttttttggtgctgttgagatgatgattaaggtatctctcctattggttgattatattttcattataaaaggattcttcttaatcagttaaggaaatcttatcagttttctaaatgataaattaacattttcacttgttgaaatcaacgatatatttatgtgacacaatactaatgaaaatatttcttatttttcttcaccttatagatgattttttaaaatcatttgttttatttagtattagggtctgtatctggagtttctcattcttcgttgagctataatttgtttccccaccaccaaggaggcatgctctagattatattctttttatagtatatatttttttctggtttatgagacagggcctcactctgtcacccagactggagtacagtggtgggatctcagctcaccacagcctcaacctcctgggctcaagtgatcctcctgccttagccccaagtagctgggactacaggcacacaccaccatgcccggctaatttttttgtattttttgtagagacagggtttcaccatattggcttcccaaagtgctaggattacaggcttgagccactgcgcctgacctgtagtatattttaatatctggaaagactcctttctgtatccctcccccatatacacatatactctttcttattttagaatgtttttggattttttctgtttattctattgatacattttaggcattttattttgttctaagaataagcttattgtgatttcttagtggttatataacttataaaattaatatagggaggaccagtatcttctccttacttattcttaccatttggtggcattgtatgtttttatacttaagtcttatatttctcagtaaatatttatgcagttcctatacctctccattccgtttcatggtttggctgctgttatgaatgggaggaatttctttttatagggcttaaatttcttgatacaatgatataggcaagattcttttcaagtttatcccagctcacattgtataattaaataaagtagaaatgccattaacatggcagtaataaatacaattctctttccccatgttgcatacaagatcatataatgtctacttggttagttatttaaactgatcacagagtttgtggtagtgtttgcctaatgttactatatggtataataaatttaaagtaaatttcaagttgaatttaccagtgaaaggactcaaaaattactgaggttgcaaaatttcatttctgtaacacttcgctgtatacttttgcttacagtaaatgtttttgccatgagtatattacatataatcaatgtaggtaactttgcaactgcaataaaactttacaattacttatcactaagaaataatatgttagagcctgtgaatacaaaagccaaatgccttgcctttactattttggattacctttttttttttttaaggatttaaataagcggttatcactgcctgcagacatcagaatacctgatggatatcttgaaaagttgcagataaacagtccaccatttgaccaaccaatgagtcgaaggtctcgtagagcttccttagtaagtttttggtctcctatacctccaccatcaatcagatctgcttgtttgctgcttctgggtgtaaacattttaaattaatttttatacttgactttagaatagctaaattttattatattgccttctcgatttttattattttccattcttaaaggtttattggagtccttaagatgcattcaataggatgcatattggaataggatttaaggtatattttatttttggtaaatgttattaatacatgctaggtagataaatacatactagatatatagatacactagatatgtgctggataaataaacatgtattaatatatactagatatacagagaagtacacaaaccataattgtacagctcaacgaacttttgaaatgttaatatacctgtgtaaccagtacctggatcagtaaaagaaaatttcagaaatcccagaaacccccttctgttccctttctctttacttagtattcctcacttcctcaactgtagccatactctctgccttctgatgctaaagattagttttacccatatgtgtgacattgttctgatcatactgtttttatagtatgttttggtatctggatcttctaaaatcccattcacatatattcttatttgttttttaaatgtgtaatattctctttctgattatccttattaaaacgtctgagctttgtgtaattatgaatatgtaattatattaaaatatattttatgtagatatacagaattatatacttatacaaagtttgtatatatatattgcacaatatgtatcccagtatgtatggaagttatacagtatgtattatttttgttgttagcttcttttgttcagtgttatgtttgtgagtttcagccctatttttgcatgtaattatagataattcgttttcattgttgcatggtattccatttatgagtgtactgtacttcatccattctcctatcgatgggcattctggttgttttcggtttttggctattaccaaataatgcttctatcaccattcctgtgcatgttttttggttaacatgtaagcatttctgttgagtgcttacctaggagtggaattgttgcattatattctgcttccctagatactgtcaacagctttccagagtggttgtaccaacttatacgtatatcactagcatataatagttctggttgttctccttgccaacttttgataatgtcttttaaaaattattattttaagttttctagcaagttgatagtggtctcttggttttattttgcatttctctgatgactaagttgaacacctttctgtgtgtttattattcatcgtatgtttattgtatgtttatatttagatactctcttttgtgaattaactacccaagtctgtttttcttcttttttctattgggttttctgtcttttttattggtttatacgaatttttaagtatactttatatacaggacctttgtcagttacatgtcttacaaatatattttcttaatatttagtaattaacccagcaccatttattcaaaggataacttttcttattgcagtatcactttaatgtaaattcaggtgattgtttatgtgagaatctcttttggatgactatagtcctgtagtagagatacatataaagtgctttgggacaacaaaagaggcagcaagtaaaatgccttggcaaatcacaagcttacagagatagcacttgagctggtcctagaaggatgggcagaaatttgtcagttaaaaacggcctatgaatgaagggtgttgtaagaagaggaaacttcatgtactaaaactaaaacccagaggtttgggtgtagatgtcatgtttgggaaatcagaactgatatgaagggtaatatggaataatataaaagctatggcttgaacggacaggacagatccagaatgaaaagccttagaggtcaggccaagaagtctggacttcttcccatgtaatgagaagacatcaaaggtatttatttaaacaaaggctgacatggtcacatttttgtttcatagcaatagctttaggaaaagtacaaacaatgaattagagagaaagactagaggcagggagaattaggaatgtattcaaaattaaggatgatgtggcaatcagatggaaatagaaagcagaacataaatcctagggaccaggaagggataaaataccacctaatacccacttggactttgcacctgaaggaagagaaattgatgatgactcttggattgctagcagttgttgtatctccttttttacattattattattattattattattattattattatttttggagacggagtcctgctctgtcacccaagctggagtgtagtggtgcaattttggctcactgcagtctgcctccccgggttcaagcgattctctggcctcagcctcccgagtagctgggattataggtatgcgccaccatgtcctgctaatttttgtatttttagtagagatgtgatttcaccatgttggccaggctggtcttgaatgcctgacctcaggtgatccacccgcctcggcctcccaacgtgctgggattacaggggtgagccactgcatccagcctttacatattattatataatggaactattttctttagagacaaggtctcactctgtcacctaggctggaatgcagtagcacgatcatagctcactgtaatcttgaactcctgggcccaagcaatcctcacatgtcaggctcctgagtagctaagactgcaggtgtacaccatcacacccagctaattaaaaaactttttttttttttttttttttttagagatggcatctcactgtgttgcccatgctggtttcaaatgcctgggctcaagcggtccttctgcattggtttcccgaagtgctaggattataggtgtgagccgcccatagcatctggcccctgtgggccagattagatattctagttagatagtctacaaaatattttggtgacatactctaaaaaataaaatcactttatgctgtatataccatgagcacattgttatttgacattcaccagtatataaatatggtaaaaagtataacacaaacttgattttggtataagcatatgattatcataatttagcatcactgcttaagacattttttgtgtgtgtgtgtgtctgtgtgtgtgagacagagtgtcactttgtcgtccaggcaggagtacaatggcgcgatctcggctcgttgcaacctctgcctctggttcaagtgattctcatgcctcagcctccttagtagctgagattacaggcatgtgccaccatgcctggctaatttttgcatttttagtagagatggggttttgccgtgttggccaagctggtcttgaattcctgacctcaagtgatccacctgcctcagcctcccacagtgttgggattacaggcataagccactgtgcctggccaagacatttttattgggatgattttgccatttgattgtcaagtcaaaagttttcttcggctatcagtttttatcaaagattggtacttaggataaattttgaggttgtatttgttccaattgggagtaaaaatgtgatttaatcaccatgtaatttttttaagctatcatttaggagctatcttttacagtctacatgatattaagaaaaacagtgccctctaatgaatgctaagtgattaaagtttttatttatggttaagtgttcctacctacctcccccgctttttttttgagacagagtttcacttttgttgcccaggctggagtgcaatggcatgatctcgggtcaccgcaaccttcgcctcccgggttcaagcgattctcctgcttcagcctcccgagtagctgggattacaggcatgcgccaccacacccggctaattttgtatttttagtagagatggggtttctccatgttggtcaggctggtcttgaactccccatctcaggtgatcctcctgccacagcctcccaaagtgctgggattacaggcgtgagcccctgcgcctggcctgcctacttcccttttcagaaaattctgaaatggcttatagatttcagataaatcatgccagctatgttttggattttactgatgcatccatttcattattcatctaccttagtaaagcatactttttggaaatacattaaaaattattcttcaaaatgaaaatctctaccctaggtttatatttgaacatagtcagtgaagggagggcatgtgaaagttagggatggatggaaaaggagtgggaaaaagaaactcatttttttatatgtattagaatttgtgtatctgtggataatatattctttatatacctaaaaagtaaaagttttttcaaagagatcagttcttcagcatagaagtctggacccttggtttatgtgtaaaggagatgggtaaagattagggatggatagaaaggaggtaggaaaagaaaaatattcttcacatgtactagacttcatttttccatggataatatacccttaatctaaaaaataaaatattttttaaggtaaaatgtaaaatttagccttgtcttctaaaagttttaaactttcaatgtgttgttctcatatatatatataatttttttttttgtacaaattatttgtagagacagggtcatactatattatccaggcttgtcttgaactcctggcctcaagcagtcctcccgctttggcctccaaaatcactgacattacaggtgtaagctacctctcctggcctattttcatattttctaatggcaatatataatgagtagtaaaaataacataaaacctttgcttgagtaggaattaagaaacaattcatttttcctggagaaagttatacagtagggctgaatgggtctaatataaatttatggtcatcaatctcgcatagatccccagtgttgtctggctatcccactgtctttctctgattaactcttcctctcttactgtaagcagatgatctctcttcctatatcataaaaaagagagagggccagatgttgtggctcatgcctgtaatcccaccactttgagaggctgaggcaggaggtttgcttgagcccaggagtccaagaccagcctgggcaacatagtgagacctccatctttacaaaaaattaacaaaactagccaggcgtggtggcacacctttgtagtcccagctactcagtaggtaggaggtgagaagatcacttgagcccaagaggatgaggttgtggtgagccatgattgcaccactgcactccagccttgtcgacagagcaagagaccctgtctcaaaaaaaaagggggtggccattaaccgaaaactccctccttttctgtataacaaacttgcaaatctacctatgcatatacccattctgttcttttttgtttttaatcttgagaagttgtcccccttactatcccatcttttcaggatgcttaagactatctgttatccctataaactgatgtgtgttcagtctcccatttcttaccttaatcctttccagtgactttttatttacataaacataattttagttttagatttacagaaaaaattacaaaaattatatagttcttctataccacatacccagttaccatattattaacattttatattactttaatacatttgtcacaactaaggaaccaacattggtacattactagtaacaaaactccatactttattcagatttcactaattttttgtcagtgttgtttttctgtcccgatactccctccaggataccacattacatttagtgatcatatgtcatgttaaaaatattggctattggatggtgacgtgctatttagtagtcctttatgattgataagaaataaaacattgtcaacatatttagttaaatattagaatagtggcaaagcctatatgtagatagtcaggattcatcagagcttccttgcccttacgataatggtatacccagtggaagttttgtgagactgagtgcagcttcaattataatggaggtcatccatatataaaaatttgtcttattgtattcaaattataggtttatacattttaagagcatatgccttcctaaacaatgaatgtttggattcttcattcctggttttaccaatagactatatagacctttcttaattctcagagcaggtgagaaaatacaatcaagtccttacatctctcagcaattagaaatataagatggaatgtgggagtgaggttcaaagtcccacagaatttacctttagcatattatgtacaggagtacaggattaaggtggtattgtggtgatgataatagcaatttttgtaagacaaagtgactgagtagaatagagattctcagtctttccccctgcccaccaagtctaagggataaaacacatttctttcgttaacagtaactcggtaattcccacagagagggaaatgaatgtttgaaaaagcctccctcttcccctgctgtttcttttttgttgttgttttttgagacagagtcttgctctgtcgccaggctggagtgcagtggcacgatcttggctcactgcaatctccgcctcctgggttcaagcgattcttctgcctcagcctcccgagtagctgggattataggtatgcaccaccacacccagctaatttttgtatttttagtagagacagggtttcactatgttggccaggatggtcttgatctcctgacctcatgatccgcccttctcggcctccgaaagtgctgggattacaggcatgagccaccgtgcccggccccgtttcttatgtattaatatatactcactcttaaaatgtcatctatggatcctctgtacatacagaagcttccccctttatctgtggtttcattttccacaatttcagttatgtgaggtcaaacatagtctgaggataggtgaatacaatgccagtatgattattttgagagcaagagatagagactgcattcacgtaacttttattacagtgtattattatggttatttgttttattagttgatctcttactctgcaaaatttataaattaaactttatcttaggagtgtatttaatatgtatagggaaaaacctagtacatacaggtttcagtgctgtctgctgtttcaggcatccactggtgttcttagaagtatcccctgtggataagggggacctctggtgcttcatttgttttgaagctcagctagcacagcatctccagcctgtgatagagtaattatgttgctagatccaaagtaaacaaaaagtttcccataaggcttggtattgcttacaagttacagtgaattctaggaagactattataaattataatttaatttatatatatatttagaattttcatgtgtttatactctaagagccatctgaataggaatttgcttggggctgtcaaaaagtgaagtattttcttggaacagtgaaatatcagaaaaaattatcttcatttgtctggaaagcagcattaagggggctcttatattacatgaaaatataagctttgagcagtgatagtatcatacccgaggtttatccaaggcacagttattgctaattgaaaatttttcccaaatacccccaccatgacaacttgtgattatagttggcattggcaatttttgagtttctgcagagactggaacaacaacatacacattataaagcttattgtgctatttctttagctattatttctgtttctgtgaaacttttaaaatattctaaaataatctaggatggaactcaggctagattgtgaactcatgaaagtgggaatcatgtctgtcttctctagcacctaacattgtgctgggtaaatgttgaataaatgagctttgtcctctgtcctctgaataatttctgtaggagagcacgtcaacaagctagtcattatatctattgttaatcttgttgtgttcagcaaataaaaatgcaagcaaaattttctaaaaattttatttaaagattcagtaagtactgttttgatgtaatcattaaatcctaagttggaaattactaaattgggggctaagcttttactttttgaattaggatctgacagacaattcactagtgtaattgtgcctttgtctgaattctctgcctgcctgcctgcctgcatgggtggaattcagtagtgttgtttattttatagactgattattcaaatttaaacttaacctcttacatatttgtctttacagtctaatttgtagtccatttacatagtctttaaagcaaacctcgacattttgtcatagtaaccattggaccctagtgtatttgatgttttaagaacatagtagtattcattcatttaagataaaaggattaataagaaaatttctctactcctgagaagaaaaaatgcctagcttacagtcttatttcccgtgtgcttctcattgttataatgacattttaaatatttttttcaggaacattcattcttttgttcatactagtttgcatttattctcaatatagtgttttttcccccataaaagatgacacaaaacttaaaattcatggcaaaaatgcggtagttccatattcatgaatttaagcacctaaattccagagataagtatcagaataaagatattttattagtttctgtgatcttggcaagtagccttttttatggagtaaagtatttaagatcatatataaataggctatataaaacatatataaattaaaagattattcgtaatcagactgtcatgtaccagatagtgggctatttgccatgtttttcatactgattttaaaaacttcacttgtattttaacaatgttatctattgtagttttacttctttattttgcatagttattgatactagaaagcgaaggacttaatactgagtcatgttcaagacaatacatggatgaatagtgtatgatggtcgtaaaacttcatttttaaaatttaatgttttatgaaaaacgtcataggaaaatgtcatagaatgcaaaaataatttttcattcattcaataatacctgtgaccaaagttttaattagtttactaaaattgaattaagtactattggacgtgcagttttccacatggcttttaatatgatacatatcattgtaacaaaaagataaaaacagttattttgaggggcctctgctacttttggccattcagctttggataatttatcctattgtctgaaatggtaagtgatgcaagtctaattaccaaggattattttaattttattccacagttccaaggaaaattgcgtatttagacctctagagtttgactaaatcacaacgtttaatcatctggcataatttatacacctttgagaactgagattatgtattaaaaaacattatttcctttaactggctttttatttaagggcattagcaccattctaagcaagtggatctttctttagattatcattaccttttccattatctataaaggggtactagaaagcaactttaagaaaattcttttcccattctgttttactttttaaaatatttctgctctctcagtccctagttttcaatctatctaaaaacaaattttcctaaattttgtgttaaggttttttctttttcattttaaatattgtgtttgtattacatatttaggtatatttcatgtaccctgtttatcatctccatacacaatagtcaggcgagctcaagttttaaaagcaaggcttttaagaactcacttttaaagcattttctcttgttgttgtgggtttgtttgttttttttttttttttttttggccgagtgttgagggggggtgtagccagaattagacttacattgctgcttctatgtttgccacttcctgatccatagaagagcatgattttcagttgtctttttcattgtattttgattggaaagcctgaaacaaatagtattttgttgtttgcaggacttccttgggaattcagattggtgagggagaaaatacataggaaaattatttattttgcaattttgttaaaaagaaaatcccaagtagttatccttgataagattctttagtatcttaaaatgcctgtggtatcttagaataaaaccaaatatttttcatgacagaatgttaactgtgtatatataaaggttgggttgacaattttgattgtgaactttgatatttttgaacctttgaatgttccaacattgggtttattttaaaacttgatagatattcaaccatttgattataatcagatttttctattcttagtcattctttagagtgggaaagtttcagaagttgaggaagagatgaattgaaactttaagaatatatacaaggctgggcgcggtggcttacgcctgtaatcccagcactttggaaggccaaggcaggcagatcacttgaggtcaggagttcgagaacagcctggccaatgtgttgaaaccctgtctctgctaaaaatgcaaaaatttgccgggcttggtgctgcgtgcctgtaatcccagctgctccggaggctgaggcaggagaatcacttgaacccgcgaggtggaggttgcagtaagccaagattgtgccgctgcactccagcctgggcaacagagtgagacgatgctgtctcaaaaaaaaaaaaaaaaagtaaatactaaatttttcattgtttacttttcagtcagaaattggctttggaaaaatggaaacctacatcaaattggaaaagcttggagaggtaagtaaatatctcaaaaatgtaagacacatttttttcttattcgtcattcaaactctgttactccacggtttttgttaacctggaaaaaacgtaagtactgatgtctacaagattatatacttgttctggaaaggtaacagagtttctaggagttagagtcttcaattcttgaaattatcccatcagtttgagaggaaatgaattttttttatagctttgaaatttttattgaagcagaaagtattatgttttcttaataacaaagtaggcatttgtcacttagtctactgccagtctactgtctgtgccaccatgggaaattgcatgagttcagacctgtgaaaaatcagaataaagataaaaacacattttttgaaggttacggaaattcttaagatcttggttttcttgaacttactactagtactactgatttagaaatggcctacctcctatagtaggaaagggcaaagaaaacaatagttaatagggaaggcttaaaggagcttgagggctgtcctggcaataatagaagagatccttgttttttaaaggagagttaatgtacaaagattctgaaaagtctagaaacatgggtaaaatttttatgattgccgggcgcggtggctcacgcctgtaatcccagcattttgggaggccaaggcgggtgaatcacgaggtcaggagttcgagaccagcctggccaacatggtgaaaccccgtctgtactgaaaacacaaaaattagctgggcgtggtggcgggcgcctgtaatcccagctactcgggaggctgagtcaggagaatcgcttggaaccggaaggtggaggttacagcaagccaagattgtgccactgcactctagcctgggcgaaagaatgaaactccatctcaaaaaaaaaaaaaaaaaatttatcatttaacaatatgtacattatgttttcatttttcaattaatatgttcaattagtgtccatcagtctccatataccattgcaggtaaagcacctttgattttaaagctattgatctaattgttaatctaaaataaggtacaaaaagtaaatattctgtctatgtttttatactcttgaggcactctgtagtgttacagaagtatggaagctgtgcatatgaactgaaagtcctgtttactgtaagaaaagccatggctgatcattgtgtgtttttctttgcaagatggaacttaacaatgcttagaaactagaaattcaggtagagctctttattataagatggtattaaatagactcttatgatacttttgatgcgtcctttaaaaatatattttatagggtacatatgcaacagtatataaaggaagaagtaaattgacagagaatttggtggcattaaaagagatccgattggaacatgaagaaggtgcaccctgcacagctataagagaaggtataataattatacagaacattttaaaatcaaagtggtggaataagtgtctattttttataagtaaaaagagctcagatatacaagtaataaatgactggaagatgtaattaaacctttaaaaagcaaatttctaaaacaaatactcaaagggattaattatattagtgtataacttataatgaaatctgaattcattaaaaatcactatcatagacaactatttgtcatagggaaatgttatacattggtacatgaggaacatggtaactataaattaaccagataaactaaataaattaaaaaacagtgtgtaaacatatttatatcatagtaccattttataaagaagattattcagaaaatggcttgaggcaactgattagtaatgtggaggggaaaaatggttccttgtaatttatatctaaattaatgccagaagtttcaaaagttaacatttaggaaaaatacagaagatgatatggagaatgttataatattggggacaattttaagtattataatatcaaacccagtagtataaaagaaaaaattgatttccatgaacttttttttttttttgagagggagtctggctctgttgcccaggctggagtgcagtggcgagatcttggctcactgcaagctccgcctcctgggttcacgccattctcctgccttagcctcccgagtagctggaactacaggcgtccgccatcacgcccggctaacttttttttgtattttttagtagagacggggtttcaccatgttagccaggcgatctcctgacctcacgatccgcccgccttggccttccaaagtgctgggattacaggcatgagccaccgtgcccagcctccatgaacatttttacaaccaatccccttggtaaattattgctttaaacttaagagaatcttttttttttttttttaaatagcattgttgcccaggctggtcttgaactcctgggctcaagtgatccgcctgcctcggtctctcaaaagtgctgggattataggggtgagccaccgcccaagacctaaacttaagagaatcttttaatcagttcgtatgttcaacttacttcaggtttttataaagactgccacagactaaacaattttctttttctgttttgcagtttcactattaaaggatttaaaacatgcaaatatagtaaccttacatgacattgttcacacagataaatccttgactttggtgtttgagtatctggtaagcatctcataaaaattcagtatttaactttactttagaaaaacatagtaaattggacttttagtttgttttttatttttctttaaactgcagctgtgcttagctaaattggactttttaacagcccaagagactttattatttagttatcagtttttcattaaattatgtgtatggtgcatccagtatcttttcttgaaaaacaactaattttgaaaaacactattaagtgaaccagtcacaacattctgaaaatggtgtatcacatagcagagtgctgtgtttttccaggataaagacctgaaacagtacatggatgactgtggaaacatcatgagtatgcacaacgtaaaggtatgttttcttgcgtgtgtaatttttaaattttgtttaaagcataggtgaaccattatataatgaaatgtaccagcctcataactcttcttcagggttttctgtttggccttttaaataggttattgtcctctgaacgtgcaatatttacccagaacttctgtttactacactatagctttcttaggatcagacctttttgtagaaccacttcattcttttgacatttcacattacaactgattgtcctaatatagaatatatgtacaggtgtattctgctttaaaaaaaaaattcaaaataaacacgaatgatgggtgcattctgtgaaaggccttctttaaatagtgaactccccaaataaatggtatttaattgtaaaacaacaacttttcagaactaatgaataaggccagaacatgcaggttttatgaacactatgctggaaataccaatctgtactgtcaggaagaagagtaagataattggtgtgttttcttacaacaacatatttaaaaatttaatgctaaaaatgtttgccataaaatcagtgccagatgatacccaaaagttattaactgagtaacagcatccagcatagtttgtattcttacagtaggtttctttgacctgagtagtgtatccaaatttagcaaagatttatttatccaaacttagtcaacaatatgtaagaacctattctgaaaataggctgtcgcagctgtgtgcttcagacatttctaattctgtaggtagtaattttaaacttacattttaaaaaaatattaagtttggtggttataaaggagagccagtttctgttactaaaagacagctcagaacatatggataacacattgctaaggatttttaaaaagggctttaaatgtacttccatatatattctgtcagggttgttttcatcttattttacatcttttgtttgcaaagtgttataactgtcattttgtatttttttggttttaattttgtttttcctgctttttttattggcaataatttgaaaataaaacaaggtccttgatgataatttcacaaatgttgagacgtttatttctttaatgccaggtttacatgattagcttaagttggaaagcgttttattatttatttgtttaaatggcctttatactttcaaaatacaaagtgtaacaagaattcatttaaatagtaattttagagttttaaaaacataattatgtagactggagagactctggcacagagaattcattcaggcataccgttgacctgctgccttggctgcctcagtgttcggatgccctgtttttcacctacagatgaactgaggggaaactcttgaatcctctgtacttgaggttctttttgttaaccccagagaatcaaaggtcttatgtgttccgtaaccctctttctaccaaaatgtacagcaaaaactctaccattagccttataggaattacttttttcagagtcattcagaacactacggtgctaatgcccctttgtgaatcacagtagattttgaaggctaagtaggaggtgctgaaagtaaagtacccaagagatgggtgatagaagctggtttaggttagttttatagtaagtaatttgccagagctatgcagcagctttctctttgatacctcagacttttcataaaatcgccaattccagtgccttattttaaagacactgccccagatcagagtttttgtttttgttttttttcaaggagagatgggtgggaggggggttggttggttgttttgccagaattttataattaaactatgtaaaccttagtaggcctgtaagtttatgaggatatgttttttttttttaagtcattttccacagtaaatcaactgttactgctaggaggaagttactttttaaaaaatatttccatagatactgttagactaaaagaaataggtagatgcttcaaatagaataataaactattaaattcagaaagccactatatataaaaggaaaaagacattgtacttaaggatgcaattactttctttttcctgttacaatgttctaggccagctgcttttctgcttaccatcatttatgcttatactaaagcatgtctcatctttaagactaatttttatttatttgtttctgtagctgtttctgtaccaaattctacgtggtttggcatattgccatagaagaaaggtattgcatcgagacttgaaaccacagaacctcctcattaatgagaaaggagaattaaagctagcagattttggtatggaatgtatgagatatttattagtacttccaggttctaaaatgtaatggttaaaagatcaaccactgtcataatgtgccattgcttttatgtgggtttggaaattttctcggtagcccacagaataagatatttgacagaactttggttggtgatttatgttggttattagcagcaaattctaaaatgcacaggctgttcttgggtgtggacaaagacccctagggctcctgagacccttgtaggaggcctctaaatgtaaatatattaccaaaattgtaccatctgttatttgcctatttcactgtgttaatatttgcaatgatggtcccaaaataataatgcataaaactatacatcaaagtagtggcaccaaaatatatcttttttttttttttttttttttttttgaagacagcattttgctgttaaagcccaggctggagtgcagtggtgtgatcttgactcactgcaacctctgcctcccaggttcaagtgactctcctgcctcagcctcccaagtagctgggattacaggcatgcgccaccatgcctggctaattttgtatttttagcgtgaccaccatgttggtcaggctgatctcgaactcctgacctcaggtggtccactcgcctcggcctcccaaagtgctgagattacaggcatgagccaccatgcccaggccgtcattgtattctttaccactacacttacgtaaagggaaaactgtcagttacacttacatgatgaagcaataaaatttattaattatatttaatttccatccttgactacatttctttttaatattttatgtgataaaatgggaagtgtacataaaactcatttgctgcacacagaaataatgtggttacttctcagggaaaagtgctcatgtgattatttgagtgcacattgaactagccctgttatttgaggggacaccatttttacttaaatgactgacagacaaactgtggttattcagacttaggtgtttggcagacattttcctgaaagtgaatgaaggaagcctatcatttcaaggaaaagaactgtcagtatttcttgccaataataaaattcaagttttcaagcaaaaattagagtttggaaatttggatctgctttgagtttgatggcttttcaatacttagagacttttctgatgagatcgatgttgatgttaacaaacacgatttttcaatatgctgaaaaagtgtataaacatttggaatgtataacccagggatccactgttttccaaatggctaatgcatgatattacagaatcatgcatggataaaagacccatttaaagtacaaggtcaatgaattttagtgcaacaaaagcatgagaagttcatcgttatagtttttgttaacacatagcttttaagagaccacttactttctagttctgatgtagtgtcaaataagactattcacatttatcagaaaaggctattaaaatgcccctcctctttcaacctcatatctgtgtgagatttgatttccttcatatatgtatgttgtgatatgtatatttgatctattttgatacatattgtgatatgtatcaaagcaacatatcacgacacacagaatgcaaaaacagatgtggaatccagttgtcttctattgaaatagactttaggccagacacagtggctcaggggtgtaatcccagcacttatgaggctgaggtgagaggatcacttgaagccgggagtttaagaccagcctgggcaacatagcaagaccccatctctacaaaaacaagacttaaaagagatttacaaaaatgtgaaagaaggccattcttcttactgttttgtttttataaaaaaaatgtttttcataaaaatgtcatacatgctgcatataaagggtggtgtttttaaagagaaaataatattttaaaatttgctaagttttaatttctagtgtggcaaatatcagtaaatatatccacaaaaataaaagctctttaggtctttgataattttcaagagtataaaatgggtcttgagaacaatgagtttagaagcaactactgaaaggcgttcccttaatatacctgccaccattactctgtatttattatatgctcagtaatttaattgtagctatttatctattttttttttagctaatctggttttaagggaattgaaagtaaaattaaatgctctttttgcttctagaaagtaaactttttcatattgaaggaactttgtagagcagctttgaattttttgtattccgcattctgagagtttgaatactcttagagaacttagtttttaaaaacccatgcagttttccataactaaattcataattttttttcataaatgattatggtagttttttggttgtttgttttgagacagggtcttgctctgtcaccctggctgaagtctagtggtgcaatctcagctcactacaaccttcgccttctgggttcaagcgattctggtgcctcagcctcccaaatagctgcaattacaggggtgcccaccacgcccagctaatttttgtatttttagtagagatggggtttcaccatgttgttcaggctggtctcgaactcctggcctcaagcaatctgcctgccttggcctcccaaaatgctgggattacaggtgtgagccatcacacctggctttgattatggtagttttatgtttggagtatttcattaaatttaataaatatgagtgtttcaagtattactcttcactgtcattaaatggtgagtttattctggaaattcctatacttttgctcgtttaatactttgccatttgaagagtaaattactttttgcatttccttccttaaaaaggaaatgtgtgggttacctgtgtttgaataacaaattatatgctatttacatatgctttcataaagtctcttcttgggcatagtttatgttgttatttcccttataataattgttactctctctctcttttttctttctctttccttcccccagccactatttccttttcactctttttccttctccttctctttgtttgctaacctgcatgtaatgctctttattcccaatcccaaaatgaatggcagtgaagagaaatacttcaggatgctaaggcgggtggatcagatgaggtcaggagttcaaaaccagcctgaccaacatggtgaaaccctgtctctactcaaaatagaaaagttagctgggcattgtggcggacacctgtaatcccagctatttgggaagtttaggcaggagaattgcttgaacccgggaggcggaggttgcagtgagcccaagatcatgccactgcatgacagagcgagacttcatctcaaaaaaaaaaaaaaaaaaaagcaaaaggaatgtcaaggactataaaaaatttacctttggctgggtgcggttgctgacacctgtaatcccagcactttggaaggcccagcaggcagattgcttgagctcaggagttcaagaccagtctgggcaatatggcaaaaacctgcctctataaaaaatttcaaaattagccaggtgtggtggtgtgcacctctagtcccagccagttgggaggctgagatggtaggatcagttgtgcccgggaggttgaggcttcagcgagtcatgatcaagccatttcattctagcctggttgacagaacaagaccctgtctcaaaaagaggaagaaaaaaacaacaactacttttatcagggaatactctgagtgctttaaattttgcttccaacctctacaatgcaagccaggcaaattttacccacaaggcaacaagaaattctgattattccatgagatagtatattcaattctgtctctatttcttcctttttttttttttttttggttgcatagtaaatatgacttcttgtgaaggagggtcatataactttgagtatttatactataagttgttctctgtccctctgaaaattctacccttttcccacgatcagtgaaaatcagaagtctaggaactagtgatatagacagatattttcactaatgatagaaaatggcttatataataataccatatcacatttaattaattttgtttaggagagattgtttcatttcattccaaccagtattgaaattctaattgtgaactagaaggccatgtacacaaacaccatagttcggaatcctctcaggagtgggagagtaggatactgaggaaactataactggtaatttgccttgatatggtatgttacaggataagcacgtttgcaaccctgtcctttgccttcctataacccacttttaatatcaagaagagaggtcagaaagctacctccatcttgttaattaattaccaaaattggtatgaaaataatttgttggacttacttcaccaagttgagatgctggagtaaaacttgtaattaaatgaaggaatgtcaacattgttccagttataacctttcaccattatactgaactgaaatagtatatgagtcctgcctaattaaatttctgacattgtttctgtaaccttattcagtaaaattgattttttcttttgtgacatttttctttaatattttaatcagatataccaagttatatataacagcaatctcagcctaaaaaataaattcttccttgttttggcaaaataaatttgtaattttccagatattttttaaagttgcttcttcagatcataatttagaggcttcgaggtaatagcgactctctcacactagtgactcaagagataaagttgtaaactctagcctttatttctggattatcaatagattccatattaaattagcaaaggaatggcaaatgttttatatcacttacagcaagcttgtccaacccatggcccatgggccatatatggcccaggatggctttgaatgcagcccaacacaaattcgtaaactttcttaaaacattatgagatttttttgcgatttttttttttaaaggtcatggctgttgttagtgttagtgtattttatgtgtggcttaagacagttcttccattgtagcccagggaagctaaaagattggacacccctgacgtaaacagcaattaataatatccaaggacaatgaagtctgtcttactccagaatgatccatgtaacttacaacctaaaaagggagtacagaacagcactgtaattttattccaaggaaattgtctctaagtcgatttgtcagtaaatctcaatgagattatggaccaataactttacagtttttgataaaaaatggtatagcaaatgaaagttggaatcaggttaaaaggtgacaaaagctcatagccgttagaagtaaaattgtgtatctcaatgtcattggcctattatggattaatttaattgcagctgagaaataattttgtcatcatgattcatggacagaaggaaaacatcttaagtttagattcacccagaatacttcaccaggtgtattcaaacataaaagtaagcacagtctctggttgtggaattcttgtttagttcaactatgtaaggatttgcttacttagggccacatgcactcaacgaattcataaagttaatagtggtgaagcctcaagaagctacgaattaaccatttcaggcatccctttgaatggagtcatggtgagaatagggtctgagagatccattaaagctttttcttaaccctttgttttattttccctatgaaggactagcccgagccaagtcagttcccacaaagacctactcaaatgaagttgtcacactatggtaccggccacctgatgtgcttcttggttcctcggagtactcaacacagattgacatgtggtaaatatatacagatgtcactgacatttataattttgaaagaatgtaactgttaatgcaagatgtattgataagtatatacttttaaggagatattattttaaagagccataatgtaacagtgattaatgagttctggcatgggaattagattacctaggtttaaataccaattctgccatttagaactatgtgttaactttattcaaattactggcctttgcctcagtttcctcatttaaggaaatgggaatagtaacaataactactttgaagtgttgtaggtgatgttaagattaaatgaacactcagaagagtgctttatgagacactcaagagtatctgatacatagtaatttaaaacaaaattatcattttatcatcatttaatattcaccaaaatctttctgctttaacttgaactaaaagtaataatcaaaatattgtagtcatctttctcacacaccgcttcgatcctgacactcttctactcagacaccgttattgccacccccttcattacctatagaataaggtacaattaattcctcaatctgatacttaaggatttccataagatgtactctaaactaccttttccaacttatttcagactgtttctcaacacaaatgttcccttttagcaaaatggcatactcactatatctcaggaataatgtggactttcctacctttgctcttggtgttcataccagtccacccatctggaatgcccactccggtgctctaacttgggctcattcctagtaacgttcaaaatacagcttttcataaatcctttcctgaatatactctagcctctgttggcagttccttcctctgaactgtggttgcatttattttctatgttcttcatgtggtaataagtcatataccgatttctgttgctgtcttgaacagtttatgtaaaatgtctcgtataactttttaaaattaatttttaatattgtaaaatactcataaaatttatcattttaaccaatttaagtgtacagttgtgagacattaagtacatttatattgttatgcaaccatcaccactatctatctacctccagaatctttttcatcttgcaaaaccaaaactctgtacccacttaacaatttcttcctattcccctcccccaccatcagtttctggtaaccactgttctataatactttctgtctccataaatttgactgttctaagtaccacttatgagtagaatcatgcagtgtgtgtcttttcatgactggcttacttcatttggcataatgtctttaaggttcattcacgttgtagtgtatgccagaatttccttcctttttaaggctaaaaatactccattaaatatatattccacattctgttacccatttatccattgatggacatttggtttgcttccaccttttgactattgtaaataatgctgttgtgcacatgggtatacaaataccttttcaggaccctgctttcaattatctctctctccttctctttttctttttaagagacattgtctcaccatgttgtccaggctggtcttagactcctgggctcaagcagtcctcctgcattggcctgatttcagttcttttagatatatacctaggaagtagaattgctggatcatatagtaattctacttttaattttttgaggaaccaccatactattttccatagcaactatatcattttactttctatataacacttaatatgtaaaattaacttttatatatagttgctagattacgagccctttaatggaaggattatgtcttaaactgtgtgtgtacatacagttcctagatgactgttctaagaaccaccattctattctctgaaccaccatccttttcttttccttcacttacacacaccgccttgtaccaacatgttctacctctgcttcctgcatcaaaacgtcttgaatcatttgtttctctccatttctcctgcctagcttcactcactgtcatctcctagattaccataatatctcttcagttgtttttccccactcctgtctttgctgttcaatccatggtctacactattgctaatacaaggattcagtgagataattggtgcacttaaaaaacatttctaacacatagtaaatcttcagtcactgttagctgttgttagtgttactcttcaaggattatgcaaaggagagttggacattttaagtgggaaaaatgggatatagcaatatagaaattgagacaaatagggtaaatgcgaacaaattagttagatctaaaatatcccttcaagaggttttccgacaggctagtgcaaaattctgcagagaggcaaccttaaggaaaagattcttgtgcttcataatatgtaaatgaattgctaaattattttcatgatctattttaaaggggtgttggttgcattttctttgaaatggcttctggaagacctttatttccaggatcaaccgtggaagatgaactgcacttaattttccgactgctaggtaacagaagaaatcttttcccagtgattttgcacccataattgactagctggataagactgtatctctaaaatacatattttaaaattagatactgagactaacataaacagctgttagttagaataattagaatggacactatgaagatagatccttctaggtaacttcatctgctaagttttatctttgcaataaagattttatggaaaaacagaacataattagtatggaaaattggatgtcaccatattattaaggaatattgctaacttttttggtatcaactggatagaaaaaggaccaggcatcctttttacagtatcattgcaaagtccaaacaaaaagtccatgtacgtttatttctgtcatttcaattgcagttgaaatagttaagtcatctggtaaatgtaaattattctctaagacactttgttatatatatgtgtatataatttttatatataaattttatatatatttataaatatatttaatttttttttttaattcaggaactccatctcaggaaacttggccaggtatttcttcaaatgaggagttcaagaactacaactttccaaaatataaaccacagcctctaattaaccacgcacccaggtatttttttttcttatgtgaaaggggggaaaacacatgattcttttcaatcttttgaaggattagccacagtaaggattcaggaaaaaatacataatacacataacccttacgtattttaggatcttatttaattttgaactgtatatgttttagaattctagagtttatgtagttacttttcccagaaagaagacattgattaatgccttattccgtaccacagagattatgatgaaattcctgttttgctttctacagaattattctgtatttacttaacaaaaacctaagaaagggttatgtaagtaaaatcttgactctataacacaaggtaacctatcagtattttgaccagtgttaatgatgtaattcatatttgaagaatataaactctgtccaattccttagcaaaatgtaacatctaaatgtcagccattcatttaagtttcttcttagacctaccccaagatcaatccaaggctcccaataaaatttgagtcagaacatttttacttgtagaatgtattacattttcaggagataacatagaataacccctttgactgcattttccatctccctgcccccaacccccccaaattttgaaagtcaccaagataccaaataaggacatcatttattttaacccaaagccattcacattgctcacaacataacacacttgttatgcttccttttattttcaagctaaggaaggaagagcaaaacagttatgacaccaaaaatatttttaaagtatttatgtgagttggtactcttattgttactatagcaactaataccattctaactagattttcttaggaagaataataatacttgctgggctttttttgcatgtctctcccaagtagcataaattctatttttgtcctttaattattttttggtaatgttcagtgtagaaggttgaagcttttctttgaagcagagtctccatgacttagtgcctagtttgtgcccagggaactctggatatgtgctagaatggcaaactacatagaatgtctagactgcagcatccacaggacccacttgagagcacttggaaaaaaacgttaccttattcataattgtacttctaccagtgaaaggcagtgtaagatagaacctgttatttctgatcaagagattattccattaagataatcccaggccgggcacggtgattcacgcctgtaatcccagcactttaggggggtcaaggcaggcggatcacctgaggttgggagtttgagaccagcctgaccaacatggagaaaccctgtctactaaaaatacaaaaaattagccggacgtggtggtgcatgcctgtaatcctagctactcgggaggctgaggcaggagaatcacgtgaacccaggaggtagagaggttgcagtgagccgggatcgcacctttgcactccagcctaggcaacaagagcgaaacaccatctcaaaaaaaaaaaaaagataatccctaaccctactacccctagttatactaatttcatctttattatgtcattagttttatatcccttattgatgaaatttttttttttttttttttttgggagacagagtctcgctcttccgcccaggccagactgcagtggtgnnnnnnnnnnnnnnnnnnnntctcctgcctcagcctcccgagtagctgggactacaggtgcctgcccctgcgcctggctaatttttagtagagacggggtttcactatgttagccaggatggtctcgatctcctgacctcgtgatccacccgcctcggcctcccaaagtgctgggattacaggcgtgagccactgcacctggccaccattgatgaagttttatgaagttattgtagcatatttaaattgaactcaataccttctagtacccggtgctaagcagacaactctaaaaatttgctgaatagctcatttctgtgtttgtcttgaacaacagtgatacattttggggtcacttgtctctgttttcacctatataataggaaaatgatgctcttatatacttgcgtttagtgaaagactgcgaaaagtgatacaatatgtaagctttcttaatattgaagtttctttgttttgagacagcatggtgatttttaaaattctttaatttgttcttggatattgaaaattcaaattgaagccaagttatttatggcttatccttaaacaaatagcaaggccagtcttttaagactaaaacagatttgtgtctatttgaagacaacaagagtgactattttagggcatttaaatttagcagattaaaacacttagaaaatagttttatctgaaaagttttatcagctaagagagcataaatttttacttgttctttgttgtttctaggttagactctgaaggaattgagttgataacaaaatttcttcaggtaagtcagttcttacagtaattgttaaataggttgttaagcctcagcttcttcatgtgtagaatgggctcagtagtacttcctcggtattgttaatgacaaataaaattatctatgcttaaggcacatgtttaagttaaaaaaaaaaaaaaacatggtttctcctaatgtgtctgggtctcttgtcacctacaacagtctgaggtagttggttactggcattgatcagctgtgtcaaggccacattctctgcaattgatgctctctatgctctcttatgttctcttttccttatacgtacagcctttggaggatgctctgcctccaaatgccattcatatttccctccaaagcaggaataaggggggacgataagggtagtaccagccacattagtcctcttgaaacttggaagcaaaagctttacagaaacccctacaaggtttctttccaagtcttattggccagaacattaattgtaggaaagactgggaattggggagcagaattgtcataattagccaaaatttaaaacagttatgattcatgattcatctatcagagttgatggacaccttgaacaaacctaggttgtatcatcaaaaaaaaaagggaaatgagtattggataggtcgttaagaatgactgccataaaaatactgggtatatgtccaccagtcctttggtgttcatgaagagaagtaactacacaggtcaaatattttaatttttctttgcttcagaaaatacaagcaatgtaaattcttgtttaagatccagccttatcttagaaatgtggaactgagatgttattacacaatctcagcagcgactcaaattagagtataactggagtattccaaattgttgattgaaaaatagtcatcatattaaataatcaagattttttttaagtagctctaaatgctaatttgcccatctcctactttttgcagtaattagagaaaaagctaatgaagcagttctttgctttttcacagtatgaatctaagaaaagggtttcagctgaagaggccatgaaacatgtgtactttcgaagtctgggaccaagaatacatgctttaccagaaagtaagagaaatcctaaagtgttttccctgctttatttttatttgtccaaggttagggtctggggtgattggggagatggctattgatttttaagcctaagattctagtcttctctatagttagattagaatttcttgaagggaggtgtgtgtcttatttccctatgattcagttatttcttgtaacactgagcacattgtcactcctctgtaggaaaccaatagtacttaggcaaggatcattaatcttattggactttagttgaaacatgccatctgatgacaggcattgtccctaggcccaatctagcttcgatttagcgttgttaaaagtgaatttcaaacaaaaactaatgaagcataaccgaaacataaattgttttcttgtgaaaatacattttttcttaagatacaaagatgattttcctttattgtggtcacactgactttactatccccatgacagcagtgagcatattgtcaaagtcactgtaatagcagatttcccatgcctgaataacattgattttactcttaacattctatttttagattaccacagtattttactttaaaatagagtaaggtgagtggggaattagaagaatgtttgggaactaagctgccaaaagctttcattaatttcctattctcatttattagacaatattgattcatcaaagcttgtgtagcagtcagtgacaaagctaattggaataaaaaatccttaatacttttcacttcaactttactggatatatttaaatgaaagaatacctctctgacagagattggaaatgaaaaagataaattacaagttttcttttaaagatatttgtatttcactgggcgcgatggctcatgcctgtaatcccagcactttgggaggccaaggcgggcggatcacgaggtcaggagttcgagaccaggctgaccaacatggggaaaccccgtctctactaaaaatacaaaaattagctgggcgtggtggcgcgtacctgtaatcccagctactcaggagactgaggcaggagaactgcttgaacctgggaggcggaggttgcagtgagccaagatcatgccactgcactctagcctgggtgagagagtgagactccgtctcaaaaagaaaaaggtatttgtgtttcattattaataccaagttttactttgaggtaggcagttatggttatacaaaccttttccttgtttttcgctaaaattccaaagatagcttgagggcctggtaccttcatgtcattgtaaggagacagagaaaggacagagagaattaacacctagtataataatatattttgactgggtctcccaaccccagaaagtcctggaacagacagtgtatattctcctcagagaaacacttgcccacagcctgctctgacacagagttggaagaagaaaggttctaaaggtggattgcttcattcatttagttttctcctcaacacactgggacaaaaaggaaaaatttcagcagggctatcaccttgtaaaatggtttcatattgaatcagtatatgctttataaacatttgttgatagtagggttgtgtttgttttaatgttagaccttcacctaataatttttgtctatgcattttaggtgtatcaatattcagtttgaaagagattcagttgcaaaaggacccgggttttcgaaattcttcttatccagagacaggtgtgtttgtcataaaccatttcacgtgtcgatcatgaatttttgcgtggaaccaagcttttggtttataaattgatcagtaaaattattgatgtaaaaaccaatgtacagtgcattccacaactgtttatgtttagcattgcacgtactcacttttctgtatgatgtgggcagctcagtaaatcttcagagaaaaatctgactcagtcaagtcagggatcctgaaagctgcagatggcacaaagaccttttacaagtgacctggcttgatcactgcacacgccatccctggtacctgaggcagaagacacatcttgtgcttccctagtcatcaggttcatcacttcgaagcatagaagctgtagactgaccccgtcaacagaagggtcatttaagacagtgctgatcactcttaccatggaatattagcttttgctggtgggaacattagcttcctagtcaccaaataactgtatgtgggataaaactgaaccttgaactgcctcataaaatgactttatattttaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatatatatccatttgttacataaagtgtttcttcctaggaattcctaggggtatttcttcattttattaaggaatttgacaagcaaacaagtgtttgtttttttgttttatttttgatactcgagcaccattcagatcctgaaaacactgcagtgaagggaattgaaactccgaaacttggaactttgaatacctgtgattcctcttaaactggtaagattcttaaaggtaagagaagatgccttttatatttttctttccaagtggtactgtgaacacacattggatgtgtcattctaggtgtatagagtggctgcattctgtctgaggctttatcaactttcatttgaaaggctatttgttaacatgttataatctgtcttttggactcgggacaatttatgtaggttctttttatcttttaaaaattgtgttgagacatatatatatatatatatatatatatatatatatatatatatatatcataaaatttggcattgtaattatttgtatgtgtacagttcagtggcataattatagccacaaagttgtataacagttaccactgtctacttctaaaatgtttcattactccaaacagaaactctgaaccattttacccttccccgcagcccctggtaaccgctaatctactttctgtctctgtgaatttgcccattctaggtatttcaaataagtggagtcataccatatttgtcgttttgggtctggcttatttcattcagcataatgttcacagttcatccatgtttagcatgtatcagaacttcatttcttatcatgactgaataatattctattatgattatacacattttgtttatcgatttatctgttgatggacactaggatatcccatcttttggcttttgtgaataatgctgtgtgaacattggggtataagcatctgtttgagtccttgtttttaattatttggggaatacatacacctaggagtggaattgctgggtcatataattctgtgtttgactgtttgaggaactgccaaaatgttttccacagtggctgtactatttgatatttgcagtagtaatgcatgagagttccagtttctcctcatccttgctaattctttttttcctcctttttattacatttattctaataagttgaagtggtatttcattgtagtttttatttgcatttacctaatgcttagtgatgtggaacatcttttcatacttttttggctatttgtttatttgctttggataaacctttatccaaaggtttattcaagtactttgtccattttaaaaatagggttgcttgtctttttgtcatcgagtttaaaaattctttatgtattttggctgttacacctttatgaggtatttgatttgtaattattttctcctgttctttgggttctctttcactttctttggtgtccttttgttgcacaaaagttttattttattttatttttattgttattattttctgagacggagccttgctctgttgtccacactggagtgcagtggtgcaatctcggctcactgctacctctgcctcctgggttcaagcgattctcctgactcagcctcccaagtagctgggattataggcatgtgccaccatgcccagctaatttttacgtttttagtagagatggggtttcaccatgttggccaggctggtctcgaactcctgaccttgtgatccgcccatttcagcctcccaaagtgctgggattacaggtgtgagccaccacgcacagccaaaagtttttaatttaacgacatctattttatctcgtttgttgcctgtgcttttggtgatttaagaaagtattgtcacgtttcaaaggtcataaatatttgctcttatattttcctttaagagtttattatatttttagctgtcagatttagagctttgatccatttaaatttttatgtgtgatacaaagtaagggtccgactttattttgcatatgaatatcaattttttttccagcaccatttgttgaaaagactgtcctttccccattaagtggtcttggtgcccttctcagaaatcagttgaccatagatgtgaggtttatttctgggctgtcaggtctgttccattagtctatatgtctgtccataagggtttgtagcacaatgttttgattactgtctttagaacgttttaaatcagaaaatgtgagtcttccaactttgttctctttctcaagattgttgcagctattcagagtctcttgaaattcaatatgaattttaagatgggattttctatttctgcaacaacaacaaaacaccattggaattatgatagggtttgcattaaattagaatctatagatcactttgggtagtattacaattttaataatattaaatcttccagtccatgaacacaagatgtctttccatttagttaggtcatctataatttcagcaacattttgtagttttcagcatacaagtcttttgccttcttaaatttattcctaagcatcttattcttattgatgttattgtagatggagttgttttcttaatttctttttggattttttcattgctagtgtatagaaatacaagtaatttttgtgtgttccttttgtatcctgcagctttgctaaatttgattattagcactaacagggtttctgtagagtctttagggttttctatacatatgatcttgttacctgcaaggaatgatagttttacttcctcctttataatttggatgctgtttatttctttctcttgcctaattgctctgtctaggacttccagtactatgttgaagtgatgaaggaacatatccttgtcttgttttgatcttagggacaaagctttcagtctctcaccattgagtatgctattagctgtgtctttctatgtatggtctttaacgtgttaaagaagttcccttctatccctagtttattgagtatttttatcttgagaatattggattttcttcaaatgctttttctccatcaattaagatgatcatattgttttctatatttttttgatgtgtattacattgattttcatatgtgaaaccactcttgcattccttggataaatcctacttggttatggtatgtaattctaataggctgctgaatttagtttgctaaattttttttagtatttttgcctatattcataaggtatttggcctgtagttgcttttcttatagtgtttttgtctggatttggtatcagggtaatgctggcttaatagaatgagttaggaagtgttctctcctcttcagttttttggaatagtttgaggattggtgttaattcttccttaaatatttggtagaattcagcagtgaggtgacctggtcctggcttttctttgttcagaggttttgattaatgatacagtctctttgttatatataattttattcagagtttttatttcttgttagttttggtagtttgtgtgtttctaggaatttgtccatttaatctcttataaccagtttgctgacataaactttttcatagtagtctcttataatcctttttatttctgttattgatttctagtttcattccattgtggttagagaagatagtttgtatgatttcagtttttaaaaatgtattaagagttgttttgtggcctaacatatggtctgttctggagaatgcttcatgtatgcttgagaaagtatgtgtcattctatgaaaaatattgttgggtagagtgtttggtatgtgtctgttaggtctaattggttcacagtgttcagttcctctctttctttactgatctgactcttttgtacattattgaagtgggagcattgacatctccaactgttattgcaggattgtcatatttctcctttcagttctgtgagtgcatgcttcatatatttgggggccctgttactggctgcatatgtgtttataattgttacctatcttcttggtggattgaaccttttagcaatatataatgtcctttgtctcctgtaacttttttttgatactttagtctattttatctgacaaaaatatggccaccccatacctcttttggttactatttgtatggaatattttttccattcttttattttcagcctcttcaaagtaaaaatacagtgtctgtgtttttaaagtgagtctcttgtagatagcatattgatggatcattttttaaatccatcctgcccatctctgcccattaattggagactttacaacatttacatttaaaataattactgataaggaaggacttctgccatttagctgttttctgtatgtcttatgtgctttttgttcttcagtttctacatactgccttgtatttgatttttttttttttggtaatgtaccatttttattttcttctttctttgcctgtatatttttagttattttcagttcctatcattttaaaatatttatccccaaatgtaatcccttcgagtttattatttataatgtcagtggttttattttttaaatattctagattcttacattgattctttctgattgacaaattcatccatatcagaattttaagtgttaacacaagccctcaagcaaggctgctgaagaatttgcatacttttctatgttccaaacttgaaatttccaaagtttttaatgcattactttagacccaagagaaaggtacaacattttcccctcttgctcagtgtaaagctgaaactatttaaaaaaaatttttttttgagatggagttatgctctgtcacccaggctggagtacagtggtgcaatctcagctcattgcaacctccgcctctcaggttcaagcaattctcctgcctcagcttcctgagtagctgggattataggtacatgccaccatacctggctgatttttctatatttagtagagacgaggtttcactatgttggctaggctggtcttgaactcctgacctcaggtgatccacctgcctcggccccccaaagtgctgggattacagacgtgagccaccatgcctggcctgaaactattttctaatcttaaattcagattctgggcttagtcagataggagtttccctgagctgtcatcattcccggctgaagttattacaataatcagtttccatcactgacccagaaaaccactgaagttaccaattttctgttagactcaaacagaaagaaggtgaccaagccactgattataaagctactttgattagaggagaatataaaatttcaatctgtgatgatggggaggatttttcattggtgggttccccctaagagaagtgggaaaattccactaatttgaaaacccatttttcaaagattaccatttcaaagactgtaaactaaacctctgttgagtagagtgggtgtgggggctagatgtgcaggtgtgcatctgtgagagggggacagggagagaaagactgaagctggaataggaatcctgatggctgttcttgctactctctcccaccttaacgctgctgcagtagtgatgcagagatacctgggctggatcataaagatgtgaagatgtagctggtgaccctctggataatatgcagcacctttcagagggtaagggaaacttagcgtctgccaacagtcttgtatgtttaccaaaggatggctccactgggctctgattgacctatggaattttagtgaatagacttgggacttaacgcaagactcccttgggactcttttgagtctttcctagaacagtgctagttgaaacagtgccactctccagccgtttctccagctatattgacaatagttccacattctaacagtcaaaatagtcttaaggatcatctttatcttgttattttcttcctcatgtatgtatgcagctgaggttgtcaagtgatgaatgggtgacgtggtgctgttacaggctgtgtagctcatctctggatgatgatgatggactgttattccagaaacactgaaaaagtttatttttgagggccccatcctgccatcttgctcttccacagaatcgtagctaatcactgtgtcattactcctcagggatctagaagcgttcctccttcctcccttttcaatttcgactctgttgctactggtatctacattactatcccatatgatgatgagataggctttgttctctgtgagggtaaatccagccatattgatcttttgagttcctcacacctcacctcattgtgaaacatcccctttcctctgcttgttcatctatgcctcttctctttgttacccttactcattctcaatgtaattttttcttccagaaagccttctctgccccacctaccctaccacagactgggttatgtgctctgctgcttaactgccttccttcccaatagcatccttatacttcactctgcaacaacacttaatcacacgtcatttcttctcactaatccacaagctccatgaaggagaggattgcattttgctcacttctttatcctagtacctgatacattttaggggaacagtagtatttgctgatcaaattaaggcacacatgcatgatgaaattctgagtaattctaaaaaatcttttgtcagttatgtaatatcaacttggattcgtcccctctctgagtcaaccaaagacaaatgtcgctgtcaaaaattggtgatagaaactttcttcctagctggctaaaacatgtgagtctttaaaatcttaagaactaacctatgatcaagctgttctcaacacacacacacacacacacacacacacacacacacacacacacacacacacacagatatgcaggtacacacgcgccactggggagtgggtctaggaataaagtcaatactagagaaatctaggtagggccagcttcttgatgacagaaaatttgcctgccctcccaggaaacactgatatagcaaacatgtctgaaaggtttatgtgcaccaggtactgttctatgtgaagatgtaaattgctaatttacattcgttggaagtcctatagattaagaccatggcctctcaatcaaaatgctgtttgaaatctggccaattctgtgaccttgagccagttccttaatcactctaggcttcaatttccttatctgtaaaatggtatataatagtacttctatcataggtttattaggaagattaagtaatccatgtaacatgcttagaacagtgcctggcatgacagcaaccttacaaatggttgctatcattaactgaaattatgccatccagcaatgaaataaaaccatgttttagagatctgactcacctgagagagggtaactaaacatagtgtattcttcagtgccaatcctttaggcagggtcatataatcccaggtaacacgaaggggcggcgcagatccctgtgggtatttaagcataaaagggcattttacaaaactgatttgaattctttttttttttttttgagatgtagtttcgctctcgtcatccaggctggagtgcagtggcatgatctcggctcactgcaacctccacctcccagatccaggtgattctcctgcctcagcctcccgcgtagctgggattacaggcgcttgccatcatgcccaactaatttttgcgtatttagtagagacggggtttcaccatgttggccaggctggtcttgaactcctgacctcaggtgatccactcgcctgggcctcccaaagtgctgggattacaggcgtgagccaccgcacccagccagttgaattcttatgtataaacagaaccaagcaaattattaatgagaacagggatcgggtttccatcccccgtttctaaaatggcacctggaacatagttgatctttaaatgtttcttcaggaagcaaatgatttcctaccgccacctgtgttacactatatgtagctgtgagttatctgtggccttttggcacgctagtgatactgaatgtgttgtttagggactgcattaatctgctttctccctgcatcccctcccctcccctcacaccagtctccctatatcaaaccctgagtggagactgctttgaatcacccatgaaaaccagagccaggtcagcctggtattgagaccaagagaaataataacctttatcaccaagcctagcagttcacattcccctgaatcaacaaaatggctaaaagaataaatggtagatttgattttcccctaccttctcacttcctcctcctcctcaatacagagcagttgatagaacttaaataagatcaggggtctgcttttcaatccattccattctcccacaagtcagcctcaataattacatttatttcttaaaatatgtgtatgtaaagcactttttttttggatgtgctgtctttaagggtaggtgacaagactcattttccaacttgtatccatatggaaaagtggtttgggtcaccccaagcaaatggaagtaagccaatccagttacctctaaacaccttttatcacaaagtttttattgaacaaaaataatatgacagtaaaaatgatacataaagtgaagatttgcagtcatagaaaagatgtgtacaaagagaccaacattcaggttatatagttctataaaacttttcccatagcagtttaacactgattaagcagacataaaagggaaaagaaagtcattaatgttctttgaaacctattttctgagtaaaatacctctgctaacacacacatgcacacacacacagaatgaggcagagctatatgagtgagttattcttcagttcctccagttctctgtttgtgttacaggagtattttcatccatcaaaaaattgtagtatttttgcatttctaataaatggatctagagcatacattaatcccagtttccaaaggaaaagaaagaatcagatctatagtcatttaaatatttccaatcagcatttacgtaaacaagtatactaaaaatagtagttttggttgagatttttgcacattaacttcctttagtttgtaagaatcatgcattttggatgtgttctcttatctgacaacacagttttaaatgctgtctttatctgttttgtttgttttactaataacacgtagttttgaaccagtaattacttaacagctaggcatgggggagacagaattggactgagcaccaatcattgttctaccttcagtgagctgtgcagccataggc

SEQ ID NO: 1505 - DNA, 2785 bp, Homo sapiens
gcctcgcctcgggacccgcggtccccgctcttgctggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagaggtaatatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaa

SEQ ID NO: 1506 - protein, 519 aa, Homo sapiens [sequence omitted]

SEQ ID NO: 1507 - DNA, 34200 bp, Mus musculus
  misc_feature (1)...(34200): n = A,T,C or G
ccagactcccagggggtttccacagccaatctcatcatgccctacccaggaagaaggagcaaccccaccttccagacaaactgggagggagtggcgaggcagggtgctgcggaggccacactgcccagagccctggatcctcccacagcaggatggagatgttctccggaggcgccactgtgccaggcacagcaatgccagaggcttaactgcagagtcactgagtctcccaaatgtcacatgtcattctcaatgtcgtcataacagtatgagatcactgggggtggggactgaggccagctagatcggatgcctggaaggctgagccctgtttccaaagatcacgtggcagctgtgctttcctggtgtctggtacttgtggggagccaggcaaacaagcactgatgaggtacatcaccagagcttggcccggcggtctggcacagcaaggaaagctgttgccttcaaagcccaagacctgagttcgatccccaggaccgacatggaaagaactgattcccaaaagccgtcttctcgattccacatgagtactctgacatgtggatacacacacacacacacacacacacacacactcacacacacacacacacacacacacacacacacacacaaaataaatatgtgtaactagccaggtggtggtggtggtggtgcacacctttagtcccaacaccttgtcttctaagcactgggataaagggagtgttccagcacaacctgtcacttcttactggaatttataccgtgccaggactgtcctgagaggggctgagccatcttgaccctcatagccatctgataaggcgtacatttagccccactttataagtgaggaagcttgctcagagagggcaagccatttaccaggcaggcagctagcaggtctggttcttttgttttgttttgctttgtctttttgccagatgtgcttctcttactctgtgtccaaagctgacctcaaactcatgagcctctcagccttcaaaagctgagacagcaggtgtccggggcatgcctggctcaacccaatctgacagtgtctcattcacagatgaggacctggtcggcacaatcatcacatcgcctgactgccaactcctgaatccttctgacctatacccaaccttccaagacacccagtcacccgccaaggggcaggtgccaaccttcccatattctgaccctgtccctctgccctgatcaacgcggttgggggaggggcatgtggggtgtcactctcccaggactaagagagaacaaaccagatgttgcaatgccctgactcagctcctgcgtgcagacccagccagaggagagagaaggaagattaagccttggctgagccccagatgggttgactctgcccagtgccagggactcaggcagccgccaaggtcccggggcggagccaagaggtccagatctcgctccaggaagctggcctgctttcacccctggggcggggcatcctagggggaagagagcgagcactggactcagggtggatgtccagccaggagcatggagaagaggctccttgtgacttcttcctctagctcggcgtttcccaacctgtccgttgcaatcccagggctggggctggaggctgaatgccccctttacaggggtcgcataccagatatcggatatttacattacaatccatgtcaatggcaaaattatagttatgaagcagcaacgagataattttatggttaggggtcactacaacatgaggcactgtatcacagggttgcagtgttagaaggctgagaacctcttgctatagggtcttgcttgttatgtgactgaaatccaatgtcattccctcttgctgcaatgggcatctctgttcctctgctaacccctccctgccccaagctacaggtgtgagctatgctgctcagatctctgtagatgcccccaaacccacacccttccatgcctcagtttccccatctgaaccattccttcccaaggagtaggggcagacaattatggctagtttgaactttctggcttcaagtaacccaatggctacttgatcagctcaggaggttggagacattactggagtcctgcttaaaacctgagtctgctctgttccttgtggtatgagctacggaagcaactgcaactgaaaatctactgtatttcattccatctctggataggcactcatgtagcccaggctagcctggaacttcacaaagtagctgaggatagccttgaacttctgaccctgctgactctacctctcaggtgttgggattacaggcctgtgtcaccttgatgggtttgtgtggtgctgggatagaacccagtgcatgctgggaaagcactctaccaacagagctacagtccaaatcgcattagcccagaaatatttgatgaatttcttcacagggtgtggcagcgattaagtaggttgacccctgtaggaacttgactagaatgagctaggccttctgtctcgtttgtgtgcataaaaggaggcctggctgcttgggtgagaattaaggcaagcagtgtggttagacagaacaatagacaccagtaatcccagcatttaggaaactgaggccagcctggactacatagtgagttccaacttcaactacatagcagcttacatcagagcaacagtggagctggagagctggctcagcagttaaaagcaccggctgctctttcagaggaccagggtttgattccaggcacccacagggtgctcacaaccatctgtaactccagctccaggggatctggtgccctcttctggcttccacgggcaccaggcatgtgcaaggtgcacagacacatatgtaggcaaagcactcatatacatatacataaaatgaataaatctaaaaagaaacaaacaaaaaacattaaaagtccactcaggaggcttagggggaaggacacctcgaactacacagcaagaccctgcctccaacaaatagacagacagagggagaaattgaggttagtaaactgcttgccacaccaagcacaggacctgaactcaattgtgaaaacaacacatttaaaactctaggcgtaagccaaacttcagtgactcatgcctttaatgtcagcactcaagaggcaggggcaggcagatctctgagttcaaggccagagtgagttccaggatagttggggctactcagagtaaaatgattgcccaggacttgagttcaattgtgaaagcccacgttaaaacagcaggtccaggagtgggtaggtaggggagcagggttgggtgacggtataggggactttcggaatagcatttgaaatgtaaatggggggctggagagatggctcagcggttaagagcactgactgctcttctgaaggtcccgagttcaattcccagcaaccacatggtggctcacaaccatccgtaacaagaactggtgccctcttctggagtgtgtgaaatacagctacagtgtacttacatataataaataaataaatcttttaacaaaaaaaaaaaaaaaaagaaatgtaaatgaagaaaatatctaataaaaattgaaggaaaaaaaaaccagcaggcacagtgtggcctcgtctgtaactcacacactgagaatatatttacaagcacatccttggtgtttgctggcttctggtctgctaacctagaaatacagggcatcataagagactgttcaaaaaggaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcctcgaactcagaattctgcctgcctctgcctcccaagtgctgggattaaaggcatgcgccaccacgcctggcttgcttttttttttttttttttttaaagacaagggctctgtgtagccctggctgtccttcatctcactctgtagatcaggctggccttcaattcacagagatccacctgcctctgcctcccaaggcctgggattagaagtacgtgccaccactacccagccagcacacatatctttttaaagggggaaagacaaaagaaaaatgtgttttctagagttggtccactttgcaggtggaaggatcaaggctggataatgtcacttaattctctggaagtcacacaactaaagcgcagttggtaggatctgcacccaggtctccaaagcaaagagggatgaacaaattgatgtgggtgagagaggacaagggcctccacccagcctccctcttcataccagccaccttggttctcctgggtactttgactgagtgggccaggtttctttctcctcccctcctccccaggagaacttaggagcaatgcaggagacaggaaggaaggattggaacaggaacaaagagggtaggtgtttatatgagggaaagtggttagacagcaagcaggacttcccagccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctcacctcctcccttaggccctcacctcctcccttagaccctcacctcataccttagaccctcacctcctcccttaggccctcacctcctcccttagaccctcacctcctcccttaaattttacctccttccttaggccctaatctcttcctttagacactgtctgttccccatagacccttctccccaggcccttccgttccccctccattctcacacaggagaccctcaacaccatctctctcagcacctttcaacactgccgagtctagcacataacattttttttttttttttggtttttttgagacagggtttctctgtgtagccctggctgtcctggaactcactctgtagaccaggctggcctggaactcagaaatccgcctgtctctgcctcccgagtgctgggattaaaggcgtgggccaccacgcccggcgcacataacattttataccacctgctctagtcacgtaagggccaagccactgccctgcctgtcccaaggtggcaggcagtgtgagagtcacccctacaccctgcctgccccctgcctcagctttcctgtctgaactgtgctcagagctctccacctttcctttggattcgaaggacccagaggagtgggctatcagatgttgactccttaccctgccctgactgcatccctctcatgctggcgggcagaggtgacattgcctactgtccagaacagagtctcaagagagaagatgggggctgatgagatggctcagtgggtaagagcacccgactgctcttccaaaggtccggagttcaaatcccagcaaccacatggtggctcacaaccatctgtaacaagatctgacgccctcttctggagtgtctgaagacagctacagtgtacttatatataataaataaataaatctttaaaaaagagagagagagaagatggatgactgagttcacagagaaggtcactgaggtcgctggggacaggagctcaggggtctgatgtgacaggaaagagcactgtcattgagctgtaccccagcgctatcgtgttaggcatagaagacttttattcactcagtgtgtgtttgtgtgtgcacacggggcaggacatatggagaacagaggacaccagtgggagtcgtttgtctcctccaacccaagactgaacccaagtcattttgcttggtgactagcacctttatctgataagccacctcactggccacttctttcattttgggggccatgtagcccaggctagcttcaaactttttctgtaagtagctaaggctaggctttgtcctagccttcacctccatggtgttggaatactgagcctgcactatccaggctgcatttttgtttttgttttattttttactcttattattgaaatagagtctccacaagttgcccagttagccttcagctcactctgtagcccaggctagttgcaacctttctatactctttccttagctcctgagtacctcaaatatgcaactccccaggtggcttggaggtgagatttgaacacagatctcttcaaatcagtagccgctcccctgattcaccttaatggaacactatggggtggggtggggggtgaggcagccggagagacaaaaggcaatgggaagtggtaaggtcgcctggcacttcgaatcccacaaaccaggttaaccatccacctgggtgcggcctcagccggccaaagtcccttcacaactccacacccacttacacggtcccagagaagcaccacggagggcacagggacaaaaagggacagaaaaatggaggtggtgactctcacctgtaatttcagcacagaggcagaggcaagaagatcgcccctagttcgtggccagcctgggctaaagagagtctccttgcctggaaaaaaaaaaggagtcagggaacagaatgcagggccaggtttgtagagacacatgaacatccagagaaagaaccagaggaccctgagaatcctctgagcaggtttgccatgcggtgctattcccctgcctctctaagtctacaaagccgccccgcccccctccgcctccctgtgactcagtgacctggactcaaccccagtgtgtgctccacctcccgggatgtccgggaaagccccgagctgctgccccgccccggggcggacccggaggaggcggagcctctgccccgcctccccggctccagcgggtttgagtcagggccccaaccagcccggcctgttccccaccagccagcccctccttggggtgggaagggaagtggggaaagctgagggagtcaacctacaccccccaacccccacaattgtctggccttgagccctaagtgaggcctgctggtccaaactcttaactctccctatctacacttgcatctctcaggatctgtctccaaatctcttctctctctctgcatctgggattcattggcgtttcgttctttgaggcctctggctgggtgcagggacctggcaaggagacacattcagagctctcctgcacccctagctatcctgtgccctgcgagttaggaggcatgaggaaggcagagggtggctactttctgccaagaaccagtctctgccttgggctgggcttttctctcgcacaaagagtgagtctgggctcaccctgatggtgcagacctgcatcccacctcagacaggaagattcaggttctaagccatcctgggctacagaacaaaggcaaagccagtccgaacagcttagtcttaaaacggaacgcaaagagggctgggagatcgctcaagtgcacaagctcctaggctccagcattgcaaaaaggaaacggctcagagggagaagtgcatggccaaggtcacccaagaggaagtaggactcaggattcagacccatgccctagcaaccctgtggcctctaaggacttcagagttggcactaagggagatggctgaaagagtcagaaatactaaaggaaagatgggaccagtgggaggggaaggtgctcacaaaagtagaagcgatcgccagacacagccaagagattcagagatgggggatttgggggaggggcttagaagtatggatccctagcacgcaggagcccaccccccccaccagccaacagaaacgtttgccggttatggtgtcccaggcgagatgggaggtagaggagggaggatcaggagttcaaggtcatcttccgctacacagcaaatttaaggctagccttcgatccatggtccaagaaaaaagaaaggaaggaagaaaggaaggcaggcaggctggctggaaagatagatagatagatagatagatagatagatagatagatagatagatagatagatagatagatagacagacaaatagatcaaggcacagtagtgcaagtgtcatttcagcactcaggaggtcgaaacaggaggaacagaagttcaagaccaccctctactacatagtgagttcgagactagcctgggctacaggagctccagtctaacaaagcgagagacagacagaagatgtgagaatctcaaggactcagacccagacagagctcccggccagaggcacaatgagcagagtggcgggtggggaccaggagctccgcctccgagacgcgggtccaggaaacccctggggcggacgggtggccccgggggcccgggggcggggaggcgggaggcgggcgccgccccgactgacaaaagtcccttcagttcagtcggcggcaggggaagtcccgctgcccggcgagaccgccttcccgtgccgagctcgccgcacgccccggcgtctccgggcggcccgatgccccgatgccccgcgggggccatggacgaggggcccgtggacctgcgcacccggcccaagggcaccccgggcgccgcgctgccactccgcaaacgcccgctgcgccccgcgtccccagagcccgcaaccacgcgcagccccgctggacccctggacgccctgcgcagcggctgcgacgtcccggttgtccctgggcccccccactgtgtggccaggccggaggccctttactaccagggtgagtggcctcccccatgaaagtcagggccgggtgggggccacctaaggtcagcagaacacaggacacaaatagttggggttcctggtagctgggactccagggtgcaagttgatgacccaaagacagctaggaaagaggttgagaggccctggagctcagccatgggcgtgccaagaagttcacccaggcaggtgcccaagggtcaaatggccttggggaatgggggtcagaagacagcgtccagtgtcgcagatatgggatcccaagacactccagagacgcagaatatctggttgggagagaccagatgttcagaactatgaataatcgtcactcggaccttggaaactggggttctggtaagcagatatggggagatgaatagaaatggacccaggatccaaggaggctgatacggtaggttaaaatcctgggaaccgaggtcttagggcgatagtgactgcattctgcaggctagttgtgagcactcacaagtgtccctgggtcaggtggccctaggggcaggcttggggactgagggttctaagagagggaacacaaggaatttagaaactgaagggcttcggtccaaggagagggattcggggacctgggaaggggggactttagaaagggaaccccagagctggtcagacagcaagaaaccggatacctttctcttcaacttttatatccaggaagggacatccacctgcagtaggcacattactatctgctaaataccccagcgctgctgaggtctctgggccctccaggttcttcagctactacctatcatgctccagcaggaggacactatgtaacaagagaccttctccatctgatgagaaccctgccctccatttccccatctgtgcaatgacccttcccaacgttgtcatccaaaagggttctaaaggacaagttttctgacagccccaactccccagatcccctacacccagatattagcttgtcatttattccttcagctaattactcacagtgtaatcttataactgaagtcccctgctgggtggtgacagggctctctctgcccttaagggtccttctgtagatggaggtcagacatttgtgagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctgcatgcctgtaatcctagcatttgggaagctgaggcaggaggatctttttgagtttgaggccagtctgggctccatagtgacacaacgtttcaaagaagggatgggggccaaagaggtggtttagtggttaagagcctctggagctcttgcagaggactagagcttgtttccagcatccacatctttcagctcacagttctgagaatgcaatgccctcttctggcctctgagagggtcaggcaggcatgtggtacacactcaggcaaaacattcatatgcattaaaaaagtgaatacagccttaaaaagtagtgactaaaaatagatctttaaaaagtggggggggggttggggacaggggatatgactcagccattaaaagtattcactgtttttacagtgggcttgagttcagatcccagaaaaccatgttgtgaggacttaccactgcttgttaactccagtttaagaggatctggcgccctctaatggcatctgtgggcacacgcacaaatgtggtacacaaaacatacacagacacacacacacatacatagaaactttgaaaataaatctctattttttaaagaaaaaaaatctaatagtaggtgaagtgatacaggacagcactgaggagattcaggcaggaggaatcaagggttctaggttatcctcagctgtatttgatgttcaaggtcagcctgggctacataagattgagaatggggaatctgggaggatgctaagacctgaagagagagacccccctggacgaaggcctgtgggtttggcttcacccaggtctcctcttgtcttgctctaccaggacctttgatgcccatttactctaccccgacgatggccccccactttccgctgctgaacctgcctactcacccctactccatgatatgccccatggaacaccccctttcagctgatattgccatggccactcgggtggatgaggatggagacacgtaagtgacagggtctgggaggagctcagacctccaggacaggggatatcaggctctgccaccactgccactgccactgagcaacactctctgtctctgacacttggtttccttttacatacaatgggcacttaagagcactcactggctaaaactgctttggggggacagtgacttgttttctttttggttgtgggggtgggaaactgaaccttgtgcatgctccgtgcttgttctaacaggaagccacacccccaccctctcagaatttgtatcataatccaaatatgaaaactataagatgggcagtggtggtgcacgcctttaatcccagcacttgggaggcaaaggcaggcagatttctgagtttcgagtccagtctggtctacagagtgagttccaggacagccagggctaaacagagaaacctgtctcgaaaaacaaacaaacaaaaactatatatctttattttcacttcttttactgttatttatatgggtgcttgtccctgtgagcttctgtgcactgtgtgtgtatccctggtgcctgaggaggccagaagaagccattgggtccccctgcccccagaaatggagttatagatgctgtaagcttctatgggtcctctggaagagcactcattgctcctaaccactgagccagctttctagcccctatcccatttttgagtcaagatctcactatgtggccctaacttgtctgaaactcattctgtaggtcaggctagcctcaaactcacgtagatatgccttcatctgcctcctgagtgctaggatcaaaggtgcgcgctgccacacccagctctgggaactgttttatctgctgattttgtggaggtgtcacacacacacatgtgagaagggagtctggtgtgtcgtacatcatgtgtccagtaaacttcagctagagcgccctgtgcatacccgtaagcctcgttctggggaggctaagggtagagactgaagaattcatgagttcacagccagcctggactagaaaaacaaaaggaggggctggggatgcagcatagttgagagtgcttgcttgagtagcaggcagaggaggcccaggttccagcccagccccgcagaagccacctgagtgttgtttagcatcattgttgttcctgtgtagtgggtgagctcacaggggtccgtgcacactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgcaaagactcacacaggggggaaacagggaaatcatgaaaacactatggtggaggggttggtgagatggtttagagagcagaggatctatctgtatgcaagcctcacaacttgagtttgatccccaataccaacatggtgggggaagacagaactgacctctgacctccacacatgttctgtcgaaaaaaatgcacacacagtaattgcatacacacatgcttgaacggatagcaaagaaacaaagctaggtatcagtggtggacacatttaatcccagtccccgtgtggcagaggcaggtggatctgagttcaaggccagcctggtctctggagcgagttccatgctatcggtcaaaccaagatctggttttagcagaaataaataaaagtttaaaagtagagtggagagcttgagggaagacagtgacacacacaggacacatgctcacgtgtgcaccacactcacaaatatgaaaaacaaaggccaggaggcatgagagcatgcggccagcctgtctccccctgtccccacgtacatatgtgatccttctgtttgccctcagctgggaatggttattctagtctgggatccctggaaagagagcaggtgctttagtggggatgtcgctgagggatctgaagagggcttcaggtgccccacaggaaatggtggagcaatgtggcctccctagatgagggattgggaaattggaacagtgatcacctctaggcatcattgggtgagtagctctctccagtaaagataactgccatgctgtatgtaaaggaaggcctcaaggagctggggtgtggatccttcacgctataaggacattctaaactgccaaacccagctccagagccatgacccacttcccacatggttccttcctccttattttattcttctgagatagctctcactccgcagccctgtctggttggagctcactaggtaggccagggcagtgtcaaacacagagaacctccttcctctgcctcaggacagctaggtttaaaagtgtgagtcaccaggtgggcagtggtgtcacatgactttaatcccaggcagaggcaggtggctgtctgtgagttcaaggctagccaggcctcactgagaaaccctgtctggaaaaacaaacagcatgggacccaccatacctggcccttccacagacagccctggaaggctgaacctgatatgaggcagagacctgaccacgagtttgcatgcctcacttcacagataaggaagctatggccccggggaggctggggaagtagtcacgaagcactcagggtgacatatgggatagatacctgtcatcagcacatagtcacagcacacttgttctctgtcagagcctcctaagctctggacagggaacggcatctgcccagtggggccgacattattttgatggggagattcaggaagaaaatggtgacaaacttgacaatgaaccacagagcaacctggaagcaactatggtagacgaaaggagaaggcatgtgggtctgccatagtacctcagcagaggcagggatgagggtggtaagccctatagatatctaaggaacctgttccgggcacactgaagaacctacaaaaaggtcccaggaagtaagtgtggctggtatgtcttaggtgcaaggaggccaatgtgttcagagcagaaggaagagagagtgtggagagatgctgtcaaaggaaatggaagaggaagacaagatgacttagccttgcaaggcggaggcaggagaattgacaatttgaagccactctgagctacatacgtagacccacactcactcacacttgtgatgtcaagcctgtaatcaggagacaggaggattatcacagagttgaggacagcctgggacattgagtgagatcagggacagcctgtgttatatactaaaatcctgtcaggaaaaaaaaatcctgtgaaaactagggcgtggctcagtggtagagcttttgcctagaatcccccaatgaagggctgggggcgtggctcagtggtacagcccctgcctagaatcccccagggaagggctggggggtgtggctcagtgctagagctcctgcctagaatcccccagtgaggggctgggggcgtggctcagtgctagagcccctgcttagccagtagaagggttttgttcctagcaccactgaaaccaaacactatccagttttttactaactcacatgggacctgtgatcaagttagcagttggaggaagatgtatctgaaaatgttcctctggctttgatgtgacagtctgacagggcaaatagaagccagagagctcaggggctgggaggcaggagttggggggctgtaattaatgtccaagaaagcgaatttgggctgttcccaggtggttaaaaatgaccaaaagcaccccaccatgactttcaacaatccagtgaccagcccctaatcccagcgactgtcccatcgtcccctcaggcctctccacatcgctgtggtccagaataacatagccgctgtctaccgaatactcagccttttcaagcttgggagccgcgaagtagacgtccataacaacctgcggcaggtgaggtggccgggagttgggcaccgcgaaggaggggtccccagaggaaggatgcaggggagccagcatccacatcctgggacaagagggcagtggagctgggcatggtggcatacagctgtcattcagcatttgggagactaaacatgaactgaacgtgagcaatggagagcttgcctgagctatactacagcaaaatggtgtctaaaaacaaacaaaaacaacctgtgggggcagtgagatgactcaaccggtaaaggtgcttgccgccaagcttggtgacctgagttcgaaactcactacaacttatccctcaacctccacaagtgtactatggcacacacgtgctcacacacccatataaagtaaataaatgtttaaaatcgaagcaaacaaaaccaaaaccagcgtggcagctcactcctttggtctcaggaatttgaagtcatccatcctatctacatagcaagtctgaagtcatcatgggctacttgacatcctatctcccaacatttccccccatccaaaaacagaaaagaaaaagaagctttattgaagttagacttttgggttctgaggaagacgaaagagtctctgactctcttgaatcgggagaggtgtcgcgtaggcttctatccctagattcaaaaagcctgaggtgagagcacagctttactctgatccctcactgtcactattccccagaccccgctccacctggctgtcatcaccacattaccagacatggtccggctcttggtgacagctggtgccagccccatggccctggatcgtcacggccagactgcaattcacctggcatgcgagcaccgcagccccagctgcctgcaggccctgctggacagcgcaacctcaggctccgtggacctggaggttcgcaattatgaaggtgagtccccagaggggacaaggtgaggttgacaccattcaagcccaagccggggtttgactgactgtggcttccccttcttcaagggctcactgccctgcacgtggccgtgaacaccgggtgccaggaggctgttctgctgctcctggagcgtggcgcggacatcgatgcagtggtgagccaaccaggcagccggcgaggggcgtggtctggcgcgtggaggtgtggctcaggaggcggagctagcgaagggcgccagggtggcagaaatgttcacgtagttaaggcgctggaggctggaccagagggagggatgctcagagccttcagagagagactgaaacacctgtcctctcgcaggatatcaagagcggccgctccccactcatccacgccgtggagaacaacagcctgaacatggtgcaactcctgctgctggttagtacccatctttggcttcttccatgtctggcgccaatccatcttgtcacttctactcctggcatggaccccattttccaattcaaaccctggttgctgttctgcctctgactcggattcttctcttcagtatctcatttgcaactccaagtttgtttgtttgtgaaagggtcttactctatagagttgactagcgtgcaatccaactcgcttcatagcccaggctggcctctaactcagagatccacctgcctctgcctctgcctcccaagtactgggattaacagtgtgcaccaccaccacccagctttcttttttgattatacgtgggtgttttgcctgcatataagtctgtgcacccggtacctccagtgtcctctgaggccaaaagagagcatcagagtccctagaactggaatcacaaacgtttgtaagctgccatgtgaatgctggaattcaaacgccgtttttctggaagaccagccagtgctcttaaccaatgagccatctctttatccctcaagacttttttttttaatttggggggctttgggggatgtttcgttttgtttttgagatagagtcccactacagagccctggctgtcccataactcattatgtagaccaggctagcctttaactcagagatcttcctgcctctgcttcccaagtgtttgggattgaaggggtatgccaccatacctggactgttttaaaaatcagatttggttggctatattgtggaggtcagagggcagtgtgtgggcatcagaagtcctctccttccatcatgtgagccctggggatggagctcaggtcagtcctgacagcaggcccctttacctgatgagccatctatcagcacgcatggctggttttcaagtcttttatttcacttcctgggatgccaatttgtccattcctgttgccctgccagcctaggcttcgctttgggatgccatactaaccctgcctctgtctttcaccatgtcctctgtccttctgccctaattccatctataccatctggagtcacagaccttttcctcccttgcataactggaccacagtctctcctagagactaggagagggccgatttctcctagcttccctccttggagtcccatgtagccaaggcatttcaacacactttttagctcaggttaaccttgacctcctgatcttcatgcattcactctccaagtgctaggattacagacctacgtcatttttgacacagccccatgtccagaatcatttcaggttctagctgtcggaatgagccctagttgtgatcacctgtccgtccccttcacctagctgacgccaggccaagcgaggccattggcccacgtgactcttgactcgaatttctccgtcccacagcacggcgccaacgtgaacgctcagatgtattctggcagctcggctctgcattctgcgtctggccgcgggcttctgcctctggtgcgcacgctggtgcgcagcggggctgacagcggcctcaagaactgtcacaatgacacacctctcatggtggcgcgcagccgcagggtgagagcactgggcccggccccggatgtacgcaggcctggggagggtcagtgagcttaggccggcaaggtaacaaaagtgcccggaagggaggctgtgaggagaaactgagtcacaaagcaaaggaagtgtctacacatcctcaccgggacactttggtcgagggaggggagaaaggggaagaaagaatgaataaaggtcgcaatggctttggggtgaccttcattttcccacaggtcattgatatcttaagggggaaggcctctcgggctgcttcagggtcacagcctgagccatccccagaccaaagtgccaccaactcccccgagagcagcagtcgtctcagctccaatggtgagagtctgcacctgggagccttggggaccctagagcagctcagcaggcttctccctgccctaaccctggtctccctccacaggcctccagtcctcgccaagctcctcaccctcgctgtctcccccgaaagatgctcctggcttccccgcgactccccaaaactttttccttcccacaacatctacacctgccttcctgcccttcccaggagtcctccgaggccctggccggcccgtacccccttccccagctccaggaagcagctgagacggatgggggggcagacccggactcatgaggaggggcctccccgccctgtggggaccactcttctggaaactgtgaggaccttgttctgcttccccccgcccaatcctcgggaccaggttttgcaccaaggcacatgcacatactactgagcacagatcctcccaatcgcgccccttgcccaggactctcagcccccacttaatctcaggcacccaggttccctgtctggaatccaccagatactcaattctttgagtggaggaaccaaaggacagccagcctctcctctgccaccctccaccctgagggacccagagaaacagaggggtctgggagggcattgatcacagtgtaaattattaggtttgggtcagatttcttttgtaataaactatttttgtatcatatcccttgctttccatctgttgtaaccaagtgtggcaccaggtgcttgtgggtgccgacctgcctgcccactgagtgactctgaatcacattctgctggggcaaggggtctagggctggtaacggctttggtggtgatgtgaactagtaggacactgtgacagcttcctcagagatgctatatggttccagaatgttctggctgtggatatttctgagggactctgcaatttgtgtgtcaccacggtatttggatttaaagaagcatttgtgtgtgtgtgtgtgtgtgtgtgtgtgtgtgtgtgtgtgtgtatttatatcattcatatatgtgatatatgactatatatatgattacaatatatacttatgttatatgacatatataatggatagtttgatataatatatatttacatcacatattacaagcataatagatacttatatatataatatgcaatattagtatatattgtatattaaatgtattatgtaatataatatattatacagttataatatacttatatataagtatatctagtatacttatatataagtatatctaatatacttataattataattgtttttatagataattatatatcttattaatatattatataatatatagtatcatatatgttaatattatatgtttatgatatttttaaatattacctaatatataagtataatatttaaattataattacttacaactatatatataccatataagtatattatatagctatataaagtctaacatacaatattatatacaaattataaaaacataataaatatataatatatacatatattaatatataatgtgtatacacatatacatatggaggtcagaggacaacttttagcaatcaggtctccttccatcctgtgggctctgggaactgaactctgggccttaggcttggcagcacatgtcatcacctacagaaccatctccagtcagccccagttttgttttttgttttaattttgttaagttttggtgattttgagacagagtctcatgtagcactggccagtctctaactcactctgtgaccaaggaagagaataaacttttgaccctccaactccaaagcctcaagattacagacttgcagacatatggcaacacacagttnnnnnnnnnnnnnnnnnnnnctcctcctccccccttatcttgagactctcaatcctgctgcctccccatcctgagtttcaggattatgggctgaggctgagagctgactttgaggcagtctctcagtggtaccatctagtcttgtgctgagtggaaataagaaggtagagtctgagagtctgagatgagaacatagctgagttttatggggctggggggcaggtagttgagatggggctctcttttccatctggcaagccctaagatcacaagagtgtgctgctatggccactgtagctttaattcccgagttgtgacacaacaacgacaacaacagctgagccccaaacagtagtttagcggggcttgctgactcaagcctacaatctcattgctctgaaagctgagggaggagaatggtgagtggaagccaacctgaattacagtggtgagaccctgttatgagagacaggaggagctggagacatgattcaagaggttaagagcccctgcagctcttcaagaaggctcaggtccaggttctgttcccagcacccacatagtggcgctcaacactctaactctagatcctgtagatctgatgctctcttctggcctccatgggcactgcatgggctgcacagaaattcatgcagacaagacacggataaacataaagtaaaatttcagaagacagacagagccgagcgtggtggtacacacctttaatcccagcacttgtgaggcagaggcaggcggatttctgagttcgaggccagcctggtctacaaagtgagttccaggacagccaaacctacacagagaaaccttgtctcgaaaacaacaacaacaaaaccaaacaaacaaaaaagacagacggaaggcctgatgtggtggcacatgcctttaatcccagtactcgggaggcagaggcaggcaaatatctaagtttgaggccagcctggtctacagagcaagttgcaggttagccagagctacacagagaaaaccctgtgacagaactccaacccctccccctgaacatacatacatacacacacacacacacacacacacatacacacatgaaaaaaagaaagatggaaggaaggaaatggaagagaaagggaaggaaagccagtgtggcggtgtatccctccttataagcccagttcctaggaagcagaggcagaggcaggaaaatcaatgccagttcaaaggccagaaatcaaaactaaagcagtgctgcccagatggcttggagggtaaaggcattcgcttccaagcctgaagcctgaagttcactcttcaggacccagatggaagaaagaaagaacccagacctgtaacttgtccaccagggccaactatggcattgttcacacacgtgtgcatacacacaaaatgaaccaatagacacaacaaaaacttaaaaagaaatgtagatagatagatagatagatagatagatagatagatagatagataaaaaacaggacccccaaaagtctatgcccttgttcttcaaacccatacatcaaataccttagaatgaatttagtcacacagccacacctaacaaacacctaagcatgcaggtaaatgtagttttggggaaaaaattttacgcttatttacttgtggagatggggtcagagtgcacagcacacggccaatggttgtctacttctactgtgtgggtcccaggatcaaatttagggccccaggcttggggacaagtgcctttttctttacaaaagaagcttggttttatcttgggaggacacacccaagtaaaactcacaagttctgcttctaaaggaaaagaagaaagtggacggggagatgctgcagcaagggcagaggctcatgacttgagtttggtccccaacaccacaaaagactatcatggtatcacacactgaatcccagcactctggagacgaaggcaggaggatcaaggggatttgttgcctacactttgagctcaaggccaggctgggccacacgagaacccccctcccagttccaccaaagtgaagataccaagcctgtcacacctgaccagagctctgtccaaaccactcctccaacatggccaagttaacttcaacacccaggccttactttactactctctgccatgagagtcagagctcagcacagccatggccctgcaaactggaaacttctacagactgtgggtgatgagaaactggggttcaatggctgaccttagcaaactagttccctaaaacaaaggatctggcttctccatgcatggaaatcccctctctggcctccctgaccttgacactggacatgtgtccttccatgtcccctggagataggcaaagccagagggagaaagagggtagggccctatgtgggagtctccagcattgaatattggtgatagtctcagcagactgtgactgcatccaaagttatagattcagcaccttgacttatgcaaacatgtgggtgtctgtgtgtcatatgtgtgcatgtacacaaggagccttgagcttaggtgtgtttacatgcagtctcataaacccaacctgcattccacagattgagccagatgtgtgccagcacacacctctaaccccagcactcagaaggatgaggcaggaggattttgtgctcaagcttaacctgggctacagggtgagactacgatgaaaagcagagaacagaagggacaggcaggaaggctccgggggttgaagtacttgctttgcaagcttgacagctgagctccaatcctagaagtcacacaaaaagagccaaatcctgggccagcaaggtagctcataagtaaagatgtgtgccgctaagcctgagggaattgagtaggaagagagaaccaacttttgcaagttgtcctctgaccctcacacgtacactgcgacacagatggatggagacggggggggggggaagcggtgagtatcaaactggatgctaaagtgtgtatctgtaatcccaacattactaatgcaaagtgggaggccaaatcagaagaatctcctggaagctcgagatcaccacctagtggcagcacacagaacagcagcagagccagtgaaaggtgggaatcactcctgaaaaagtcctctgacttccacactgggtgtgcgcacactaacaatacaacccaacacacacacacacacacgatatatatatatatatagatagatagatagatagatagatagatagatagatagatagatagatagatagatagatagatagacagacagacagacagacatgaaagggaaaggagagaaaaggtgaaaagaggactctgaggcacaaaatgggtagacactggcttgctgagtcttcattgtttttgtgtgttctcttttacttcgttaaggtggggctcagcagaaagtccaggtttttgtttggttgtttttggttggtgtttgtctgtttgtttgtttgtttgtttgtttctgagacaaagtttctctgtgcagccctggctgtcctgaagctctctctgtagaccaggctagcctcaagctcacagagatccacctgcgtctgcctcccaagtgctggaattaaaagtgagcaccaccactgcctggtgtagttttttctttgcaataaaataaagaagaaagttctgtttataggatttctaaatcagggccagggcggtggctcagggggaaaagacacttgtcgtgaaggtcatctgagttcagatccccagaacccatggggaaggcagatgtggcagcactcacctgtcacctgtaccatgtcatccacatatccccatccaaaacacggacacgacttcgtattttacacaaggataaaaagattgctaagtctgcactcatctgagtccagtctggagagctggtgtaagtgtgtgatttactgctttggaatgagagagggcaagagcaccaggctaggcatggtggttgtcttagtcagggtttctattcctgcaaaaacatcacaaccaggaagcaagttggggaggaaaggctttattcagcttacactttgcacattgctgttcatcaccaaaggatgtctggactgaaactcaagcaggtttgggaagtaggagctgatgcagaggccataaagggatgttccttactggcttgcttcccctggcttactcagcctgctctcttatagaaccaagactaccagcccagagatggtaccacccacaatggatcctccccacttgatcactaattgagaaaatatcttacactggatctcatggaggcatttcctcacctgaagctcctttctctgtgataactccagattgtgtcaagttgacacacaagaccagccagtacagtggtgtacacatgtcatgacagcactttgaagatggaggcaggaggattaagaaatcaaagccaggcggggcggtggtggcacatgcttttaatcccagcactcgggagacagaggcaggcagatttctgagtccgaggccagcctggtctacagagtgagttccaggacagccagggctacacagagaaaccctgcctcaaaaaaaaaaaaaaaaaaaaaagaagaagaagaaaagaaaaggaaggaaggaaggaagggaggaaggaaggaaggaagaaatcaaagccaggagctggagagatggctcagtggttaagaacactgactgttcttccagaggtcctgagttcaattgccagcaaccatatggtagctcttaaccatctccaatgggacccaatgccctcttctagtgtgtcggaagacagctgcagtgtatactcttataaataaaataaatatatcttttttaaaagaaaaagagaaagaaatcaaggccaaccttggctatgaagaaagtgtaagggtagcctgagctacataacagggtggggaggagaccaggtggtggtggcacacacttttaatcccagcactctgaaggcagataggcaagtggatgtctgagagttcaaggccagcctggtatacaatgtgattccaagacaaccaggactgcagaggaaaaaacattaaaaaaaaatagtgtgcgggggtggagggactagcataggaagaaaaactgaattgaaggtgtgagcaagggtttgggttatgactctgtttagggttggagtttgagtcaacagcatccagaggcatgggagtgtggcctcagatcccaatcaagggaggcaggaaggttgttctcagtgtgccctctagtggtcaggatcaattcaggccctcatttaagctcctatgaggtctaaatcaatccaagtgtgctgtgtcattatcctctcagactttctcagctccgccaaggcacacacctgtcagtcacctggacactgaggaggcacacacctgttagtcacctgggcactgaggagacacacacctgtcagtcacctgggcattgaggaggcacacacctgtcagtcacctgggcactgcagaggcacaaacctgtcagtcatctgggcactgcagaggcacacacctgtcagtcacctgggcactgaggatacacacacctgtcagtcacctgggcactgaggatacacacacctgtcagtcacctgggcactgaggaggcacacacctgtcagtcacctgggcactgcagaggcacaaacctgtcagtcacctgggcactgtggaggcacacacctgtcagtcacctgggcactgaggaggcacacacctgtcagtcatctgggcactgaggaggcacacacctgttagtcacctgggcactgaggaggcacacacctgtcagtcacctgggcactgcagaggcacaaacctgtcagtcacctgggcactgaggaggcacacacctgtcagtcacctgggcactgcagaggcacaaacctgtcagtcatctgggcactgcagaggcacacacctgtcagtcacctgggcactgaggatacacacacctgtcagtcacctgggcactgaggaggcacacacctgtcagtcacctgggcactgatgacaccagtcatctcagcacttccaaggctaaaagatatcactgacagtgtgaggccagcctgaaatatgtacagtgacatatgtagtcctgaccgtcctggaccacatgcttacaaataaaaggctggagagagatctcagtgcttaagagcattggctgctctagaagaggaccagggttcaattctcagcacccacatggtgatccacaaccatttccagttccaggagatccacgggtactgcatgcaggtggtacatgcaaaattcatgtacacacaaaacaaattatttaaaaattaaaaaaaagggggggctggtgagatggctcagtgggtaagagcacccgactgctcttccgaaggtccagagttcaaatcccagcaaccacatggtggctcacaaccatccgtaacaagatctgactccctcttctggtgtgtctgaagacagctacagtgtacttacatataataataaataagtctttaaaaaaataaataaataataaataaataaaaataaaaataaagaatgatggtacagctgtctcctgaggagctctgccagtgcctggcaaatacagaagtggatgctcacagccatccattggatggagcacagggtccccaatgaaggagccagagaaagtacccaaggagctgaagaggtttgcagccccataggaggaacaacaatatgaactaaccagtatccccagagctcactgggactaaaccaccaatcaaagaaagcacatggtgggactcatgtctctagctgcatatgtagcagtggcctagtctgtcatcaatgggaggagaggcccttggtcctgtgaaggttctgtgccccagtacaggggaatgccagggccaggaagtgggagtgggtgggttggggagcagggcgaggggggacgggataggggattttcggagaggaaactaggaaaggggataacatttgaaatataaatttaaaaaaatataagtaaaaagaaagaaagaaggcgagagctggaatgatggcccaacagttaagagtgcttctggcacttgcagaggctggtggatttctatacctctggaagcttgaggctagcctgttctacatgggctatactaataaaagaaagaaaagtgaaaagaaacccattgttagttcctgtcttttcccatatactaatgaccctaaatatatcatcagtggtattacatattattaattacaagttaaattacaaattaaaacataatacatattatatttttttggttggttggtgttttttgttgttggttttttttgtttttgtttttgtttttgtttttgtttttgtttttgttgtttgagacagggtttctctgcgtagccctggctgtcctggaactcactctgtagaccagactcgcctcgaactcagaaatctgcttatctctgcctcccaagtgctgggattaaaggcgtgcgccaccactgcctgactatattttaatttttaaagtcacctattctgtatatttcataggaatagaatcataccatacatagtattttaattttggtcattttattggggaaggaatgaggcaggtgatcacatagcccaaaccaaatctacgaacttgatatgtagatgaagtagactttgaactggtaatttccctgcctcctcttcccaagttaacaggcacaggtcactataattcatgtctgtgattctgggggtggaacccagggctttttatgttctggacaaacattcaccaactgagctacatcccaacccagccccaaagatcccaaagatgggccttctgttaggttttgtttgtgtgtgtgtgtgtgtgtgtgtgtgtgtgtgtgtgtgtgtgtgtgttggggatggattgggtggtttgggagaagtttgtttttctttgggtttatgtctgtttatttacgtgcgtgcatgactgtggacacatgtggaggtcagaggacagctcatattactcccttctctcctgccactctgtgggttctgagaaccaaattcaggctgtcaggattggtgaggagcactttcacccaatgagccaaattcccaaccccgttcggttgttagaaacagaaccttgctttgtagcccaggctggaccataactcaacatctttgttctcttcttcctgaataattaggtttaaaattatctgaaaacacattcaacttcaattttttatgtttgtttgtttgtttgttttggagacaggatttctctgtgtaactctggcttacctggaactctcaatgtgtagaccaggctggctctaaatcagaaattagtctccctctgactccatcgtgctgggatttttttttttttaataataaaagatattgtaccaggcatgccccgtgcctttagtccaagcatttgggaggcagaggcagacagatctctgtgagcttgatgccagcctggtctacagagagagttccaggacgcccagggttgtatggtgagatactgtctaaaaaaacaaagctagaacaacaaagtgtgtgtgtgtgtgtgtgtgtgtgtgtgtgtgtgtgtgtgcttacccagggtgtcttcagaggacagaggcttcagatctcctggatctggagtttttgccaaacagggagggagaggaagggagaggaagggagaaggagagagtgagagagcaggcaggctgaggagtcagtaccgggcctagctggggtggtggctggcttgctggatgccctgggtgccctggggcagagagaaccgtgtccacggcgccctctggtgg

SEQ ID NO: 1508 - DNA, 1734 bp, Mus musculus
atggacgaggggcccgtggacctgcgcacccggcccaagggcaccccgggcgccgcgctgccactccgcaaacgcccgctgcgccccgcgtccccagagcccgcaaccacgcgcagccccgctggacccctggacgccctgcgcagcggctgcgacgtcccggttgtccctgggcccccccactgtgtggccaggccggaggccctttactaccagggacctttgatgcccatttactctaccccgacgatggccccccactttccgctgctgaacctgcctactcacccctactccatgatatgccccatggaacaccccctttcagctgatattgccatggccactcgggtggatgaggatggagacacgcctctccacatcgctgtggtccagaataacatagccgctgtctaccgaatactcagccttttcaagcttgggagccgcgaagtagacgtccataacaacctgcggcagaccccgctccacctggctgtcatcaccacattaccagacatggtccggctcttggtgacagctggtgccagccccatggccctggatcgtcacggccagactgcaattcacctggcatgcgagcaccgcagccccagctgcctgcaggccctgctggacagcgcaacctcaggctccgtggacctggaggttcgcaattatgaagggctcactgccctgcacgtggccgtgaacaccgggtgccaggaggctgttctgctgctcctggagcgtggcgcggacatcgatgcagtggatatcaagagcggccgctccccactcatccacgccgtggagaacaacagcctgaacatggtgcaactcctgctgctgcacggcgccaacgtgaacgctcagatgtattctggcagctcggctctgcattctgcgtctggccgcgggcttctgcctctggtgcgcacgctggtgcgcagcggggctgacagcggcctcaagaactgtcacaatgacacacctctcatggtggcgcgcagccgcagggtcattgatatcttaagggggaaggcctctcgggctgcttcagggtcacagcctgagccatccccagaccaaagtgccaccaactcccccgagagcagcagtcgtctcagctccaatggcctccagtcctcgccaagctcctcaccctcgctgtctcccccgaaagatgctcctggcttccccgcgactccccaaaactttttccttcccacaacatctacacctgccttcctgcccttcccaggagtcctccgaggccctggccggcccgtacccccttccccagctccaggaagcagctgagacggatgggggggcagacccggactcatgaggaggggcctccccgccctgtggggaccactcttctggaaactgtgaggaccttgttctgcttccccccgcccaatcctcgggaccaggttttgcaccaaggcacatgcacatactactgagcacagatcctcccaatcgcgccccttgcccaggactctcagcccccacttaatctcaggcacccaggttccctgtctggaatccaccagatactcaattctttgagtggaggaaccaaaggacagccagcctctcctctgccaccctccaccctgagggacccagagaaacagaggggtctgggagggcattgatcacagtgtaaattattaggtttgggtcagatttcttttgtaataaactatttttgtatcatat

SEQ ID NO: 1509 - protein, 440 aa, Mus musculus
MDEGPVDLRTRPKGTPGAALPLRKRPLRPASPEPATTRSPAGPLDALRSGCDVPVVPGPPHCVARPEALYYQGPLMPIYSTPTMAPHFPLLNLPTHPYSMICPMEHPLSADIAMATRVDEDGDTPLHIAVVQNNIAAVYRILSLFKLGSREVDVHNNLRQTPLHLAVITTLPDMVRLLVTAGASPMALDRHGQTAIHLACEHRSPSCLQALLDSATSGSVDLEVRNYEGLTALHVAVNTGCQEAVLLLLERGADIDAVDIKSGRSPLIHAVENNSLNMVQLLLLHGANVNAQMYSGSSALHSASGRGLLPLVRTLVRSGADSGLKNCHNDTPLMVARSRRVIDILRGKASRAASGSQPEPSPDQSATNSPESSSRLSSNGLQSSPSSSPSLSPPKDAPGFPATPQNFFLPTTSTPAFLPFPGVLRGPGRPVPPSPAPGSS

SEQ ID NO: 1510 - DNA, 31277 bp, Homo sapiens
  misc_feature (1)...(31277): n = A,T,C or G
ctagtcctgaacccagatgccccatgcatcttcacggaaccgatgggagaagcaaaatccacttttagagatatctaatctgtgaagaagtcacactttcattctcagggagattctgatctgatggaggaggaagaatgcaattcaaaccctcaaggaactcttacactgatgggaaacatgtccccaccttgggggcctccaagtctgatggcagaggtcttcctcccatccttgggaagctctagtccaatgagggaggcactcccccaccatgtcagtgccttccttcccgtaccttctccctgccctctggctgcccgaatgagcagggcagggggcttcccctccccacctccctggtgaatcctagaatcagggaacttctgcaggaggacaccacggttccccagccctgggacttccctttctccgtcagcccaaacccagggcctcactgggggggccagacatgcctgccctgctgatcatggctcacctatcaccccagcccccatgacatcacctggttattgcatgtccacagcatcccaggctccgcggggactttccatgcttgacctcgccagtgccctaccctgagagggaggagtctgtccccactttacaaacaaagcttagagggcatggcactcttgccagagaccacacagccagaaactggcagagtggggaacagaccaagtgggtctgactccagagccccagctccttaggaatgaggatgaggatgatgtacgtatacagtcctcattttctgccaggcaatcctgccaagggctatattgctgactcactagctcttctcggccatggtgttattattctcattgtcattattctgtaactcagacagggaaactgaggcccaaagagatagatgagtatgtagcagagccaatactcagtcaggttgtctgactccagtgccatcatcacagctcagctcccccagaagacagatgattatacggaattgggcatgcgaaagatttatggaccagcctgggaaacgtagcaaaatcccatttctgcagaaattttcgaaattagccaggcatggcttggtgcggtggctcacgcctgtaatcccagcactttgggaggctgaggctggcagatcacctgaggtcaggagtttgagaccagcctgaccaacatcgagaaaccccgtctctactaaaaatacaaaattagccaggcgtggtggcacatgcctgtaatcccagctactcgggaggctgaggcaggagaatcgcttgaacccaggaagcagaggttgcggtgagctgagatcccgccattgcactccagcctgggcaacaagagcgaaactccgtctcaaaaaacaaaaagaaaaagaaattagccaggcatgatgacacacacttatagtcccagctactcaggaggccgaggtgggaggatcacgcctgtggtcctagctactcaggaggctgaggtgggagaatcgcttgagcccaggaggctaagactgcaatgagctatgatcgcaccactgcacctcagcctcagcctgggcaacagagtgagaccctgtctcttacatacatatatatctcttaaatacacacacacacacacacacacacacacacatatcttaaatatatatatgtgtgtatatatatacatacgtgtgtgtgtatatatatacacacacatatacatatatatacacatatatacgtatatgtgtgtgtatatatatgtgtgtgtgtatatatatgtgtgtgtgtgttgtgtgtgtgtgtatctatctatatatatatatatgcagggcacagcacctcagaaaggaaaggaggaagcaagaggagtgagcaagggggactgtcaagttgtaatgccccccctacaggaaggctcttgcattagagaagtcccaccctggtcagaaatggctagcacctctgaaccccacctgtcattggctggagactgcccaggagaccatgccccagccggtaagctgaagcagacctcaaaggagtcaactgccaatgtcagaggctgtctgctctctctgcatgcctggcagcaagatcaaaagtccgttttttttgtttgttttgttttgtttttttaaatttctgagacagggtctcactctgttacccagggtggagtgcagtggcatgatcatagctcactgcagcctcagccccccaggctcaggcaatcctcccgcctcagcctcccaagtagctgggaccacaggctcaccaccaccatgccaggctaatttttatatttttttgtagaggccaggcatggtggcttatgcctgtaataccagcactttggggggctgaggcaggaggatcacttaaggtcaggagtttgagaccagcctggccaacatggcgaaaccccatctctactaaaaatacaaaaattatccaggattggtggcatatgcctgtagtcccagccacttgggaggctgaggcaggagaaccacttgaacccaggaggcaggggttgctgcaccactgcactccagcctgggtaacaaagtgaaactttgtctcaaaaaaaaaaaatttgctgggcatggtagtatgtgcctgtagtcccagctacttgggaggctgagccaggagaatctcttgagtctgggaggcggaggttgcagtgagccgagatcacaccactgcactccagcctgggcaacagaacaagactctgtctcaaaaaaaaaaaaaatgtacttttttgtagagacggggtcttgttctgttgcccaggctggtctcgaactcctgggcccaggtgattctcccatcctggcctcccaaagcactgggattagagggatgtgccgccacacccagccaacaggttttttcttgaagggggatgtgagctgcctgtctctgtggctgccactcccatacctatatgaataataacaatcattttaaaataatatcttccatttactgagactttcctctgtgccaggcctgtgctgacgtgtgtgaattcatttgactctcacaacaccgccggaagacatgcactgtttttaccctcattttatagatgaggaaactggggctcagagagggtaaataaatcacctgcccagggtcacacagctggtaagtgacagaactgggattggaacccaaacaattagacagggccccattcacagatgaggacactagcccactagtacctgattgtctactgtcacctcgctgagaccactgtgaccttccttcctatgccccgccttcccagacccccatccacccacccagggcagatgctgatctccacactccccccaccgaatcacccctctctgatcaaggcagctggcaggggcggcggagggggtggggggacgagggtgtccagtctccctggcctgccaagagaggatgtcgcaatcctctgactcagcgtcgtgcgtgcagacccagcaagaggcagaaaggggaagattaagtcttggcttaggccccagatgggctgattctgctcaatgccaggagctcccagagctgccaaggctccagggtggggaggaaccaggaggtgcaggccatgctccaggaagctggcccgcattcacccgtgggggtgggggcagagcagcctcagggagcggagccgtgtggacttccagcccagggcccagactggaggcagcctgaccttgggcatgtcccttcccatccaggcccagagtctctgtatccttctgtctgcggaattcacttgctctccctgaacctctctggaggctctagtggttgttcctcctcaagggactcttaagtctaactctatttttttttcttttttgtttgagacagggtcttgctctgccacccaggctggagcgcagtggcacgatctcagcccactgcaacctcggcctcctgggttcaagcgattctcctgcctcagcctcccgtgtagctggcattacaggcgcccaccaccacgcccggctaagttttgtatttttagtagagacggggtttcgccttgttggccaggctggtcttgaattcctgacctcagatgaccctccagtctcagcctctcaaagtgctgggattacaggcgtgagtcaccatgcccggccccttaagtctaactctattccctcctgctgcaatgccatcctctctccacgcacggaccctccccataccaggaggcagcagagaagagttccagggtgcgaatctccatgggtgtcctcggacatatgactttccctctccatgcctcagtttccccatctaaaccatttcttcccagggagaaggggcctagaatcaagctggaagggcacacctgcagtctccgagactcatggccacttctcccaggtcagaagcgtgctggggtcacagggacctggcttgaaatctcagctctccccagttcctcaccgtgtgacccgggcagtgagttcacttctctgtgcctgtttcctcctctataaaattgggtttttagctgaattttccttacaaggtgttaagaggattaagtgggccaattcttagttgcaactcagcccggagtgaatgtttctgtcttgtctcctctgtgagtagaaaagggtgagaaggaggccctggtctgctggatagggtaagggttaaggccagcagcgtggagacagaaatgaacattattcattcatttattccacacacttttcttatttaatctgctcagtaagcctgtgaaacaggatctgttatcatcctgttattattattattaccattattttgagacagagtctcactctgtcacccaggctggagttcagtggcatgatcatagctcactgcagccttacacctaaagcaatcctcccaccttaccctcccaagtagctaggactacaggtgcctcctgagcccagctaatttttaaaaattttgtgtaagcctggtgtggtggctcacacctgtaatcccagcactttgggaggccgaggcaggcggatcacaaagccaggagttcgagaccagtccagccaatatggtgaaacctcgtctctactaaaaatacaaaaattagctgggcatggtggcacgggcctgtagtcccagctactcaggaagctaaggcagaagaatcgcttgaacccaggaggtggaggttgcagtgagccgagattgcgccattgcactccagctgggtcaacaagacggaaactctgtctcaaaaaaaaaaaaatctgtagagacagggtgtccccttgttgcccagactggtcttgaactcctggtttcaagggattcttccttctaccttggcctcccaaagtgctgggactacaggagcacactccatgcccggccccattcgccactattaaagtcacaaggggctgggcatggtggtttatacctgtaatctcagcattttgggaggccaaggcaggtggatcacttgaggtcaggaggttgagaacagcttggccaacatggtgaaacccagtctccactaaacatacaaaaattagccgggcatggtggcggacgcctgtaatcccagctacttgggaagctgaggcaggagaattgcttgaaccagggattggagattgcagtgagccgagatcatggcactgcactccagcctgagcgacagagcgagactccatctcaaaaaataaaaattaaaaaataataaagtcacaaggaaggcacagagagggaaagccacctgcctaaggtcacataactagcacatggacgagccagggctcaaaactatgtctctaagcccagcatgttgaattctattttccccaatgaagcaggtcctgctattgaaaacacaggatatttgatgaggacaataataatatataatgttatattattattattattattattattattattattattataaaactaatagcagctaaattgcatcaagagccttctatacatcagaccccatgggacagagtcatattttcttgatgtgatccactctacagatgaggaagctgaggctccacgaggttaagtaactgcccggaagtcacaaagctaacgatcaggagacaggacttggacccaggcctcaattcaaaacaaagtaggacaaggaagccagatgcggtggctcacgcctgtaatcccagcactttgggagaccgaggagggaggttcgcttgagcccaggagttcgagaacaccctgggcaacacagtgagaccccctgagtctacaaattgttttttttattagccagtcattgcggcacatgcctgtagtcccacctacttgggaggttgaggcaggaggatcatttgagtccaggagttcaaggctacagtgagctatgatctcaccactgcacttcagcctgggagacagagccagatcttgtctcaaaaaaaaagcaggacaagacccagtaattgagccagatgggaacttaggccctgaccagccctactctctcctcttagaaagggaaattgaggcccctgagagcaagaaagctgcctcaagcctacagacttccagatggaatttcgtttccctctcaggactttgagcaggtaaattcctggcctttcctcccccaggatgggttggggaaaaagaaacagcagctggggaggagatctgaacaggtacaaagggcggcctgcatgaggggaaagtggttagacaccaagcagaacttcctggcctcctctgggaagtttctaagactcatccaggggctgcccctgcgggtgggggccctccagaggccaaggcccagagaaaggagaccctagtcctttccgcctggggtgcaaggagccgggggagggtgggggtggccatcctggttccgcatcctccgttcccgacattggagggaggctgctgtgggagctgggactttcctgagagcagaagattctgggaaattagagacagctgcagggcggggctgcctcccagcctcccttcccttccctccccttggtccctgctggctccggaggcacgcctctccacccctccaccccaccagctcctcctcccctagtccatgccttccaccctcggaccctcagatcttttcccctgagcctctttcttctccctcagatctggcctctaccctcagactctctccaaatcttctttcctcagacccttctttcccctccaactctctcctcctccctcagagctgcgtcccctcacttagtgcttctcagacttcctcagactgtgccctctccctcagatactctcccctcccctcagaccctcacctcctcactcagaccctcacttcctccttcagaccctcacctcctccctcagacccttacctcctccttcaaaccctcacctattctctcaaaccctcacctccttcctcagatgcttatctcctccttcagaccctcacctcctccctcagacccccacctcctccttcagagcctcacctcctctcagaccctcacctcctccctccaaacctcacctccaccttcagacccttacctcctcctttagaccctcacctcctctctcaaaccctcacctccttcctcacatgcttatctcctccttcagactctcacctcctccctcagacccccacctccttcagaccctcgtctcctctctcagaccctcacctcctcccttagcccctcatctcctccccccgaacctcacctccaccttcagaccctcacctcctccttcagaccctcacctcctctctcaaaccctcgcctccttcctcagactcttatctcctccttcagacccttgtctcctccctcagaccttcacctcctccctccaaacctcgcctccaccctcagacccttatttcctccatcagacccttacctcctccaacagaccctgtcctcctccttcagatcctctccccctcctcccactaaaccatctacttctctctcagacctatcttccttcttcagatcctcctccttctgacccttttatccctcttccaacctcagagaaccatcagcaccctctcttccagcagcaccgtctctcccagcccttcgaagctcccaccggacccatcacatcttctcccctctacagtcctgctaggttggaaccactgcaccagctgccctgggatgccaggagtgggacaggcttgggtgtccttcccaccctacctctgagggtccccaccctaagcctcgcccctccaaacctcagctttcctttctgtgcattgggatagtgctccacacccctctcctgtgtctgagggtccccaggggtggggttggatgggcagggaacacagcccccagcctgtccaaccgaattcctcccctcttcccttgctgtggcccccacaacaccagcaggcaggggttgccattggtcccattttccagaagaacaaactgagtctcaaggcaggggatggcttgtctgaggtcccaccgggagcaaggggtggaggtggaattaacacaggtctgtgctcgggatgtttcgccatgaagggggataagggagatccagagagaggtcgaaaggaagggaaggggtgaggcctctccacacagccacttctcacatcctgggttaacgatccactcgggtggggcccgagtccggccaaagtcccttcccggggccccaatacccactttcaaggtcccaggggacacagagacagcaacagagatggggagacagagacagagggcggggcaggagacaaccagagggaggtcaggcaagtttcgaagacagaaggagaccgggggagagaaccagagagacgccgcgtgccccctgggcaagtccggggtgcagcccccatgccccgccccctgtgtccccaaagcctccctctccgcctcctgtgactcagtgacccggactcaaccccagcggctgccccgcccccagggaaatccgggaaagccccggaccttcggggccccaccccggggcggggagagggagaggaggggaggagacggggaagagtcccgcctccctcctccctccctcccatctccagcctgagtcatgcccccaacccgcctagcctgttccccacccatcaacccctcctcgaggtgggaggggaagtcggggggaagccaaactgctccccgctcctgcagcaccggcctcggtcgcgctgactctggcctggtgtccgtgtctcttgctatctctctttctctcaagatctctgcgcctgtctccatgtctctttctctctgtgcacctaggattttccgagcacccaccccggtgccccgcgggccccggctgggggcagggcccccaacgagtgcagagacacaatcagtggagcgctccccaccctcaccccacccccagcccctttagacccacagctgatgaggcacgtggagtggcagagatggaagaggggagggagaggaatcgttcctggccgcctgccgagtgccagtccctgccccgggtgcgtctcttcactcccactaaggaggaaacggctcagagaggggaagtgtttggccaaggtcacccagcgagtaagtgggaaccgagattccaaaccccgtcccagagatgccaaggcctcctgagagacagagaagcagacagcaactgagaggcagagagatggtgacagacacaaagagacaaaagagagagacagagacggaacagagcacacagagacaaacgcggggttgcggagagaaacacctactcagacaggagaaccagagagacagttacagactcagagatagagatgttgagagatagggccagaaagacaaaaacagaggcagagagagcggcccttggcagcaggggtggggatagcaccccaccccccgaccccgcctcctctccccccacccctcctttcctctccctcccccgccgaggcctggctgcnnnnnnnnnnnnnnnnnnnnccgccactggccccgtatgccccgcgggcgcatgtgacgaggggcccgtggactgcgcacccggcccaaggccactggactcccgggcgccgcgctgccgctccgcaagcgcccgctgcgccgcccttccccggagcccgccgctccccgcgggcgctgcgggccttgtcgtccccctggaccctctgcgcggcggctgcgacctgccggcggtccccgggcccccccacggcctggcccgccggaggcgctttactaccccggtgagtggcccccgagggtccgggccgggtgggatccacacagagcatagggtcaccagagccaggaggcagagcttgaggcacaaaccggtgtctctccagggacctgggggacaagaggatataagcccaggttccaaggatatagatatgagatcatcggggagccagtaagctgtgccttgggatctggggatttggggaccctggggggcaaagcccaggggctgagtgacgtgggggggggggggccagggacaatgcccagtggtacaaatatgggggtgtcagggaatcagggcacagagcctggtatcctaggggcaagaaagtacaagctcttaagccagatgtgtagcgttatgaggaagctgagctgggctggagaaactggggttccctgtatcctgatattattagaatcaaagggagtcagggtaacagagactggggttctaaggagacagatactgaggatctcaggatgtcacaatctcaggaaccaagatatctggagacatgggcattatgaaaacagagatggggttctgagcaccccaatatctgggatcacaaggatccaaggaaatgaaccagagctccagggacccagataccagggggtcttgaggacccaggagaacagagacccgggtttctgggtactcagttatgtggggccacaagtgatcagggtcctatttgaggtcaagatcaggtgggcagaagggatcaggggactgaggatcctaagattgggtaattctgagactttgggtaatttagaggcaggatgaaaatttcaggggtctccagacagaaagcctcaaggcctcaaggcctggtattggagatacgaggacctggaaacttgggagttcaagaacagagggcccacaaggatcagcagatgacgaagaccacacactcttctctccatcctatctccatccctgatctcaagaaggggtgtcctctaccacagctgtggccacgtcaccatccccaattgacccccaaagctgcagagagccgttctacagagccccaaaactttaggtagtttctgcaccctccaccccatcagcgtgacagctggagagcctcaagctatgtgcatcaggagttctgccacggcctcccagctttcctattccaagagtgagaaagcaggcctcagttttccccgtctgtgtgatgggttggtatggatttgcctgctgccatggtcccctcgcctttgtttgtttttgtttttgttttttgagacagagttttgttttgctctgtcgcccaggctggagtgcattggcgtgatctcggctcactgcaacctccgcctcccaagttcaggggattcttgtgcctcagcctcccgagtagctgggattacaggcatgcaccaccacacctggctaatttttgtatttttagtagagacagggtttcaccatgttgcccagactggtattgaactcctgacctcaggtgatccgcccgcctcggcctcccaaagtattggtattagaggcatgagccacagcgcccggcctgccgtggcccctttttaaacagtttgatctaaaattacccatgcgtggtggtcagcatctgtaatcccagctacctgggaggttgaggcaggagaatcgcttgaacctgggaggcagaggttgcagtggggcaagatcgtgccactgcactccagtctgggcaacagagcgagactacatctcaaaaacaatttgaacaggcttctggtaacacctcctctctgcctccactctccccaaacccactctacatttatcccacaccctgcacccagcaattcatcagccacaaaatcactctgcagacagtccctggggtcccctgctaggtgatgatgggtgcaccctctgttcttaagggaccctttgtctgattggagattgaggtcagaagataagtgacaatgagggtgaccagccctagagggagaggaagctgccagagcccagaggagggacgtggaagggggtttgttttaggccctgaggaccctgtatgggatgcaaaagggacccaggagaaagggcaggtgacaccacaggagcaaagttttagaagtggggggcgggttgagggtctgtgggtgtggcctcacccatgtcccttctctgtcctccattgtccaggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgtgagtgacagtcccctattaaggggaggggtggttgggaagaccagccgtccataacacagggccactcagctcccagtggacctgagtcagaactcggtctccaccacaggctgtgtgaccttgagtaaggcccttccctgctctgagcctcagtttcctcctctgaagaatgggcaccttgagagcatttacctcctaggccactatttttgtttggtttttgtttttgtttttttgagacagggtctcactctgtcgcccaggctggagtgcagtggcacgatctcagctcactgcaacctctgccccccaagttcaagtgagtctcatgccacagcctcccgagtagctgagactacaggtgcccactgccaagcctggctaatttttgtattttttggtagagacagggtttcaccatgttggccaggttggtctcaaactcctgacctcaagtgatccactcgccttggcctcccaaagtgctgggattacaggcatgagccccaagcccacccctagaacactatttttggaacggtggtctttagatattttgtcacaacctaaaaacaagaaagacagttcattgattaacttactatatgaattatacatgtaaaactatcactggacctggcataaatgttgagtaagtgtttgttaatattactattattttatctcaaacccagcacacacacacacacacacacacacacacacaaacttgaaattaaaattgcacaaaatgaaacaatactcgcccttactatgtgggttctactgtgacattttctttttttctttttttctttttcttttttttttttctgagacagggtctcgatctgtcacccaggctggagtgcagtggtgcaatcatagctcactgcagccttgatctcttgggctcaaatgatcctcccacctcagcctcctgagtagctgggaccacagacgctacccccacacctggctaatttttgtattttttttttgtagaaacacagcagtcttgctatgttgcccagactggtctcaaactcctgggcttaagtgatcctcccacctcagcctcccaaagtgctgagattacagatgtgagccaccgagcccagcttacagctttactttgccattttctattctagtcgacttcattgtttcatggtcacagcccactacattaatttgaagatcccctaaattgatttcacaacccccatggtttatcacctgcagtctgaagaacatgtttgtgaggctgctgagaagtcctgcacgggagggtttggtctgtgcctagcacatagtaagcactcactgcaattgatcatcatgattcttattattctattgacctgggttggaatctcagcgtggccacgttctactccctctgtgcctcagtttccctctctgtaaaaacaggaaccatcgcgtgtgagggtctctgggaggaagaaatgacatgatttatacaaagcacttctgtgagaattagtttggggcctggaaaccacaggtagagatgaacaggcctgtttctgcagagaagtagcagagggctgctccgccactggcccactgagtgatttcatgtccctgagtctcagtttccctatttggaaactgggtctcataatagcacctatcacaattaggattcagtgagatcttgtacacatgtattaatacagtgcacagaacagggctgggcaaacagtaagtgctcaatgcatggaaatgggtaatgtttgagcagagctcccagggtggttgcaggccatctccagagccctagcaggagaaagtggcctagattataaagagctaataaaacctagttccctccccttctgggtacctctggggggtcatctatgaaatgggcttaatcagacagtctctgcccccagtggtgagctgtccatgctgttgaaaagcagggtgcttgccagaggccacccggcccaccagtctccagccccaggccctccccacaccctccctctccgactctcccccaaggcaaacacttctgcctcagctgcctgctgggggaaatcccttcccgcagaacttgaccgcaacccagctgctctgcctcccccacgtcagcacccgtcactcactcgcagcctcccccctcctggcgcttcctccaaccttaaccccttccgctggggctgagactttaccggaacgggcagcggcccggccccagcctgcgccaccggctcctcttcacacccgcgggggagggcagtgggggcgaggagggcgggggacgctaagtctgggtccccgcagaagccaaaaggttgggaggctgggcttccatctcctcacaggcgggtacgagccttggggcatttggacccccaagaggttagggactgggcagccagaaacctggggagggggcaggaaggcgggggcggggggggggtgatgttctgattctcagaaggcagaagttggggaactgtattccttaatctccgaggggatgaggagcagcttggcagcttggggacctggcactcagaggggctttacgggcaggaccagatacagaaatttgcagagtcccttgttcaaaacttaagaatttcacgacagcggcagcaggacgttgggctggtgaaactggtcacgccaaggggcctgaaagtctgtgttcccaaagggccagggtttgaggcgctgtatttctgggtctctgaggggacaaggactggcaaggtagtttgggatcctggagctctgaaggacgggggaagtccttattcttaaagaagagttagggctatttctggctcccaagagatgttgggggtggatgccgggataaggaggacttgcagccagctggagcctgagctctgcggggtggagttccagagggtcccccaggcgggaggactcgggattatgcgccccccctacacacacacacctcaagggagctaggtcttcttgggctgggcactcccttcccccgccccattcgaggatggaagttggggtgccaggggtggccagggtagatccccggcgggacaggcttccctcccccgggagcaggaagcagagccccgcccagcagacctgttactggaagtccgagggctgggtcgcccctcccgtccccacttcctccagccccgccccaccccctgcggcccgcgcgtttatgggaactcaggcctggacggtttctctgaaatcattcgctgcgtctgccctcacttaaccctggccgccccgagagggacccaggccaggcgtcctgggagatgcagagaaggggggacccttcccagggaccccggcccctccctcaacattttatttttaaatttggctttcacggattaggagtcaggttcagcgattcacctgcgtgatctcaccctggcatgtggacgctgtactttacataagagaaaactgaggctccgaaaggcccccatggctttgccctagcacgcggctacgctaggaggggttgtggcccaatttgcaactctggccccgggatttctgcactccatcagaaccacctgggaggctagtttaaactggattctagagacacattccacaagagaaacgggtgctggtgagaaaggaattacttagtaaactttaaataaagatcctgccacccactgtgtacacgcagtcctccttgggtcctccactctgtcccccaccccatgcaaacagcacaggcgtgcacaagcacgcacgcatgcacacacaccagtctctgaatagctgttctaggttggggtctctggaaactgagcaggaagtttattggaaatgctctccatcaacacctgtgggatgaaggaagcccatctgggcagagggagaagttgagctgctgtgtcgcctccacacggcctcagctgtcccacagggaatattgaagctggaatggccttcagcattggggtcaggaggctaggccttctatgctggcattaaccagtgactggatgccattgaagggcagctgcccttgattcacatggggcgtgaccttggacaagcagctctcttgagttgagggtaattcccaaatggtctgaaagctgacaatcttcccagaagctgagggagtgagtccttcagtctagaagggggttctggactgtaccgcctccagaacaatggccccatcccagtttgtcctcacctcccttttagtcaaaacttttgttccagactgggcgtggtggctcacgcctgtaatcccagcactttgggaggctgaggctgaggcaggaggatcacttgaacccagcagttagagaccagcctggccaacatggtgaaaccatgtctctactaaaaatacaaaagttagctgggcgcgatggcacacatctgtaatcccagctactcaggaggctgaggttggatgatcgcttgaacctgggaggcagagattgcagtgagcacaagatagcaccactgcactccagcctgggcgatagaacaacactccgtctcaaacaaataaaataaaataaaataaaagggtccctctggctgttgtgtgggggacagacagtagagcataggtggaagcagagaagccatgaggatggaactgtactagaccagcagggagccagtggtggctaaagcaggatggagggagcgggtggtaaatcaggatggagggagtgggtggggagaagtgtttgaatactggggacatttccaaagtattcaacacattggagttagcattgccaacagcatgagggtgagaggtgaacaacccctaatgcctgtgattccttcactcccccacccccaggcctctccatattgctgtggtgcagggtaacctgccagctgtgcaccggctggtcaacctcttccagcaggggggccgggagctcgacatctacaacaacctacggcaggtgaggctcggtctgagggaggagggctggggcctggactcctgggtctgacagaggaggggctgggggcctgaactcctgggtctgagggaggggggctggggcctggacccctgggtctgagggaggagggactggtgcctggactcctgggtctgatggaggagggctgcgggcctgggatccggggtctgatggaggagggctgggtcctgggctcctgagtctgagggaggagggctggggatctggactcctgggtctgagggaggagggctgggggtctggactcctgggtctgagggaggagggctggggtctggactctaagtagcgaggtgctccaggctcctggttcctggggaagaagggctctggggcctcggactggttgttcctgagagggagggggcctaaagacctcctagtgaggagggagggggctggggacccagaattcaggtactagggaaagaggaggttggaggcccagtcttctgggtcctggggaaggaggagcatggggcccggactcttgaatctgagacaggaggtgtctcaggtttctgttcctggggaagactgcaggatgaggaataagggttcagaaaacctgggggaggcaggactagagagcagggctggacacaggtccctcacagtcactgttccccagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacggtaagcatttaccgcggggcaccgctgggctgtccagcggacctggagtccatcagcggccgcaaagcccgggcctaggtttcaccgagccctcctctccctcagggctcaccgccctgcacgtggcagtgaacaccgagtgccaagaaaccgtgcagctcttgctagagcgcggtgccgacatcgacgcagtggtgagcgtgcactaggagctgggagggagcggggccttagcaggggcggggtcttggcgggggcggggccagtgtggggctggcgtgggagagcacccgggtggggtggggcttggagtatcagacccaagagagaggctggaccccgcgaatgggatgtggacgggatgcgggtcgccggctgctggagcagagcttggagaaactaagaccttccctccccgccgcaggacattaagagcggccgctccccgctcatccacgccgtggaaaacaacagccttagcatggtgcagctgctgctgcaggtgcgtacagcccccctgagcctcgcgcccaccctatcctctgaccccaacccggctctggcctcagcccctagctctgaccccgccttccacttctggctccggctcctgctccgcgtccagctctgatcctttaaggcctagttttctcgaccctcgggctccacgcccctggctacgaacttgtcccattcctcctctgccacctcaacggcctaggccccgccctgcgatggcctggctgaccccgccttccagctaggccctgtccacgcattgtccttcccccctccagctcccccgactccttggggcgcgggcctcggtgtccagctccggttaattcatcgccgccaacgcagtcccgcttggcctgcccttggctctcgctcctaccttcctgtgaccccaccccgatccggtgccgccccacgtgccggccacccacccgggcctccagcctctgttcccttaccccgggtggcccgcgcgccctcctgacccggccctcccgtcccgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtgagccggggcagctgtggacatgccccttgcacacgtgtgtccgcgggctggttgcaggcgagtgtgccagagcgcagaggagtgagggtgtctgtgccgttgcgtggaggggagtgggtgagcctctgaaagcgcgggtgtgagttccagaaatgaggagagactggcaccaagaaaaaaagtgccttgcccatcttttcatactgagaagtggagaggccaccacctggatccagtgagctaggagggatgggagagaggactgtgaggcatgggtggctctatggtcacgcccatcttcctacaggtcatcgacatcctgagggggaaggccacccggcctgcttccacctcccagccagacccctcccctgaccggagcgccaacacctcccccgagagcagcagccgcctcagctccaatggtgagaaaccgttcccaacctccagccctggcgcctcctccctcagacccaggaatcccaacccacagcccctcctccctcagatccaggagtccaggcccctagcctcctccctctgacccaggaatcccaacccatagcccctcctccctcagacccctggcccctcctccctcagaccccagcccctcctccttcagacccccagcccctcctccctcagacctcagcccctcctccctcatacccccagcccctcttatctcagacctcagcccctcctccctcagacccaggagtccagatttccagaccctcctccctcagacctcagcccctcctccctcacacccccagcccctcctccttctgacccccggcccctcttccttcagacccaggagtctaggtccccagatgcctctttcctcagacccgggagtttaaatccccagcccctcctccctcagacccgagtccagacccccagcccctcctccctcagacccccagcccctcctctctcagacccagatctcaggccccagcccctgctctctgggtctagcctctcaccacccacccctctgtctctcttccttcttcaggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgccctgtggggtcaacccttctggaaactgtgaagatctcactctgcccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccatatcccttgggtgcatgggcctctttcatgagatggacctggcggaagtgccttcgtgtgtgtgcacacccgtgcactgaatccagttgactcccagagtgatgttgtgagtctcagacagacaatctcctgtgtgtcactctgggacttctggtgtgtttggttgtgaatgttgccatcattgtcactgtaccattgtttctaaggaggacgtggtgtgtgatatcttttttttttttttttcaagacagagtcttgctctgtcgcccaagctggagtgcagtggcacgatctcggctcactgcaacctccgcctccccggttcaagcgattctcctgcctcagcctcccgagtagctgggattacaggtgtgcaccaccacacctggctaatttttgtaattttagtagagacggggtttcaccatgttggtcaggctggtcttgaactcctgacctcatgatcctcctgtgtcggcctcccaaagtgctgggattacaggcatgagccactgcacctggccggtgtgtgatatctttccagggcaccctgttggattccgtagtgaccctgggcatgtgtgtttctgtagtgtgggggtcctggtgataacccacagctgacttcagccccaatcgtctctggctgtccgagtgcgtggtgcttgggagtgttcctaacattgagatctggggtgatgctgtgattgttgccctgtgactgcctcacatggcgtgagacagttttacttagtggttccatggggcccctctaatggaccacatctgtggttttgttgttgtttttttggggggggatggagtctcactctgtcacccaggctggagtgcaatggcgtgatctcggctcactgcaacctccgcctcctgggttcaagagattctcctgccccagcctccagagtagctgggattacaggcacccaccaccatgcctggctaatttttgtatttttagtagagagggggttttgccacattggccaggctggtctcaaactcctgacctcaggcgatctgcctgctttggcctcccaaagtgctgggattacaagcgtgagtcaccgcgcccagccacacatctgtgctttgactctggggtatgcctctgtgtgtcagtcggggtttgtaatggtttcctgttgccactataacaaatcacaaattcagtggcttgaaatgatgctaacttttttttttttttttttaaaacagagtttcactctgtcacccaggctggagtgcagtggcacaatctcagctcactacaacctccacttccctggttcaagccattctcctacctcagcctcccaagtagctgggactacaggcgtgcaccaccacacccggttaattttttgtatttttactagtcacagggttttgacatgttggccagactgatctggaactcctgacctcaagtgatccacccacctcagcctcccaaagtgctgggattacaaaaggtgtgagccaccgtgccagccaaacaatactaatttattctcttacagttctgggcataagaagtccaaaatcggccgggcgcgtgtggctcacgcctgtaatcccagcactttgggaggccgaggcaggcggatcacgaggtcaggagatcgagaccatcctggctaacccggtgaaacccagtctctactaaaaatacaaaaaattagccgggcatggtggcgggcacctgtagtcccagctactcgggaggctgaggcaggggaatggtgtgaacccgggaggcagagcttgcagagagccgagatcgcaccactgcactccaacctgggtgacagagtgagactccgtctcaaaaaaaaaaaaaaaaaaaaagaagtccaaaattgaggccaagcccggtggctcacacctgtaatcccagcactttgggaggctgaggcaggagaatcccctgagaccagaagtttgagaccagcccgagcagtatagtgagaccctgtctgtacaaaaaaaaaaaaaaaaaaaaaattagctgggcatggtggcaggcacctgtagtcccagctactcggaagactgaggtgggaggattgcttgagtctgtgagttcgaggctgcagtgagctatgatcgcaccacagcactccagcctgggcaacaggtgaggccctgcctcaaaaaaataaataaaagaaccatggtgtcagcatctgcttcttgtggtgaaggcttcaggctgcttctactcatggcagaaggccgagggaaccacacgtgtgtggggatcaagtggcaggaggggaagcgagagagagacagagagagagaagtgccagcctccctttaacacccatctctcatgggcgtcaatggggagaactcattcacccgccagggaggacattaatctattcatgagggacctgcccccatggcccaaacacacctcacatcaggcccacctccaaccttgggaatcaaagttctttttttttttttgagacagagtctcactctgtcgcccaggctgcagtgcagaggcccaatctcggctcactgcagcctttgcctccaaggttcaagcgattctccagcctcagcctcccaagtagctggaattacaagcatgcaccaccatgcccaattaatttttgtatttttagtagagacggggtttcaccctgttggccaggctggtcttgaactcctgacctcaagtgatccacccgcctcggcctcccaaagtgctgggattacaggtgtgagccaccgtgccaggcccaaatttcttcatttttttggacacagagtctcactctatcacccaggctggggtgcagcaggagatcctagctcactgcaacctcgacctgggttcaagtgaggggatcagatttcaacatgaggttttgaaggaaaaaatattcaaaccatagcactgagtgttttttgttttttatggggttttttggtttgtttgtttgtttaatctgtgggggcttctctgggtcgtcatgtgaattgctgatagtgaacatttaatccccatcactctgtaatgtagttgcatctgtggggccagctgccttaacaacttcctggatggcatcactggggtctgtgaagggctgtgtgtgtgcacacaaacactcatgcacacgcacttctggatggcctgtgtgagcactgactgggtgacctgtgtgtgcctggcccgcctgactgggacgtccatgcgtctttctgtttgcaactatgtttcagtgtttctgacccagaccctgtgctctggtatctctgaagctgccaggcttgaagggcatgttaatgtcctgttgctggccaggcacgatggctcatgcctgtaatcccagcactttgggaggccgaggcgggcagatcacttgaggtcaggagtttgagaccagcctggccaacatggtgaaatcccgtctctgctaaaaatacaaaaattagccaggtgtggtggtgtgcacctgtaatcccagctactcaggaggctgaggcaggagaatagcttgaacccaggaggcaggggttgcagtgagccaagatcacgtcactgcactccagcctgggagacaaagcgagagtccgtctcaaaaaaataaaaaataagaaataaaaaatcctgttgctgccatgcaaactgccacaaactaggtggcttaacacaacagaaatgtattcctttacagttctgaagtccggaagtccaaaatcaaggcgtcggcaggaccgcactcaccaaaaactgtaggggagactccttccttgcctcttccagcttctggtagccccaagcattcctccgcttctggctgcatcagtccagtctctgcctctgtcttcacatgatcttctcctttgtgtgtccatgtcttcttctctgtctcttatgaggacatttgtcactgagcacagtggctcacacttgcaattccagcactttggggaaggcaaggtgggaggatcacttgaggccaggagttcaagaccagcccagacaacatagcaacaccctgtcttgaagggaagggaaggggaggggaagggaggaaagagggagaggaaggaaggaaggaaggaaggaaggaaggaaggaaggaagcaagcgagggagggagggagggagagaagattatttctatgtttcctggtcaacatagtgagacgctgtctctacagaagatcaaaaaatgtgttggctgagcatgagcctggtggtgtgtgcctgcagtcccagctacttaggaggctgaggttcaagcatcactttagcccgggatgtcaaggctgcagtgaactatgatcacgccactgcattccagcctgggtgccagagggagatcctgtctcttgttttgttttgttttgttttgttttgttttgttttgttgttactaagtctcactctgctgcacaggctggaggagtgcagtggtgcaatctctgctcactgcaatctccgtctcccaggttcaagcaattctcctgcctcagcctcccaagtagctggaattacaggcatgcatcatcatgcccagctaatttttaattttatttatttatttatttatttgagatgaagtctcgctctgtcgcccaggctggagtgcagcggcgcaatctcagctcactacaagctccacctcccgggttcacgccattctcctgcctcagcctcccgagtagctgggactacaggcacccgccaccacatccagttaattttttgtatttttagtagagacagggtttcaccatgttggtcaggctggtctcaaactcccgaccccaggagatcctcctggctcagcctcccagagtgctgggattacaggcatgagccaccgcacccagccaatatttatgtttaatccttagagcaacttgcaggtttgctccaaggtttaaacatgaacactagtcaagctaattgtgctcctctcctcctatgcagtggcggcaaacagcagtgccctcagtagtatacgcagcctgctgcgtgtagcggtggccttaagagaccttggagatagccctttccgatgcatgttcatgtttctgatcttgacctcaccccagtctagactccagacaggtatgcgaggcgcctttggaaagccccagggtgtggtggccagggttcacattggctaaggcatcacgtccatccgcaccaagctgcagaacatggaacacgtgattgaggccctacccagggccaagttcaagctccctggccaccagaagacccacatctcaaggcggtgggactttaccaagtttagtgcagatgaatgtgaagacacggtggctgagaagtagctcatcctggatggctgtggcatcagatacatccccaatcataggcccctggaatagtggcgagccctgcttactcacacccaccaataaatcctccttcctgtccaaaccgaaaaaaaaaaaatatgaacgggacacagtggctcacgcctgtaatcctagcactttgggagctggaggtgggcagatcgattgagcccaggagttcaagacaagcctgggcaatatggtgaaaccctgtctctccaaaaaaaaaacaaaaattagccggtatggtggtgcacgcctgtagtcccacccactggggaggccgaggtggcaggatcacttgagcctaagaggtcaaggccgcagtgaatcaagattgcgccactgcattccagcctgggtgacagagagagaccttgtctcaaaaaaggaaaaaggtggggggaagtaaattttgtgcaatacttattacaggccatggtgctgagtaagagcttcataaatgggaattgctgttgccatcatctaagaatttttgacagttttgaggtcagaggaaacacagtagagacgatgagacctattctttgtcctggtagaaaaatggaacaatgaggtcatagcctagatgtgtgttttagctacattttttttattccacggttgtaattaaattaaataatatagctgggcatggtggcacacacctgtagtcatagctactcgggagggaggctgaggcatgaggatcacttgagcccaggagtttgagaccagcctgggcaatgtagtgagaccccatctcttgaaagagtgaagtgactcgcatctgtaattccagcacttttggaggccaaggcaggagaattgcttgagcccaggagtttgagatcagcctgggccacatagcaagatcctctctctacaataaaaaaaaaaaaattatattaggtgcctgtggtcctagctattcaaaggctgaggcagggtgcagtggctcacgcctgtaatcccagaagtttgggaggccgagacaggcggatcacaaggtcaggagatccagatcatcctggctaacatggtgaaaccccgtctctactaaaaatacaaaaacaaaattagcgaggcgtggtggcaggcacctgtagtcccagctactcgggaggctgaggcgggagaatggggtgaacctgggaggcggagcttgcggtgagctgagatcgcaccactgcactccagcctgggtgacagaggagactccatctcaaaaaaaaaaaaaaaaaaggccgagaggagtttgaagctgcaatgagctatgattgcaccactgcactccagcctagacaacagagagagaccctatctttaaaaaatatataaaacaaagagcctgagtaacatggcaaaagcctgggtaacatggcgaaaccctatctctacaaaaaaaaacgcaaaaattaaccaggcatggtagcgtgcatctgtagtcccagctactcaggaggctgaggtaggaggaccacttgacaccgagaggtcagggctacagtgacctatgactgcaccactatgctccagcctgggtgacagagtgagaccctgtctttaaaaatataataaataaaagaagaaatatagtagcttttttttttttgagacagagtcttgctctgtcacccaggttggagtgcagtggcaaaatctcagttcactgcaacctctgcctcccaggttcaagcgattctcctgcctcagcctcccgagtagctgggattacaggagcctgccaccacgcccggctaatttttgtatttttagtagtgatggagtttcgccatgttggtcaggctggtcttgaactcccgacctcaggtgatcacccaccttggcctcccaaagtgctgggattacaggcatgagctaccacgtccacccaatagtagcttaaataagatgaaagtctatttttctctcatgtaaaggcccagcgaacacccgcatctagaatagtagccaaggatgtcagagatcgaggctccttctacctggttgttctgctgccctcacctcacacttccattgtgtggtccaaaatggctgctccagctcccaccatcacatccacattccaaccactgggaagaagaaacaaaagtcaatcgcatgcccctacctttaaagctacaacccagaagtcatacacatcatacacatcacatcctatttggccagaatttagtcacatgaccacacctatcacaacagaggctgggaaatgtggttttatctgggcagcatgtacccagccaaaattcaggggttctgctacaaaaggaagaggagagaatggttattgaggggccgcacatgtatctgtcacaaccagggctctgccaccaaatgactaaatgactcaaggtgaagtgacttcaccacactgagcctcagtttcctcacctgtaagaagggaatccccccgaccccttggggttgatgggttgttgggcatttaatgagagtgtgagtgtcaggcacttagcccaggacctggcccatcatcagtctggagtgtgttggaagtcctcttgtgcttgtgggtctaggctgtgggtgatgtggcttttcgtgtatgagaaaccgtcccggggcttgagagctgaacccagcactgaactttataagtaacttctctaaaacaagggatctggcctctgtacacatggaaatccccactcagcctcctagaccttgggactaggcacatgtccttccacagtcttcccccttccgctggagaaaggcagactccaaagatggaggaagggtcctgcttggggtctccagcctcccagccttcacagaattaagcactcatagcctggccaacatggtgaaaccccgtctgttctaaaaatacaaaaatgtgctggatatggtggcacacatctgtagtcccagctactagggagactgaagtgggaggattgcttgaacctgggagggggaggttgcagtgagccaagatcgtgccactgcactccagcctgggtgacagaaaaataataataataattcaatcactcacccctcaacttccaaagctcctcatgggtgacagtcccagcattccggggacagctctaacgccagaagtcataccttcaatgcatttctcggggctccactcgcttgtcctcaccacattgagtaaacccagaaagacagaggacatctctcctagatgcgtgtgtgaaatctgccagattctaaatgcctgggacattccaaaaagtgactttaagagcattggccgggcacagtggctcacacctgtaatcccaaccctttgggaggctgaggtgggaggacagactgagccctggagttcaagaccatcctgggcaacatgggtagaccccggctctaaccccgaacatggtggcacgtgcctgcagtcccagatactcagaaggctgaggtgggaggatcgcttaagcccaggaggttgaggctgcagtgagctgtgaccatgccactgcactccagcctgagtgacagcgagagactttgcctcaaacacacacacacagagtcaggggacggtggcttacacctgtaatcccagcactttgggaggccaaggtgagtggattggccaggagttcaagaccagcctgggcaacatggcaaaatcccatctctacaaaaattagccaggtatggtggcacccaccaacttgagaggctgaggtagaaggattgcttgaannnnnnnnnnnnnnnnnnnngactggtctcgaactcctgacctcaggcaatcagcccacctcggcctccctaagtgctgggattgcaagcatgagccaccgtgcccagcccaagaccatcttttaaaatatggcctggatgggagtcagggaaactgtccttgaagtctgagcaccttgagatctagctgtgtgaccagagggatgttgtcagcctctccaggacttgtttttttttcaatctgttcatcttggaccatctgccagggctccacccaaaaacacaccccagctctcccgtgccctgggaagggttctaaccgcatcttggcagaaagttcactctgtttgatgcggctgatgagttcccgagccttgtcctccagtgtgtttccaaactccttcagcttatccaaggcactggagacgtctggggtcccctgggctggggctgggcctgccaggaagatgggcaggggttcaaaatttgtttttttttttttttttgtttgttttttgagacggagtctcgctctgtcgcccaggctggagtgcagtggcgcgatctcagctcactgcaagctccgcctcctgggttcatgccattctcctgcctcagcctcccaagtagctgggactacaggcgcccgccaccacgcccggataattttttatatttttagtagagatggggtttcaccgtgttagccaggatggtctcgatctcctgacttcatgatccgcccgcctcggcctcccaaagtgctgggattataggcatgagccaccgcgcggccgaacacatctgttctttaagtgtgttttcagaccttcacataagccagacttttactttatagaaagggaaactgtggcccagggatggaagagactgac

SEQ ID NO: 1511 - DNA, 1797 bp, Homo sapiens
ccgccactggccccgtatgccccgcgggcgcatgtgacgaggggcccgtggactgcgcacccggcccaaggccactggactcccgggcgccgcgctgccgctccgcaagcgcccgctgcgccgcccttccccggagcccgccgctccccgcgggcgctgcgggccttgtcgtccccctggaccctctgcgcggcggctgcgacctgccggcggtccccgggcccccccacggcctggcccgccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgccctgtggggtcaacccttctggaaactgtgaagatctcactctgcccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccat

SEQ ID NO: 1512 - protein, 444 aa, Homo sapiens
RGARGLRTRPKATGLPGAALPLRKRPLRRPSPEPAAPRGRCGPCRPPGPSARRLRPAGGPRAPPRPGPPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 1513 - DNA, 37723 bp, Mus musculus
  misc_feature (1)...(37723): n = A,T,C or G
tgatgccctcttctggtgtgtctgaagatagcaactgtactcatacataaataaatcttttaaaaattttacaacattttattaaggcttacttgacttatgatctatcctatgagtgctctctctgaagagagtacatggtgttgcttttgggtgaggtttagatagaattggtttgtcgcactcaagctttcctttcttggtgatcttctggttaattgtattgtccattattgaaaacagaatattgaggccgggtttggggattcacatcttgagagacagagccgggtggattgcatcatcgagaccaccagcttgggctacagagtaaaaccttgtctcaaaaaaagagtagagcactaaagtctttgatggtaactgttgaactggatgcttctcctgtgaattctcacagtgtttgcttcatggtgttgttgttgttgggtacatgtatgctagtttcttcattgttatcaagagaaagtgtttttgctttgtctctagtgatagtttttgtctacagatcagttttaccgaaatactgtgcagtcctttcagttctctctgggtactgtttgtatggtatgtgtttcattgttttatcttttatatatatttggtgggtatgtatattctgggaatgtatcaagtgttcatgtggatacaggtatgtgtggggttcatgtgtatgctagatgtgtgttaaggccagaggtcaactctcagctgacctcagtcactctctaccttattttttgagacagatctctcattgaacctggatctcactgattggctggactgcatggccagccagccctagggaatctcctgtccccatttccctagccctggggattgcagatgtgtatgctgctgtggttggcttcttctgtgggtgccagagatctgaactcggggcctcatgcttatggcaaaagctttacagactgagccatctttccagcacctcttcttagtgtcttttttcttggagggttggggagtgagattgagatagagtctcactatgcagccttggatagcctgaaactcactatgtagaccaggctggcctcgaagtcatagagatctacctgtctctgcctctctgattactagtgtctcatttcattctttacttttaacctatttatgtcttttgtaaactacatataattggatcactttaagaaattctagctggcagtggtggcacacgcctttactccctgcactccggaagcagaggtaggtggatctctggaatttgaggccagcttggtctctagagcaagttccatgacagctaagagcacacagaaaatccctgtctcgaaagaaagaaagaaagaaagaaagaaagaaagaaagaaagaaagaaacaaagaaaagaaaagaaaagaaaagaaaagaaaaaagaaaagaaagaaagaaagaaagaattctgccaaccaatgcatttaaattggagtatttaataattcacattttaagcagctattggcagggtagaatttatgccttgttttgcaatttcatttttatgtcttgttctacccttccctcatttctgccttcatttgtgttaaacaaatagttttgagtattcttttccttgcccgtaaaatgaaacaaagaaaagcaagggataaatgaaaggctgcccacaccttaagggcaccataaacatgggcaccagttggaccttgggctctgtaagagtcatagtcatccccaggggtttcttgaagcaaagtccacccaggagggctctttggcagcctcgtgtcttctgcccagaacactaccgttgcagacggttcctaggcaactctacatcccagcccctgactctccatctcttccctggctcctggccttggcgttgtccgggctccttatgaagtgtgatggatttacttcctaatttctctctacctcctttcagacccagggtgggtttgagaatccctgcagggcacagttaggctgcgggagtgtgatggtggagggggcagccatatgacttggagttggtcggtcgcctggttcctccctcgtgaactctgggatcggctacttttcagagccatgctgtcctcgtgcctcagttgggacaaagctggacgtgcaggtcgctgctgctggcactgtctgtgcggctggtgtttctttctttggtccctgtgtctttggttctttggttcctgcgtctttccacgctcttaaattcctcccgtgcagaaaccagtgagtggagatcactggaccagacacctagttccccactactctctccatttgcttcgaaccccgtgaaacacaatggggtagcagcaaggagcttggcaaggagagtcagtaaagggtgaccatatgtgccggagacagagtgttagcagagctgacagagaggctgaacttataggcaaaaggggcaacttcagcagaagcccaaagagggaactaactccttggggggggggtcacctgttccttggtttatccttctctctcgttccctacagtattgctgataatgtgtttctgtgtctgtttctgcccacttcactagaagctccatgggataaagactatgctttgtctcctgtgtctccctagagcctggcatccagccagtgccatcaaatgcctgttgaatggatgaaggggcccaggcagacctgcacagctgcagcagggtgtgtgcagtgggggaagaggcagggcaggcgacgttaagcaaggcccctatgactggcctcctctgtatcttggctcggggccgaggttggcaccgggacacacaggcagcctccagagagccctgccctagacctactagggagtcagacctttccagaaggaaagacccagagcagaccctggtggtgtgagcatcacagggcatagagagtatggtgaggggacagactggaatcaccccccccacctccacccaaagtttcagccatctgaagacttgactacagggccattttcatctctcagtgttctctcactctggggttcagggtgcatgtgcacgtgtgagtgtggaggtcagaggtcactgttgggtgtcttcctctttcatatctctatcatacttttgagtcagatctcttactgaacttggagcttggtagtggctagattgtctggccagaaagccccaggagccctcctgtctgggcttatacgtgcccttgtcgtgtccagcttttgatatgggtgctggagactgaaactgaaaactcgatgacaagcactttactgagccatctgcccagccttatcttttcttatagagtatgtaactgtcagagtcaccctcgtcctttgggaaggttttcctgtaattggtggtgacccttgtccagcaggcaggcagtccctcagttgagtctggatgcttggtcctctgctgagcctcggtagcacgtctgtgtgcatgagctcccccccacctttaaaaggaaactggttattccggtcccccatggacatcttgctggcaatttgtgggacagtgagtgagggacacaattaaggtggttgcttaggccagggccctgagtatcctatcaggctatgcacacacataatcctttaaaagcacctcactgttggtctttttgctgtcaaagctcatactgtattgagcttgaaccttggccaagtttctgagcctggccagcttactaactgagaccccggggactctctccccagcctgtcaacccaggctctgcatctctgagctgaggttcagtctgggcaaagggtgagccagggactgtgggtggcgagtgggtcagtcataggcctcctgcctgctgtgccctccctgcaccaggtggcaggcaggtcagtaccttaggcatcaaagcctcttctttctcaccggcttgcaaactccttgagaacagggcttctgtatgcagtagttctggcaaatctctggcctgagtgggaaccttgttgcagtggtggggagcaaatggcatgtggacagctactttgtttctagagggaaggtttatccaagacctcacgactctttttttatttttttaagatttatttatttattatatatgtgagtacagattgtagctgtacagagagttctgagccttcatctggttgttgggaattggatttaggacctctgctcactcagcccctgcttgttcccgcccaaagatttctttattattatacataagtacactgtagctgtcttcagaccaaaagagggagccagatctcattacgggtggttgtgagccaccatatggtagctgggatttgaactcaggaccttcagaagagcagtcagtgctcttacctgctgagctatctcaccagccccaagacctcaccactcttaactgccccccaagatggcatttctcaaacacttacccagcctagctgtggccagagacctcagttaaccgagaagggccattcagaaagtgaacctgtacttaaggccagctaggtcatgctgggccccttggcatagtcttttaatattttagacacatcttagtgttttgagacccagtctaaccatgtcaggggcatgaggtaaacagacttaaaaccctgtgttcctgagcatggtctaggcagaggtgagaagctctgagggcgggagagctggtacttttccaggtggttcgcatgtagtatggggtagtaaatgatggcccaggagcaaatgactcatgggcctgccgctggagaaggccttgcgtttagctttgttggggagaacatgagctctgtatgtattgttggggagagctaacatgggggtccctttatatcacctcagcaacatggggagctctgccgtctatctgggagataaactggcctcaggattaggcaggaccccaggctggatacctggctgcgtgcacttttgcttgggtaagttctgaagtgcagattttgggaacaggcagttccaggtcaggtgtttaggtacaagtgtctgcagcagagatgaggaagccgggcacttgggagttagtgtggggtgcgtgggtgtgtgctggggtcaggcaacatgataagctccgtgtgtaatcccgcttccagccctggggtcagagagtttcccagaggaagccctggctaaaggatgacaggggtgtggccaaatgcaaaggttggaaaggcagggaccaggcttagtcagagacctaggagcagtgggaggcctgaccatattcttcttgcttgaagtgctagagaggcagcaggagccagagtctggggactttggggcccggtaggtgcttcagacttccccccaaggcagcctctccagtgctcagagacatggcttgcttgcttcaggttaaggtcttgtagggttccctgtctgtattttacttgttctcggttgagacaccaagctctgacttccctgcgtccttgaggggaccagggtatgtgtgtgtgtgtgtgggggggggggcaggtatatataatgtcaatactcagagggtaaggtaagagggtccagagttcaaggctagcctgagctaataaaatagtttggagtaggactgtttggccctctaatggctaggagggttttctagctggttattacctccagttcagagttgagccactgtgaccctggaccaggctgggcacctcctccctggtgtctgtgactcacagcagtcttgtgtctcagatgaacaaatcgaatggcccaggtgtctggtgagtggcccagtcagtctctcagtggccataactggttctcctcccttgttgaagggttcaataaattctcctgggtgggctagccatatagttgggcatgtgtggtctgttatgtcacttgaaaagctgacatacctttagagtatagtgatcattaacacagtgtacacccaaggactttctagaaccttctaacatgtctctgaagcccatatgtgggttcagcactactctctctttcttggtgcaccctgtgttttctttttctttctgtagaaaaaaatgcattccaccaaagagctttctgtgacctccctctggtcccaggccactgataaatgacactggctttgtttttcagcctagggctccctgtggtgccctggtcagagattggttgctgtggagaggctcctagaggaagaccagagaaacataggccggcaaagtggttgcagtgtctggctgtgggtttccttctgctgtgatcttgtatctgttgtcagaggccttgcctctggtcccaggggttcctccttacatcttcttgatccttgggcatttgccccattggctggcaagtctttggagcaggtggcttccttcttcctcactggaaggtcagacctgcttacagctgaggggctgaggagagggagggagggacagtcaaaaagagaggaagtggctcagtgnnnnnnnnnnnnnnnnnnnngtggccacaggaagtaggaacagggatggcagatgttgggcctgctttcgaaagtaagcaagtctgcccagaagccggggcagggaatgtcccacaagtggaagtaccagcttggttatttttggcacttctgcccagaacctgcgaggaagagctgccactagtcaccatgggagggctgcctattctcaatcccacccctactctgagagctcaaagccccaccacagcagaccagaagtgccagggttagagaacctaggtttgaggtgggcccgcctagccagtacagatgtcacgactcctgcagctggacctgatacttgcctcctctttgtggcgaggctccttccctgcttctctggagattgagggtctcagtcatgtttaaagagggtgggagagggttgcttctggccagagctagtgaagagcagtgtccagcaagccctgacctaaggaaaggtaagtgtatggggcctaagatcagactggtgtgtgttgaggatttcatcttgtgtgtgacatgcctggcttcaagtcctggtgacataatcatgtgtgactgtaggcaaattaccttgttcctgtaagccttatctagcttacctacaaaatgggagttaaactattggtgcttgatacaaggctttaaaaaatacaaagtactttggacactcttgacacagacaagccggctacattgttattattagggctacttagagcttggctgccatggtggtccttccagcttcctcttctcttaggcctgcacgtttgcctcctgcttggcaggccagggagttgtggggatttctgcagcaggaagcttatggggtgattccaccgttccccaaaccagcctcttgttcagagcaagtctcccctatcatggtatatgctgagttgatgggctctccctggtgtgcagggtaggaagaaaaacagcttgatccaccctcagatttaatctcccctgctaccgcacacacccatgggcaagagcttccatattctggagctccggacccagactccgccttctgccctctaaacccccaagccgggcactgaatagccatcccctgcctaggccccctctgacaggaacctgtctgcacgtgcacccatgcctgcctgccacgtgggccttcccctgttgcaggcccccaaagcccatgctgtgactcccaggcgacaggcatcctgagtgcctgtgagcatccctgagcttgcagctccctagaggcacgtggcctgctgggcttccctctgtcctgtctcctccctgccttttttttttcttcctctgccttgctgcgcgcacacacacacacacacacacacacacacacacacacacacgtatttctagttttgccaggcttgggtctccctcggagaggtggaactcgaagtcccacccttcagcttcatcatggaggccccaggggattttccatctctggctggctttcagttctctgttgtgaattggtctggctacccaaggaagggggtttaaaaagcatgagaaagatttgttcaaagagggtctccagccctgagcgcttgtccaaatccttcccttcctgctggtgctagggtgactcagtgtcctcagtccgtctgtccctgcgatttccacaaatgaaaacaaaggagtgcacggacttagagctctctcgccgttctcctgggctaaagctcgcgctgtctaccaggcccaggagctgaggaaggaaatggtggaggaagttgctccccttctgggtgctgggtgaaagtgaaagaaagggagggggcctccagtgagtcaagcggccaggctggcaggcaggcaggccagtccgggagggagcccgggctggagctgcggaaacgtgcggagcagcgatagcacggagagcctgggaggagaaccggggctcggtgtgggcggggcttctcgtgggcaggacttatgacgccaggtctgttctttgctgctggttttctgggaactgccccacctgctatcataatctctgtggtatctgagcctaccaggatctgcagattcatccttgcccacctctagcctttccaccttagtgacccagggtcagagtcttggcaaagaggtgggcttgtatacctcctactcttaccaacttcccagagggagacaaactaactaaacaaataaacaaaattttatctgaagaacaaaaacttaacaacacagcaagcagctatgcatgttgtaaaatacaggcctggattctattctgtagcaatgtcagtgtaactgtcactttagacatcagcttagagtggggtggggagtctggctcacttgttcaacatgtgcttagcatgaataaagcccctatcccagcaacaccatcctcaaaatatggcaaagcaaaacaactgaacactttccatcataggcagtctcgagggcctgaggtctagaactctgcaccgttcctatttgagttagactctgctctggctaggcactctttaacagtggaggggacggcggtggtagccagcaacagctgctgaccagctactagactaaattgggcccacatccagccagggttgcaaaacaggttctgtgttagtttgagaaagatttcagcagccagagccccacccagcaactcttcccaggggtggggcctcacctacgtgcttcggcataaaagctgcaagcctaactctatgggccctgtgggctttgcaagagcctggtgtgacagaggatgggtggctatgctgggaatagtccctgtcccctaacttgctcttctttaggtggaggggagcagtgaccttaggggaattcttctgggtctggagctattgtgtagacagtcatgtgggaaggaacagacctgggctgcactgtgccccagcctagtttatagtttaataggacaaggttctcagtttggcttttgctttcccttttccccgtttgacttggagcttaggcaacatgtcagccccacttggccccttggtctgtgtctttagagggttccgagttacacaaccaaatgcagcagacgagagtctagccaggaggtggtgggacaggaagagcgaggacacctgatcctgctgtcttgctggcagctgccccatgatccctggcccccatgagtgacttgaggcagggggacactggtgctcatatctaggggtcacgtggctaacactgtcactggtttttcctctgcaggctccaggacctggcacaggcaggcatcatgattagggaagtgtagctgagcgcaagagcctccctagaagaggaaggaccagcggacatttcctagctcttgcctgaaggctcctgcgttttcctctgcctctcttctgccctccctggctactggactggggccaggcttccagcaggacctcctaccaagggatgggcagcagctgaaggacgtctcactgccaggcttagtcggccacaccatgaacctccaggcccagtccaaggctcagagtaaacgcaagcgttgtccttttggggaccaggagccagccgccaaggaacagccaccaccactgcagagtccaccacagtccctcagagctaaggaggaacagtacggggcccacgaaggtcccacaggggtggcctccaccacccagcctgtggagctgtctcctcctaacaacctggctctcctgaacagtgtggtgtatggatctgagaggaccacggcagccatgttgtcccagcaggcccaagtaagctcggtaaagtggcccagctctgtgatggctccagggcggggcctggaacgtggcggaggtggaggcatcagtgacagtggctggcagcagcaacctggccagcccccaccccactccacgtggaatcacctgcccctctacggtggacccaaagggagccctcatccaggtgtgggggtacctccctactataaccacccggaggcactgaaggggaacaaacctggaggtccccagctggatcactatggaaacgcagtgcagcccatggtgccacagaaggtgcagctggaggtggggaggccccaagcacccttgaactctttccatgcagccaagaaacccccaaaccagacactgcccttgcaacccttccagctggcatttggccaccaggtgaaccgtcaggtcttccggcagggccctcagccctctaaccccaccgcctccttcccacctcagaagcagcagcagcaacagcaaccggcagccctgccccagatgcagctatttgagaactactaccccatgcatcaactgccttcgcaacagcaccaggactttggcctggcaccaggtgggccactgggacagacccacctggctcaccgcagcatggccccttaccccttttcccacaacccagatatgaacccagaactgcgcaaggctctcctgcaggaccctgcttcacagcccgtgctacctcagccccagatggccttcccacgtcgctcccgccgtctctccaaggagggaattctgccttccaactccctcgatggagctggcacccaacctgggcaggagcccgcgagcaatctgttccttcaccactggtctctgccgcagccaccgccaggcaccctggggcagccccattctgaagccctgggattcccgttagaactgagggagtcacagatgctggcggatggggacagactggcacccaatggtcgggagcgggagcctcccgccatgggtaatgaggaggtcatgagagcagggggcctcggggactgtggacagatgatacgaagtggggtgatccagagcacaaaacggagacgcagggtgtcccaggaggctaatttgctgaccctggcccagaaggcagtggagctggcctctatgcaggtgagaatgggcggcatctgctgcggtagtggggtgatgcgtataggtcaggttttattcagttatttaaaggaaatggaagctctttattcagagtacccctgcatgaggcacctgtacccgcagggacgctgaggttgccaagcacggtggttggtgggtaggaaagtccttgttggcttcttcccttggaacttgaggactcggagaagggggtgctgagagccagcattctaagaggcaagagtgtactggtagttgcacatgatgcttgtcaaaatgcattagctataatctagatgaggaagtcatgttgcaataaagttcttttttttttttttttttttaagtcagaagggaaggaagaccaatcagactttgagcacttgtgttaaccctgggttttaaattttattttatacttgctcaaaagtaactgatcatacgcaatagcaaaggtatgaatgtcacctgccccaggtttctgtaaggagctgagccacttaggataaacacctcccatttgatcagcattaactctctgcatccttagaatctgcaaccactgtcacctttaggccctggctgacacacaggaggctacataattttgagtctttgctccagccagatacctgtgagaaaatagctgcaaaccgctccccacccccactccttcatcttgccacagcgagatgcttggttacatgccgcaccccataggctagatgcaacatctgcaagccacctgtggactgatgaccacctggaatctgctgcttcaggccagggtggcacagccaggcagaagggagggggtggagaagatttgaaaggtataggaagagggatggcctaggaagtgccaggctgtcaaagaccaaccagtaagtggttgagttgctggcctgaatgggattcctaggtcagcaaacaggggctcaactcctgaacctcactgccaccccctctccccaatctccctcttacccaggatgccaatggctctgaggagaagcggaaaagcgtgttggccacaacttccaggtgtggcgtggagttttccgagcctgccttagccgccaagagagctcgggaggagagtgggatggtacccctcatcattcctgtgtctgttcccgtgaggactgtgggtccaactgaggtggcccaagtcggaggtgctgacgaggatgggactggtcttgagcagtaccccaccgagcacaagccgtcagtcatcgtgacccgcaggcggtccacccgagttcccgggacagatgctgcagctcaggtatgagaggatgctattttccttcgttcatgttttgttttgttttgttttcctgagacaaggtctctgtgtagttctggctgtcctggaacttactgtgtagaccaagctggccttgaactcacagagatccgcctctaccttctgagtgctgggattaagaatatgtgtcactatgtccagcccggtaaaaattttaaaaatagttttatattctgtgactctttcccacacacatgtggtgggtgcccttggaattgcggttatggagagtataagccaccatgtgggtgctgagaatggggtccccgtcctctgaaagagcagccagtgctcttaaccactgagccatcttcccacatatcagggagatactgtttttttattttccaaatcaaacttgtacagaaatacacagagggtctgaggtagttttatacttgaggtggtggtcatcaggagagtctagcttgtggatctgttgtggttgccagtcaggaggtgataatggctcctggggaaggtcctgagctagcttctggggtgcagaagtgtttgcctgtgtgttcagttctgagccaagcggtggtgtttcctgtactctgtccctgctttttgatgctttaggggtgtgcacgtttggcccagcgtgagacttgctgagagaagtttcttttcatcagtagtatctgttctgtgagcagcacgtgtctttctgtccttccgctacatcttctctgtatcctttcggaacgatttcaagtagtaaataatctcgctttgctatttcctgctccggtaaccttgtctgtcccacgtacagttcttttttttaactaattaaactagttaaatgcatgttctacaatgttttttatatatacatgtatggatatatgtagtagaactgctaaaccaaggtagttagcatagtcattatctcttatccttatttgtgtgtgtgtgtgtgtgtgtgtgtgtgtgtgtgtgaacatttaagatctggtcacttagcagtattctaagagaaataaattaatggagcaatgaaagccgtggtgttgcccaataggctactgaattcgtatctccagtttttactgaacttgggtttcgcagtcctcattccatctccagcccttgggagcagcccctcactgggctgtctgcctgggagtcctgcctttgtagcctcccagatggaagcacgaaagcacagcttcatgtagttcctgatacacctaggtcgagctctgtcacctgctgttaggttctgctgatgtcatcctgtcttgtttgtactgccgagtatgtgtgtgtgtgtgtgtgtgtgtatgtctgtgtgtcttgtgctttcagttgactggggttgtcactcccggcaacaatgtattagttagttatatacaatgtattagttagttatatacaacgtattagttagttatatacaatgcattagttatagacttatttctctgttggtggttactttacctggatttctgcagttttctcagttccctgagggatatcacatggctaacaccctttagatgtctagaagagaagctcctgtggtatacacagtgactgcttatggcatagagtttaattccctgcttgaggagacccctagagacttaaacagtatgtagctttgacttactgaaatataatgtaaggactttcaccacttcctggacagaacagagttcctagaaggttttaactccatttcctgccaatccctagcttgaagaattattggcaggtattttaattttcgtatatttgtcctcaacagaacacgggtgtacttggatctacccatttactcgtgccatttcttgctgatttcctgtttcatatgtccagctcttggatatctatcttggataggttatgtgttacttgaagaacttgcttttctttggtgtgagtctgctaatgatgagttttactgatttttgatttctggaaagtgcctcctttggtctcctttataaaggataactttgctgagtgccgtgggtcttaggcctgtagtcgttgtctgtcagtacttaaaggtcccaccactttgtgttcaggctttcctatttattttgtgtttcaaaacaaagtttcttggaactttgcaatcctgctgtcctggaactccatagactgggctggcctcaaactctcagagatcctcctgcctctgcctcctttatgccgggatcatgggtgtgcactagcacactggcatttcctaattttcaggtcacatcgtacttccttgtgtatcagtcaggttgtctttaaattaaatttcaagtatattagttcatattatgttgctgtattaaaataataagctggtgtttttttttttttttttttttaaagacgtttatccagattatggtcttagatgttaaaagtccaagattaaatggttttgtactttcagcctctagtaagggccctcttggctcctgcataatatagcagatggcatgacagagacagacagatagaaagcacaggcctgtcctttttttttaaaaaaaaaagatttatttattaatttcatgtatgtgagtacactgttactctattcagacacatcagatggttgtgagccactgtgtggttgctgggaattagaatcaggacctctggaagagtaatcagtgctcctaaccgctgagccatctctccagcccaggtctgtcctttttaacagcttgcttgcttgagagctaactcagttcttcagcagcagcagtgtcttccaaaggccatgctccccacttggctacggccccagtggcttaaagttctgccattcaacaccctactctgaggaccaggcctctgctctgtagaccctgggaggacaaaccacatcaaatcatagcatcatactgtgtatgcaagatgtctgactgtgagctgggcctggtggcgaacacctttaattcccaagctgtggatctcggagctcaggacatcctggtcttggagttttaggccaacctgaattttatagagggcacctgtctccaaaggaaaaaatgagcctgaggttggctttgactttacaataactttctctgcccccacctctctactttgttgttgttgttgttgttacttttttttaaaaaaagaattatttatatatttattttatgtatatgagtacactattgctgtcttcagacacaccagaagagggcatcagatcccattacagatagttatgagccaccatgtggttgctgggaattgaactcaggacctctggaagagcagtcagtgctcttaactactgagccatgtctccagccccgctgttactttttttttttcttaggttttgttcttcaaaacaaaacaaaagcatctgctttatttttgggaagtgtatgtgtgagtgtgtgcctgccgtggtgtgtatcgggggacaatttgtgtgagtcggttttctcctctcgctgtgtggttccagggattgaattcaagttgtcaggcttggtagcaagtgccttcactcactgagccaactagcccacctttaaaaaaaaaaagctgggcgtggtggcgcacgcctttaatcccagctctcgggagtcagaggcaggtggatttctgagttccaggacagccagggctacacagagaaaccctgtctcgaaaaacaaacaaacaaacaaacaaaaaaatgtatacgtatgtacgtgagcacgtgtgccgtcctgcacgaggaagtcagagggcactctctgtgttcatctgcacctcccgcttgattgccatagtgtcactgtttgcagctgtgagtgtcatcaggctggttggtccagcttcccggggttctctgtctccactttccataggagtgctgggattgcaggcagagatgccatgtctgctggaccttacgtgggtccaaactcgggtcctcacacttacaggacaagtactttactagctgagctgtctacccagccacagcttcttttaacagaccaaggttgggattgtgcaatggaaggtagttcattagcaccagctcccaacacaaaggtactcttaatatggccactgctgcttttttgctttttgctttttgtttgtttttgaggcaggatttctctgtgtagtctcgactcttctggatctagtctaaagaccaggactggccttgaactcacagagatctgcctgcctcggcctctggagggattaaaggtgtgtgccaccactgcatggctgctgctgctgctactactgtttcctcttctcaggtttgtttgcttgcttgcttgcttgtttattgtgtatgtgaatgggtgttttgcctgcatggatgtctatgtaccacatatgggcctggtgctcatggaggctggaagagagggtatcagttcccttgggaccggagttacagttagttgggagtcaccctctgggtgctgggaattgaacctggatccactggaagagcagccagttctcttaactgctgagccacctctttagacccgttattgttttttttgtttgtttttgtttgtttgtctgtttgttttttctcttcaagatactagatcttgaaagtagataaataaccgcagcacttgtgtgttcgtgtatatgtgtgcacatgtgtgcagatgtgcgtgcttgtgtgtgtgtgtgtgtgtgtgcgcgcctgtgatggccagaagagaatgttagatgtctttctcagttatgttccaccagcgtttttcagatgggatctctcacagaacccatctctcaatgcttcagtcacagactggctggtgagcgggccccagggatcccccagccgccacctccctagccttgagattacagatgtttgccaccacatctggcttttctatgtggattctggggatccaaactcatgtcctgatgttttcctgtcaacacttctgccaccaagctgttcccagctaagccatgcttgctttttgtgtaaaatctttttttctcttcaatagtgctcaattaacacgttcgcacccaggacgttaatttaaagccgtctctaacatcttcctgccatctagaagaattcatctttatatgccattttatttgctagatctgaagccatgacttcatggccacttgttaaaattgacctgaaaagccagtgggtgtgcctgtctgtgtgtgtctgtgtgcctgtgtctcttcgagtcttcccaagagcgtttctcttgacttctgctgggcagcaaagggctctagcaatcctgagtcacttttacttaatcagaaacagatgaggtgatttaagcattcttccatgtaaggacaagcctgtttgccacttgctgttattctgagccacagcttttattctggtagtttttggagctgtcaaactctgcctagccctcatgctgcgcccccccccccccccagttgcttctccaagtaataacgttcacctgcaggcacaaggcagctaagaggctgggcttgcccgtttgaccccacatccacctcaggtcttgggtctttaattctttgtcaagctgtttgttctgatatctccgggaatgtttttttccattcagttcagatttcctgtttattctgttgaagagctggcctgcatgcttgttctctataataggaaagagacagggcctttaagatcattgtgaggtaattgactcaagctcatcggatctctgaggtcttctctgtggtggggaaagtacgttggaggctggaagttgaggcctggtagcttgtcttgacagagggtaggaaggagccagagaaactagtcggtgtctccatttcatacctgaggaaacgggtccagaaaaggcaagagactgcattagcctgcttctcctcactctaacaaaacacccgaggcaggctaacataatgaagaggttagctcattctagagaaacaaggtccaggggccttttctgggggcaatcaacctgcaggcagacaggcagagttccaagatcattgcagtgcttcataggggaaaaagatagggaacacacgtgtctgtcatctgtgtgtctctgtctgtattcttctggtccacacaggactggacaatggtggctccactctgatgaccttacgtaacgccaataaatcacctgcttgcctctaaataccacccagacttcagtctccgccttcttcctactgttaacgtcaggctttgaggattaaacccccatgactgtgaacttggggtgcaaatgatattcaactgtagcactggggggctctgtagcttaataaatggtagggcacttgcctaacatgtgctggtctcaggttctgttcccatcaccaaaccgcaaatcgccacaagccttagacttacctgaggtcagatggccagctaatggcagagctgaccctagatcacatcttctgagtcattgcctttgaggagtttggctataccagagggctccgagattactgagagatcctgcaggagagttagccccaaactgtctgctttctggggtcttgttctgtggcttgatatggggggggtgttgttatattttgttatttgtttatttagtatgtttctttgtattgtagacatttccaatcattcataaaaacagagaagggtctcgtgactgaatgcatagttgtcccccaggtctcataattctatcagaatacagccaatcttgctttatctgtactctcatgaccctgaatcattctgaggcgcatttcatattgtaacatttcattcataaatatgtttggcttgcatcagaatacatacatatggtctatttgcatgcctacctgcctgcctgccctgccttccttccctccctccttccttccctccctccttcctttcttccctgtctccaaccaccccccccccactcctttcttttaaaaatagtctcaatagcattgtcacaacttgaaggtcaaaaatactccgaacagtttaaatctcttacctgtaaatagttggagctggttttgtataggattgtctggcacagcgggggaggcctttagctccagatgtagttagttttctgttgctgtgataaatgctaaaaccaaaagcaacccgtggcggagggaagagtttattttatcctgtagtttacagtcggacatgagggaagtcagcacaggaacgcaggcaggaacctggaggcaggagctgatgcagaggtcatggagggatgctgctcactgccttggtcatcatgactcactcagctgccttcctagagaacccaggaccacctgcccaggggcgagattgcccacagaggcctgggcctcctccatcaattagaagttgaggagattctcccatagacttgtcctcaggcctatctaatggaggcagtttctgaactgagagcccctcctccttgctctgtttggttgatgtcaaactgacaaacgcaagcagcatggctcctctgcagtttcctcctgtgtagccattactgttcccctaccggcagagggatgaacattctccgtttgtcctaattcgtagaaggagcatgagaacacacagaaagaaaaggtcatgcccgggcctcagcaggagagccccccttggctggaatgagcttgaaggagctggatccttgaagcggggagagcctgcagcactcgagccaacttgaccgacctttgtttactatgtgaccagagatgccgtagttgctgcttccccttggagagtgttagcgtggactaagaaaggctctctcttgatggccctgctttctgttcagtagacgctcataaggcataccatatagaagggcaagctaggaaggccagcctctgacaacatgggtgagctaccttctgatagtagcagatcttctgactgtcacgccttagctgaggttttggcacaaaactcgggcttctctcccatacagactctggacatcagtagtgacagaactgttattgcaaccacacaatattgatttccatatatccactcatatcgctacataggaggctgggccgcctgtgctctgctgccctctctaggccgaggatctgaacgccagggtagagggagaagtgctgtgggtcggggattttgctcagtagggtagtgtttgcccagcatacgcaaggccaaggatttgatctccacccacaaaaaacaaatgtgcttattcatttccacatactgactggttggtttaatcttcatagctcccaggtctggtaggcatttcctgttctagtctcacattaaaggtgaggatggccgggcgtggtggcacacgcctttaatcccatcactcgggaggcagaggcaggcggatttatttctgagttcgaggccagtctggtctacaaagtgagttccaggacagccaggactacacagagaaaccctgtctcagaaaaaaaaaaaaaaaaaaagtgaggagatatctccgtggttaagagcactgactgctgttccagaggtcctgagttcaaatcccagcagccacatggtggctcacaaaccatctgtaatgggcatccgatgccaccttctggtgtgtctgaagacagtgacagtgtaccacatatgtgaaatgaatagataaatctttttaaaaagaaaagagagaaaagtaaaagtaggacagacagcttcctcaacctaaacccctcaccgtggcctcctgggaggtttgctagcctgtgactgtctggtggggcaataagccgagcttcgaagctttctccgtcttccaagacgacaggtttctggggccacaagaggccgagcctcttcattttgttttcttctccaggctgaagacctgaacgtcaagttggaaggggagccttccatgcggaaaccaaagcagcggccgcggccggagcccctcatcatccccaccaaggcgggcactttcatcgcccctcctgtctactccaacatcaccccttaccagagccacctgcgctctcccgtgcgccttgctgaccacccctctgagcggagctttgagccccccccttacacaccaccccccattctcagccccgtccgggaaggctctggcctctacttcaatgccatcatatcaaccagcaacatcccggcccctcctcctatcacgccaaagagtgcccatcgaaccctgctccgctctagtaagtgaccctggtggctgtggtggcgggttataggggactgggggctggaggacgacctctgctatctccccctggagtggagtggagtgatgctggttggtcctcctgtttggattctcatcctctgtccaccctttactgtcagacctgcaagtccaactgctcagaccccagttcgttcaatattcagcaaggatcaggatttgattagtcatgcttggctgctgatactcagctgatccacaaacagcagttccttacgattcaatctaatagctccctcctcaggctgtggtggggatcagttacattagcattattcatagtaggtggctgacctggtctcctgggcttgttgatacgttttggtcaagaacaggccctggtgttgtgaggcttaaaaatgtccattttgcaaaggggttctttccttttggaaagtgggatcacctgaccccttacagcagaccggcgcaggtgcagtcttctcccagttaacctctgaccccagataccacccatggtgtagttctctggtgcctcctggtgtctgtggatggaaattgcctggtgttggcaagcacaggttttgcttacctgggaagaagtttctttctctggcttggtttgggttggaaatcacagagcagagccaacaaggtatcagtcagtgtggccagcaagtgtttactgagcattgtgtgtaaaacctcacactggatcctgtgcaggctccaagaatgtatgggtaccattatctagtctaaagaaagtgcacggtgggatcattggggaattgacaagaaagcttgggagacagaaaaagcagaggctcctagcagtgtgggaccagcaggcagtgaatgaggccgacaccaagtttctaacctgtgtggcagcctcctggatagataagggaagaatttgggagagggtggagccatagctgagctcgaactgcagagtgggaggggcaggcactgaaggcgtggagtggggctgagcgggggagtgagggccgtgaggttggggtgagagcctgggtcatggggtgggagcacagggaactgcctgaaacagccgagggggggcagactttgtctcactcacgttgcagggggcagcagcagaggttttgtgtgttgttttgttgtgattaagggagtgttttcatccagtcaggctttaagattaacttggagaaaggtgaggcccctccccctccccctcaaaaaaaaaaatccagagagaagatgaaaagataattataaagaggcctttgacatctccctggtatgcttcgtcccggcctctttgatagaacaaaacaaaagtaaaacatagctctatactgcagcgtgtgcagagagagctcctggaagctggggctgggcttctgggggttgtgctgatagctgatagttgtggagtgccaggctcttttttaactcacacatctcattacctacaggagacagaaagaacgaaccccttttgcagatgtgaaaactgaggcactcacatgtttaatacggggccggagttgcacagtcgtcagattgcagagcaaggacagagggtgcctgggttccgagtgtactcaatgagtcaccgctgtgactcttgcatgcaggacagcagtctaggacaggagtgttttcctgaagggaggaagaggccatttaccaatttgttctttgctcgtagatagctctgaagtcaccccgcctgtcctctctgtgatgggggaggccacccctgtgagcatcgaaccgtaagtgcagcccctgccccaggcccatgatgtgtgggtgcccaggtgggcccaatgcattgcagattagcactgggttccctgagcaaggggagggttctgtggggccttcttagagccagactctctgagcttctgtagtctatcctggcctctcttgtcttctgccagcttttgtgtggacgttgcagagagagggaagggaaggaacaagttggctcgaatttgtcatgagggagagctgggcgggagggtccaagagtctctcctgatctgtcaagtatggagtcatgccccaggccaggctgtcttcactgtctcccagaagctacattccctacacccaactatggctttactgcactccgcatctgccagctgtaccgttttcttcccatccttgggagaaaatcaggttctcacagtgtgaggccttactccctgcccttctacccctgcagacgaatcaacgtcgggacccggttccaggcagaaatccccatgatgagagaccgagcgctggcagcttttgacccccataaggctgacttggtgtggcagccatgggaacatcttgagagcagctgggagaagcagagacaaggtaaggagagatctccagggagcaaggcatggcgggctggtgggcagatgggtgggctgggtcctgcaggagccagcccctaacttgatttcctgttctcccaatgcttctggtgagtccagtggatgacctgctgacagctgcctgttcaagcattttccctggggccggcaccaaccaggagctggccctgcactatctgcatgagtcccggggggacatcctggtaaggaaaatcctggcgggggggtcctttaagaaagcaagtgcaggtttctccctacctgctgccagaaccaggcttggtggtataaaattttatttcccctcccccaacccctacccctaaatcatggctgtctgccttgccttggcctcctcagtatggggatgacgtggtgtggtgattcgaggcagttacagcggggggtgtctgagcaaggaagaggctattggagtttggcctaagggaactctagtctcaaaccctggctgggtgtgcaaggccctactgttgagtccgttccctgattctacattagtagatccccccactctcagacaggattgccaccgagggcaatgatggctgtggtttccttaaagtacgcctgcaatggtcttacgacccgagtcttcagcaccccacttcctgtgatttttaccatactcccatgtgccctgtctctcagcacttaggccaggcaagagtaagtgactactctacccagccactggaggaggctctccacatgttccctagcctgggtcactcatgtcatgcgaatcttccagcttcctgactgccctttcttcccctccaggaggcgctgaataagctgctactgaggaagcccctgcggcctcacaatcacccactggcgacatatcactacacaggtaggcctgactgggtggtcacggggcccagagcctcaaagctctccagcatccatgggttcctgctcagggctgagacacagccctgaatgagagttgggacaggcagtcagccaacagtcagagcaaggaaactaatatcaatgtcactctcttggggctcccatgcccttgaggggaagcctgaagtgggtaggcaactgaggccaaaaagaaaagaaaaaaaaaaaaaaaccctagtcaccaggtacagaggtcaaaggtcaaacctaggatgtgcgatccaaactgatgtcaggtacctggaacttacccttacagcgcttgtcttattctggacgctgtactgtaagagaggcatgaacacagtcacgtgatcccagaagcctcgattaggttcccttttgtctgtaccaggcagagccagccccgaaaggttgtttccaccttacagcctttagtctttctcaggcctggaaaggcagggttccgatggtcgttcacacctgacaagcagggagagggaggcttcaggaagccgggagtacggaaccaaagcagactcacgccttgcagggcggatgctcatgttcctgcccgagtcacaacctggccccctctttgccctgcaggctctgaccagtggaagacggctgagaggaagctgttcaacaagggcattgccatctataagaaagatttcttcctggtgcagaagctggtgagcaggggcgagtgaggggggctcctgtggtcactcggcaagtggccagatatggcagggtgttcgtcgagtgtgcctgagttcggcccctatcactgtggctaggtcactgctcttaagtagcttcagaggcagtttgaaaaaccacagctccacagaggatcctccactgacttctgagctctcgggactttaagcctagataaggctgaacctagcaggcaagtagaggaggcaagagaaaacaggccttatatgggagtgtattggccaaaccaaacccagtggtcccttagactctgaaataggagagctggatgccagcgttgaggaggaccatggagatgatctgtgctctagtatcacacatcacatcacttattctgcacacatggaaagacagaaattaggaaggggtgtgtggggggggggtcaccttaggatgtacaggcctttggtggcagttagcaaggtaagggccttctgcttcctctttaggctgtccccaaatcctcctggacatgaagacactgtgacacttctctctcttactttgcactgctccctggagagaattggatccattcccctgattgatgaagggggggcaggggggagcggggatgcactgctgtattggggctgtaattggggctggctttggatgtggaaggtgtccagatactttgaagttttcaaatgtatagaaaatggagaagagtaattccatgaccacccattaattaatgcctttctggggtttaccatttgtcttgtttttgtttctttctctctctgcatctaaacacagacccaggaaatacacagagctatctcctctagcccccccccccccctttctgtttcaccaaatcgtttaaagtaagctatagctgagcctggatgtataagcctgcaatcatggctatttggggaggagggtgggtgaggtaggaagattacaagttcaaacctgggctactaaaaaaaaaatgagttcaaggtcagcctagataacttagtgagactctcaaaatttaaaatgggggtgggtaggattggaagtactatttaatggtagagcattcgcctagccatgttcagaccatatgttcagtgcctagcacagggccagaggattattttcaattaaaacttccctgagcattggcaagcaatttaaaggcacagtgagaggcccgtggagatggcctagtggttcagacatcacattacttaatgcatacattgaaaagcaaaaattagaatgatgtgccctctttctttcacctggggaccccgggaggagccaggtgaacttgcaagaagttagagggataagaacgagttcacttacactgctagttacagattctgacccagccgggcctcctgagcccctcctggcccagtgcagcctcttgtactgggactctcgcaggtcacggccctctaatatcgagtccacagtcaagtctacccagaacttctgggccttcactgaagtgctgcagaagcctccgttaattgcattggtcagagattcattgtggagtaggcactgagaattggggtttgggatttagtcttttgcctaaggcttaaagggaacgtgaagagatgagaaaggtgagccacatgggctccccctgacctccatgcggctttaattcagatccagaccaagactgtggcccagtgcgtggaattctactacacctacaagaaacaggtgaaaatcggccgcaacgggacgctcaccttcggcgacctggatatcggtgacgagaagtcaggccaagaggaggttgaggtggacgttaaggtgagtccttccccggctctgctgcatcactctgggtaacaccttaggccaggacctaactggaggcctgaggactctcctggggtttatacagggctgacagaggaggagagcaggtccctggcagctcccgggagctggtgccccaggccctggcccttttgagctctctccggtatcgactgtcgcggtcgcagtgatggtgctgatgctgaacactggagagtcggcggcacagctttggcttactgcctcttctgagcagaccaccaaggtcacttctgggctccagctcttcttgtaccacctttatgatttctgctttgtctgtgcgttaacacacaccacaattactgtttctgtcacgtctcacacaactttttttttaaaagatttatttatttatttattttatgtattcatatatctgtacactgtagctgtacagatggttgtgagccaccatgtggttgctgagatttgaacttaggaccttcagaagagcagtcagtgctcttaaccgctgagccatctctccagccccccacacaacttttattattaattttttttttgagtcagcccactctttttctcaaaagggaagctttatattacaatcataaatagaaaccagtattgttgcctataaatagaaggtactgggaaaaataagtccacatgaaaaccaaaccctgtcactaaatgccagctacacgctgcagttgcttgccaggcctctgagacagggctggcttctcatttaggcagattatcaagtctagggaagaggcacattaacaccaaccctgacgtggtctttgagagacactgtgatttaattttgtgcccagaaatcctcttgaccttgtctctaggttacaaggcaagatttggtggtgttctgctttgagatgagggagtattttggtccccatattatagatggggaatggagataaagtatcacagacagttaaattggagctcagagctactgcctggcacacgaggtcactgtgtccaaagggtgctcaaaagattctgggcatctctccaggaggccaggtggtttgtggatcctggcaagttccctccatatccctggctcagtctcacccagagggcacccagggtcaagactatcatcctctttccgggccaactggccatagggaagctgtgacttatgacagagtctcagtacaagaggctggactgggccaagacaggactgcagaccccgcaggtgcttcagagccttgggtggatcagagtctgcactctggaatgactgggttcattcttgtcccccatagacttctcagaagttcccaagggtgcctcctcccagaagagagtccccaagtgaagagaggctggagcctaagagagaagtgacagaacccaggaaggagggggaggaggaggtgccagacacccaggagaagggagagcaggaggaggggcgtgagcgctgccggcgggccgctgccgtcaaagctacacagacactacaggccaatgaggcggtaagtgacctccacctttattccctgagggcagggcaggaaggctgagcgaggcctgaggtgtgggtgggaggacagcaagactttggtgaccctcatggttatagaccaggtcctttatgcccttaacttccttgggtctcaaccctgtgtggttgaggacggactatgatgaagctcactttacagctaagcaaactggggttgaaggtgatgtagcttgtggacagcctgattcagactgtggtttatctttccaatacaaaaagtataattgtatgtaattatatgtatatacatgtatgtatatgcatgcatattatatgtatgtatatatacacacatgcatgcacatactatgtaagtgtttctgtgtctgagattcagaggaaacaggccttgtgaaaacccagtagttgtgcggtaggggaagcactcataagctgcagctcactcatggctcccctagaacatgagcctggcaagactgtctggagtagggctggagagatggctcagcgggtaagagcactaactgctcttctgaaggtcctgagttcaaatcccagcagccacacagtggctcacaaccacctgtaaccacctgatgcccttttctggtgtgtctgaagtcagttacagtgtacttataataaataaatacagtgtttaatgataaatctttttttaaaatggccctgtggccgggtggtggtggcgcacacctttaatctcagcacttgggaggcagaggcaggcggatttctgagttcaaggccagcctggtctacagagtgagttccaggacagccaaggctacacagagaaaccctgtctcaaaaaaccaaaaaggaaccattaaaaatcaacatattttccagcctggtctacaaagtgagtcccaggacagccagggctaaacagagaaaccctgtctcaaaaaaccaaaaaaaaaaaaaaaaaaaaaaggtgggtgggtggggccctgtatgttctctgtttcatgtctgctatctcactgattcctcatagtaactgcacaacgctaactcccactgagagcatgagggaaatcaggggcagagatgccattggacctggctctaggtacagcccaggtctttgtggtctgcccgttcatagactaagcatggcatctcattttagcttcccagggaaaattctccaggaagtcgcagagatggggaagtgtgcacactctccctgcaggactcctgtcagccagacacacctgtgtgcctcctgctgggctgccagcctgccaggagtgtgcagtgtctgctgtccgaggggtgacagagggcacgtttatcgcttctgatggccatttggggttcctggcctgagatgaatgcaggcctttaaacgtccttggggtgcacaccatggttcctctgctctctgatacctgttctttctcttctttttcccctcctagtacttcctcagcaagtgactgccacatctgtccctttctggagacagggctcctgttggaggagctgacttcctatcacctaacacattatgtgaacgcatgtctctctggcatggcgatatgattgcactaaatgtcaaaaaacaaaacaaaaaaaaaccaaaaaccgtgaacacagagtcagtattgatgcctatagctgccagagtgtggcacagaattactgtgtcagccactctgtgatagtgccagctgcagaggcctcctggaagcagccagcaggtcctgtccctgaccatttggcagggatgtgtgactttttagggccctctgtttcttcagatgccagaacctcaccttcacacttgcctctaagacacgccctgtttgttgcttgtctccaggccaatgacgttctcattctccggagccatgagcccaacgccccggggtctgcaggtatccagacctcagagaagccgagggaggggccggggaagtcccgaagggcactgcctttcacagagaagaagaaaaaagccgaggcatttaataaaacccagaaccaggagaacaccttcccttgtaaaaagtgcggcaggtaagaagtcccttccttgtcttcagaggaacccattaatgttagggcagggactttgacgctgctgggggcggggccccggatctgctttttttgatcagctcagtgggtttccagggtaatggcgtcatgaggcaggcatgatatgaaggggcggggcgggaacttcccgagtgggcggggcaagggtaggggctaggtggaccggctggggtttgagggaggagagtggaggggtgactctctcatcggagcccttcctgcccgccgcagggtgttttacaaggtgaagagccgcagtgctcacatgaagagtcacgcagagcaagagaagaaggccgcagctctgaggctgaaggagaaggaggctgcagcggccgccgcacatcagcaggcgctgagagaagagagcggcgaaggggagaagggctgaggaccctgctggatcctattgccgggctccccagcaccccagtccctggaacctctagaaggggccaggagagggtcacttggactttgctctgcagaacaaacccgataatgaaaaataaaccggctcttttatttacaaaggccaaggacagtgttaagggctgcaggatccagttctctcagtatctggttggtcccgagttctgctttcccggagcctagagaggccgggccacttggaatgggctagagctctacagctgcttctctgatctctgctgttgcatctgtgcctctttcatcccaggtccttagtaagccaccacggcaagccaagcacaagctcgccccatggcagcattgttcctccttccgcagaggacctggaaggctgtgcagacttttatctaagcccccagagggactccttagagagcggtggccttaacacctgtgttgtccttgtgctgtcatgctcaggccggagttgctccaacaatcccgtctggaggtccccacttccttaggcgtatctcggagggctattttcaacccctttgctgcttgttaacagcccgtctggggctgtcaaagttttctcagaagtttggagttcgtgccctgctctcagcctactacacggagaggaactgttcagaggccagaagatgcagagctctgcccgagagatcttttgacaaactcatgactagcattttatacctttgagtcccggaggctgctaaaggagcctcaagcaggtcctagagaggcctggcctgctctttggtgccagcttccttcttgcctgtcgagttctcagtagctgccagctgatcccaccgcaccccactcaatgttgatattcacagtcctccctccccccaatacggcatgctggagtttgctggattcttccctgggagggtgatgtctcctaactagattagacaggagccttcattctgtggcttgttgtcatttgggaactatttatttattttttttaatatttaagttttaacatcctcagggaccaggggcctcttgctttccagaggtccaagtgcatttatcccaaaataaggcacctttttggcatccccaagccctcccccagttccatggccctggggtcccttaccttgtggctcttggccgcaggaatgacagaaactgatcgggctgggaaggcggggagtgttatcagtcacaggaagccagcagatgtgggtgaggtcaaaggcaggtctctgtcctgccttttctgtactttcaaatgctcgagggagttggcaagaggccagaattctagttttggttatcagcctcgattctggcttgaagaaaccatatttggcttggaattactgaagggttggaatgttctagagtccccttcgctttccagttcagtaggggcctaaagccacttttctgatatcatcacttaattttagttgtacaaaagagagtcttaagtgaccgtgtgtctgactgtttagaatgttagtaaggagcggaaatagcctacagcccgttgggaattggaaatagagatggggttttgttttgaagctgtagactattgggtatttcttacattcatttacacattagtatggttctatgagagagctgcgggtggaaataacaaacctgtccccctagatacctagacagttaccttaaccttcagtttccccggtttgtttccttcataggcttctatcagctcgaagtcccgggattacaaaaatgtggtaccctctagaagcaggagggcaacaagtttaggatctcttctaaatcacttctataacgcgtgccttcacagctcagccccaaagtgccacttaggtttcccaaggttcttttctatttaaaccatatctggctcaggccccttggtggacaggtgatagcagccacatgagatccttcagccacatgagactcctctgctcagtggtaccaactaatccttagaaatcttaattaaaaacagcaaaaaagcaagaacttttctaagttcacagagaccagatgactatagccggggtgggggtggggggataaagatggtacctttaggtagtgatcccaccagacactgttttagaggggcccatgctccagcgcgcccgtgtggaaactgaactagttcaaagcggagatgcacgtgcggccggaggctggcgcaggcgcgtccttactggtgctttctcgtacgaacacactgggcttggcttttgttgttctttctattcagagctccctgtttgacaataacgtccctatacagtgtcaccctgcctgtcccccagcttccacctgcattcagagaaggccatgacactgaccgtgcctgtgttctgggccatctctgaggtctcttgccctcactgctgtcctccaagccttcagcagcccccttagagctaaagtacccacccacccaccgtccttgccgccccacctcccaccccggcacagaggccctgtgctcatgatgtctaaagggattgcctatatttaactgcctcagtcacccaacctctttcttctcatgtgccagatgttaaagacagaggaggaagagtgcaatagtactcaagcctcagctgttgaaatgtttttattggggctcactgttctgggttattatttattactagactggcaaagcctaaccccttaggtttttacaggaagtatgcatatttttatataaaaacagttgtgtctaacccacatttggctgtgtttgttgcctcaaaaaaaaaaaaattgcagctgttagaacttttcctcatttgtctcttacgttaaaggccttgctggagaggatggagcacagaacagccttgacagtctgtaattagtgtacaaatattttaatagcataaagtaagtatattccttttattttgaaacaaaatggtcagacactgcctttcatgtgtttgttgcctgtggcactctttttaaaaaagactgttacatattaaaatagtgtacatatatatatatatataaatataaatattacctctttgtgtacagttgtgatagaccagactgaaaattttattttttgtgtgctttttataaaaaaaaaattaatacactaaagagaatccttgctgtgattgtaatgtacctatgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacacacacacactttaaacaagaaagccaagtcagacactcacaggaaccagtaagatggaattcctctttcctagttttgtggggaggaaccaagtagttgcagagtgggatcaggtggttcccggaagtcagagttaaagactgaattcatagaatggatgagcaatatgagataagtccgtcgtggtagatgcgtatcaataaagccagcttaaatccacggcaaaattaaataaagcatgcgtagcaatagctaagaaagaatcagggaaggcgggggggggggtgtaaaaagaaatgcgccgtcatagaatagactcctcaaaccccttcttggcaccatagcaaccgccagatcctctggagcccgcgtatctcgcgtcgtcatggacacagttgtcacggtgacactgggggagacaagcggaccggttccgccctccactgcagctgcacgccggccgttgcgggagcgcgcggacataagcgctaggcagagctgcctccagccgagtttctcccccatcccgtgcttcctgccgcttgggttcccggtgctcggagtgccgcctctccccacgtagccaagccacggcctcgcgtgaccctcagcccgccggcgtgccggggagaggtgggaggagctgccacgccccgcgaccgcacccagccatctcccgcccggagtcatcagtcttgagcccaccttgctccctctctttaagcggtgacgccagacacagctgcagccagttcagccctccctgcccggaccaaagggggcgacattcgagtgataggcggagtgtcccgtggctcccgaccctgacttgggacccggaaagggacaagaaggaactctggtgtcttttggtaatttgtggttgcctgaagcttgtcgccccctggcctaccggggggaggagagcatgttgtattgtcctaggccctatagcctcgtgagccagtccaagcagtgtctgtagaactggcacttttaatagttgggtgaaatggctatgacactattggaagactggtgcaggggaatggatgtgaactctcagagagctctgttggtctgggggatccctgtgaactgtgatgagaccgaaattgaagagaccctccaagctgcgatgccccaggtatcctatcgagtgctggggagaatgttctggagggaagaaaatgctaaagcagccttgttagagctcactggggcagtggattactccctgatacccagggagatgccaggcaaaggagggctctggaaagtggtgtttaaaccccccacttccgacgcagtttttttggaaaggctgcacctctttctagctagggaagggtggaccgtgcaagatgttgctcgtgtgcttgggtttcagaaccctgctccagctccaggcccggaaatgccagcagagatgctcaactatattttggataatgttattcaacctcttgttgagtccatatggtataagaagctgacgttattctccgggaaggacattcccgggcctggcgaggaaacctttgattcctggctggagcactcaaatgaaatcatagaggaatggcaggtgtcggatatagaaaagagacggcggttgatggagagtttgagaggccccgctgctgacgtcatccgcatcctcaagaccaacaacgccgccataacgaccgcagaatgcctgaaggctcttgagcaggtctttgggagtgtggagagctctagagatgcacaggtcagatttctgaacacttaccagaacccaggagaaaagttatcttcgtatgttatccgtctggagcctctgctgcaaaaggtagtagacaagggggtcattgataaagataacgtgaaccaggctcgcttggagcaggtcatcgctggggctaaccacagtggggccctccgaaggcagttgtggctggccggggctgaggaagggcctgcacccaacctcttccagttactggtgcagattcgagaggaggaagccaagaaggaggaggaggaggccgaggccgccctcttgcagctaggcctggaggggcacttctgagtcctaggactggccaggctgcttttgatatacctgtgacgttttagtaagcctgccactcaaagcaagcacccagcctcctcctggcttggttttgt

SEQ ID NO: 1514 - DNA, 976 bp, Mus musculus
ggctgaagacctgaacgtcaagttggaaggggagccttccatgcggaaaccaaagcagcggccgcggccggagcccctcatcatccccaccaaggcgggcactttcatcgcccctcctgtctactccaacatcaccccttaccagagccacctgcgctctcccgtgcgccttgctgaccacccctctgagcggagctttgagccccccccttacacaccaccccccattctcagccccgtccgggaaggctctggcctctacttcaatgccatcatatcaaccagcaacatcccggcccctcctcctatcacgccaaagagtgcccatcgaaccctgctccgctctaatagctctgaagtcaccccgcctgtcctctctgtgatgggggaggccacccctgtgagcatcgaaccacgaatcaacgtcgggacccggttccaggcagaaatccccatgatgagagaccgagcgctggcagcttttgacccccataaggctgacttggtgtggcagccatgggaacatcttgagagcagctgggagaagcagagacaagtggatgacctgctgacagctgcctgttcaagcattttccctggggccggcaccaaccaggagctggccctgcactatctgcatgagtcccggggggacatcctggaggcgctgaataagctgctactgaggaagcccctgcggcctcacaatcacccactggcgacatatcactacacaggctctgaccagtggaagacggctgagaggaagctgttcaacaagggcattgccatctataagaaagatttcttcctggtgcagaagctgatccagaccaagactgtggcccagtgcgtggaattctactacacctacaagaaacaggtgaaaatcggccgcaacgggacgctcaccttcggcgacctggatatcggtgacgagaagtcaggccaagaggaggttgaggtggacgttaag

SEQ ID NO: 1515 - protein, 325 aa, Mus musculus
AEDLNVKLEGEPSMRKPKQRPRPEPLIIPTKAGTFIAPPVYSNITPYQSHLRSPVRLADHPSERSFEPPPYTPPPILSPVREGSGLYFNAIISTSNIPAPPPITPKSAHRTLLRSNSSEVTPPVLSVMGEATPVSIEPRINVGTRFQAEIPMMRDRALAAFDPHKADLVWQPWEHLESSWEKQRQVDDLLTAACSSIFPGAGTNQELALHYLHESRGDILEALNKLLLRKPLRPHNHPLATYHYTGSDQWKTAERKLFNKGIAIYKKDFFLVQKLIQTKTVAQCVEFYYTYKKQVKIGRNGTLTFGDLDIGDEKSGQEEVEVDVK

SEQ ID NO: 1516 - DNA, 37571 bp, Homo sapiens
cttggaagacacaagataaagatttgaatcttgcttctggctctgtaacagcagagcctcaacttccctctggagaatgaggacataagactcctccataggaggtttataagcatggattcgaatttgtagaggacccagcccagcgaagtactcgttagctcccttcttttgggaaggatctgtcttttggatattttgtagattggccatggaagtggaaatatttgcctgtggccatttttcctagggaaaagcagggctgcctgacaagctgttgcaatcccaaaggcctctccatcccctagttgttttgatgtcgggatcaagcttggggtcaggttcaatgtgtgtctgggagaggggatacccaggcctttgcaagtctgagctctgcggctgcctaggactgtgacaccgaaggtgtggagaacatgggctgaggagggaggggcctttctgagctgagagaacttggcaagttacttttaaccttcgtttcctgtaagtttcccaaatttccttcggttattgatttccaatttcaacccgttttgattggagaacatactttgagtgatttcagtccctttaaatttgttgagacttgtcttatggcctaatgatgatctattgtagagagtgttccttgtgctataaatatacatatatatattttatatatatattatattatataatatataaaaaagtatgtattttttattttttctgagactggatcttggtctttcatgcacgctggattgcagaggcatgaacacggcttactgcagcctcaacctcctgggcccgagcaatcctcctgcctcagcttcctgagtagctgggactatagtggccaccacacgcagctaattttttttttttttttttttgtagagacacggtctcgttttgttgcccaggctggtcttgagctcctgggctcaagtgatcctcctgccttggcctcccaaaattttgggattacaggcaccactgtgccgggcctgctcttttttaaaaagaaacaaaaaaacagttcacctacagctgcagtatctgtgtgctcttgagaagagtgtgtatttgtgtgtattttgctgttgttaggtggagtgttctatataggtcttccaggtctaattggtttatagtgtctaaatcttctatttccttgtcgatcttctatttagtcgtactgttcgttgttgaaagtagagtgttttctctctctcatgtgtatgtataaaataacatgaaaaaaagtagagtattgaagtttcctactgttatttgagttgttcattttttcctttcaattctgacagtttttgcttcatgtattttggggctctgttgttaggtacatgcatgtctataactggtatagcctcctgagggacggacactttgttcattataaaatattctttgtctataataacagtttttgtcttaaagtctattttgtctgatttttttttttttttttttgagacggagtctagctctgttgcccaggctggagtgcagtggcgcgatcttggctcactgcagcctccacctctcaggttcaaatagttctcctgtctcagcctcctgagtagctgcgattacaggtgcctgccaccacatattttgtctgatattagtatagccattctagctgtcttttggtgactgtttacaatggtatctctttttccatcccttgctttcttttttcttttttggtacagagtctcactgtgttgcccaggctggagtgcagtggcgcaatctgggctcactgcaacctccacctcttgggttcaagcaattctcctacctcagcctcccgagtagctgggactgcaggcgtgtgtcaccatgccctgctaattactttcaacctatttatatctctgaatgtaaagggtgtttctttttttaatgaaattgcatcttttttaaagaagtctgttctgccatataattgcatatttttttaaaagtccattctgccaacctctgccttttagatatttaatccattcacatttaaagtaattatggataaggtaggatttatgctgccattttgtgatttgatttctgtatgtcttatgtcttttttattcttttgttcttctattactgtcttcctttatgttaaatagatatttttgagtataccattcctggtctgtaaataacgagacacagaacagtaagggttaaacaaaatgctgcctgcaatggacttagcacagtgcctggcaaatagtaagtgctcagtaaacatgggcactcaattgggtcccaggcgtggtaagagccacagttaaccctaggactggctgagagcagagtcccctcagggctctgtgcgacccctcatgtctcctgggcaggccatagcactctgacaggtagtgcctttggggaatggggagtggtgggtcctgggaaacttcactatgccaggctgtggccctttagcccttcccctgctccagtgcatgggcaccacctggctgcttgtgaagcatcctagattccccatcgtgctcttcccacccccgacccccaccccaccagacccatgaactagtctctcagggtgggttttattgcacacactgaggtttaagaaccactgcttgacatccacacagacgggtattgacacagtgacagagagagacctggtttggggtcaggaggcttagatttgaatcttgactcctcagtcatgagttctgtgaactgggacaagttactttcagagccagcctttctcgtttctcagttggaaataagtggttatgcagataagcagtactctcgcatattcggcatgcagctagtcctggtggcacttgctttttacaaaggtgtttctttggtccctggatacaggtctcttcccaccccaggctcttaagctcctcaaaggcaggaaccagtgagtggcggctcctggaccagacatctggttggttacctgacaaacagtccactgccctccgtcttggatcatgttgtctccaggccctgctgctcccaggctctgtgcaggaacagaagggaattgaagaagcattattggatagtggtataagagcatgaagattcagaatgggtgacaacaatatgtgctggagggccagctggaggaggtaggccttgagggaaagcagattgtgagagtggaggcagggcttccaggcagaaggaacagctctaggggaggctcaaagtcagggagctcccccaggggttgcctgtccccaggggtcacttacccctagtccctgcacgggcttccttgcattataattagcgtgtgtttctgtttctctgtctccccaccggcctggaagctctgtgtctcctgtgtctcccagagcctggcttgcagcaagtgctcagcaaatgcttgtggagcagatgaagggtcagcaggcccacctgcagagctgcagcagggagggtgtgtggtgggggagtgggcagggcaaggcaatggcaagggaggcccctgtgagtggcctcatctgtatctttggcccagggcagagtctggcactggggtgctcaggcacagacttcagagagccctgctctagccctgctggggagccaggcctttccagaagggaagggaggtagtgcagcagcctccagtggtgggagctgtatagggcatagagactgttttgaggagacagagcaaggaccccagcggtcccaggaggccctcaccagagggcctcaggaacatctgctgagtctcctgcggaggaagcctaaacctgcctgcttctaccctactcctgctgggatccctgggtcctgttggaatgggttttccagggctgcctgtgattcttcgtggcctttgcctaggaggaaggcaggcagtcccttcagtgcaggcaaaagctgagcctggaggcttaatccttttctggctttgctcatgactgttttctctctgcattagcagcccccacctcccccacccctggcaaaacaaacctggctatcccagcttcccatggacaccctgtgggcatttgtggggctatgggggagggaggcaatcaaggtagaagactggacggagccctgagagtgcctcataagccctgaaaggattcctctcttacacatccctttaaaagcatctcagtggttggcatttttactgtgtaagctcaaacttcaggcagcttgaaccctggccaagcttctgatcctgagcagcttgatggctgagacccctgggactcgtgactctctggcctgttggcctgggctctgcttttcagagctgaagttcagtccagagaagtgatggtccagggactgtctggattgggaatgggccgaccatagggcctcttgcctgctctctcatgctcccagggaaaatgacacttgtgggagtcagatccacgtctgttgtatcagagcctccttgtttgcaaaccccttgagaatagtgcttatgtgtccagtggcttgcagaaatggggtacactggcctttgtgtgaagtcccagttggtgggggtgcatgtagcattgcagatggggtccagagggaaggtttgtctagggcctgggcaactctagctggcccaagatggcagttccaggccatttaccgagtctggctatagctggagaccccagaatgtctgagagagcttttcaggatgtgagcccagatgagggggccagctgggccatgctgtgctcctctggtgggggtggcagggacttgttatggctccctggcatcctggccagaccttagtgtcttgaggtccagccatgtcagggcatgaggtaaacagacccacaggcttgtgtccctggccactgtctaggtgggggtagaagcctagaaaagtggggtggagggcaacagtggagctggcacttttccagttggcctgcatgtgttgtggggcagcaggtgacagtcaagggcaggtggcttgtgggccagcagggagaaggacttgtgttccacataggtgtagagggcctggggccaggggtagggtgggatcccgggctgggccttttcacttcatcccagcatcttgaggagctctcatgtgcaccagagagcccagaagtcaggagcaggcaggagcccagggcaggaatgcgggctgtgtcgcctctgcccaggtgtggctctgactcaccttgggcgcagtcttgaatgagcatcctgacaggcagatacaaaccaagtgccaaggtacaacggtctgccaaccctgccccgtggagcctgctgtctgctggggatgacaaagcaggcacctgggatttagtgtgccatatacagtgtgttataggggcttgtagttcagctcctgtctcagctctggggtcaggtttcccagtggaagcagtgtctgcaacctgaaggattaataggacctggcctgatgaaaagagtgagaaggtgtcctaggaaggggtacagcctggccaaagacctggaagcaaagcgagaagaacacgttggaggccctggctcaagcacagactgtcgagagaggtggcaggagccaaggtctgcagggacttgtggacagggcagggagtttagactttgtcctaagacagctcagagaactgactcgcctggagactcagtttgggcctgtcttgcccttgggtgacagacccatgatctttgactcccctcttcctagtgctgagcttgtggggcctgcccaggctataagagtgggagcttggagcattagcctccaagggcagggggccctcgggtcagctgttatccccaggtcagagctgagcccctgcagctgctgagatcaacttggcatctcctccctggtctgtgtggccttgactcacaatagtcttttttctcaaatggacacactgattgccccaagcagactggtgagtggccctggtcccacagtggccacagtctggccccttgccctgtggtgatggctctctggcttctcctggggtcagccagccagtgttgggtgtgcagctgggctgccgatggcatttggggagcagtgtgtgtttgagctgacatcccaggagagctggtgtcaccatcagcattgaacacccaaaggcctttccagcaccttcccctcatgtgtctgcaaaacatatatgtggggtcagcactgtttttttttttttttcctggtgcacactgctttcttctatagagagtaagtgctactcaccatagaacttcctgaaagcctgctaggtcccaggccttggtcttgattgttgccttgtctttggcccaggggtacctgtgggtctggtcaaggattggttgctgcagagaggagcctggaggaagggaaaagtgaatagagcgtgacagtcaaacagactgacagggcgggttgccgtgtctggggccccgtggtgactgtgggtttccttttgcagtgttcctgcatccgttgtcagaggccctgcagctggtcccagggctgagctgctggcaggagttcctcatgacatcctcttccctgcaatctcagggactaggcccacaggtcagcagcctttggaggtgtcgtccttcctcttcctcactgtgaggaagggcagtttgatttccatctgagggacagggcagcgggggtggggtagaagaaatgagaggaagtggcgcagtcctgaccccgagttgcaggctgggagaagcccatggggtctgagagctggaggcaccaccagcagcaactgagcccggggtggggttgcaggagctggagagtccaggcctagatcgggggctagagtggccagtgcaggaggaagtgtttcaggcctccctgcaggtagacctcacacatctgctgacccctctgtggtgagaccttttcctgctctcccttcctggaaggccaagggtctcagctgtatttggggagaatgggagagagtacctgccaaaggttcaggcaggggtaaggggcttcccagtgccaatgagaagggatatctgatatctgtgtctagaaaatccttgcttggaggtggtgtggagtgtgctgtggaagggaggtgtatgaagaggggtctggggtcttagtggcatatcttggggataaggaagaagagcttgatcttagagtcagacagatctgggttccagtcttggctctgcaacataatgactgtgtgaccgtaggcaacttacttagctcctctgagcctcatctagctaacctgtaaatagaggttaaaatcgcaactcctgccttataaggccatggtgggaatttaaaggatataaagcacgtaggatctgcctggcacgggtgcaccatcaccatcatcattactcctatgactacttagtgccctgctgcctaggtgtgcctcttcacccttcctcccaggctgccagtatcttccactcttctccccacccccagccgatgacctttcttctctgagggtcccaggcctgattgtctgtgcccctggcacccttagctcttcggtgagggtgacagggaggcctctgcagcaagaagtttctggggtgattcagccttccccaaaccaggccccctgatttcttcaaagcaagtccctgtctgagcttcagaggctgctgtggtatcctgaatgatggccctccttgatgtgcagggtgggagtgggaggcttcccagctgagctcagctcctccagggctgaccatacagctgtgggtaagcccctgtaagacctgcatctggcctctggcccctgccctgggcagaagcaggcttgtcctggagccgcaggccccgcctcatctccttctgagcagccatccccatggagggcgcgcacccctccatcaggttcacactggcacgtgcatccaggcccacccgccacgtggaccttcccttgctccaggcctcaagcccgtgctgtggctcacaaggagacagggctgtgatgaagggaggcgtgagtgtgtgtgagcgcccactggaggggctcgcagccccctggaggcacgtgggcttgccaggctggcgcacattcttcctttctctgtcttgcttctgcagacacgcacttctagttctgtgggcttgatgttccctcggagaggcggagccagacagtcccaccctgcagcttcatgggggtgcccagggtgattttcagtgcagggtttagcttttgggttcctgctctgaattaggttggctgtcagggaatgcgggtttaaaagcaagagaaaggttgtttctgcagcccgcagctctgcacttcttgtccaaatccccccactcccctcttgctgggggtgagggtgacttggatgccctcctagtctctgtgcctctccctccctccagcttcatatatgaaaagacaaaggctgcacacgaggagggtctcttactctcttcaaggcccaggagctgaggaaggaaatggaggaggaaattactccccttctgggtgctgggtgaaagtgaaagatagggagggggccctcagtgagtcacgcaggcgggcaggaggcaggcaggctccaggagcacaggggctggggagctgcggaagcctgcagaggagcgatagcctgggaggggcattcctggtgctgggggtgggccgaactgcaaactgggtatagtcgggaccctgtgcccgcccagccctgccctccgctgctgctggctggtttcctgggagcggctggggttgctaacaatgacctgtagcatctagggcctgagatttcctcttcagagccgcccgagctgttttcccctcttcctagggaccagaatcttactggggaaagaggtgggctatgtagctcccacccccaccaacttcccaggaaaaaaacaaaacccaaacatcactctgagggaaagaaaagtcttgaaaaatacatgcaagcagctatgctataaaatacaggtctagattctgttctgtagcgactgctttaaaaaatcaagttacgaaacaaaaatggaaaaactgtgtacttaagtcatgacattatcgtggagaaaccttctggaactgagttctagcaatctgcaccctctacgatctgagttacactatttgccaggggctcttcggcagtggaaggggcaggggtcaggcaggggcggggtcagctgctgaccagctcttggcctggatcctgcctccaccctgccagggttgcaaaacaggttctgtgctagtttgggaaagactctggcagccacagccccacccagcagctcttcccaggggtggggctaggactgcacacacccttctggggccttacctgcaggccttggtgagcctgaccctgggcccctgactctacaagggtctgttggagctcctgactctggggctgcacaggaggagtggccacgtcgggaatgaccctgtcctctccacttcccgagcctgagatgtgcttggagtgtcagaggaggcactggctggacaaagatccttctgggtctggtgggaggctcctgcatagacagatgtgtgccaggaggactaggcctggctgcccagggggctagggcctgggtaagaggagaggggagccagtgtggcttttgctgcctctttctcagctgggctggaggggcttgggctggatgtcagctccacctgtgccttagaatgtgcctatgcagtgcacaaataacacagacagatgcaggcagtcctggagcggaaccaggagggtgaggtggtgggacaagagagtcacagtgccctgggagatgcagctgattctcctgccctcctggcagctccccaaaagtcctggctcctgcctcaccaatgctgctctgtgacttggggcctgtccctgtgatatgaggtggtgggaccgaaggcccttggagccccttttcttacacttgtgctgatgttcggggcatcctgggaggctgtggctgacactgtcactgctcttccctctgcaggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggtgagagtggcatgcagtggagccacacctggcagagggcatcaggctgataggtgggcggctgcaggatttgcttcttgcctagggaaagccagactttgccctagccagctgcctgtgggaaaacagtacaaagaccacccttcaccttgccacagggttcttgcttactttcttttgcagaaatattttttgaataattagatactatttcagatacagatagatacagatcaccgggttcaagtgattctccagcctcagcctccccgagtagctgggattacaggcgcctgccaccatgcctggctaatttttgtatttttagtagagacagggttttaccatgttggtcaggctggtctcgaactcctgacctcgtgatctgcctgcctcagccccccaaagtgctaggattacaggcgtgagccaccgtgtccagccagaagcactttctatagaagagaacagtgtgaggctaggcgcagtggcttatgcctataatcccagcactttgggaggccaaggtgggtggatcacttgaggtcaggagttgggagaccagcctggccaacacagcaaaaccctatctctaccaaaaaacacaaaaattagccaggtgtggtactgcacgcctgtaatcccagctactggggaggctgaggtgggagaatcattagaacctgggaggcagaggttgcagtgaaccaagattgtgccactgcactacaacctgggtgacagagtgagaccccctgtctccaaaaaaaaaaaaaaaaaaaaaaagtggtcggagaaaaggtagtcagggaaaaaggtcaagttgtgagaccactgggagccactgtgggtgtttgagtcccgtgactaaatgggaatgagggtcctagatcaaatcagaatttatcttttatttgtttatttatttattattgagacagggtctcactctgtcacccaggctggagtgcagtggttcgatctcggctcaccgcagccttaacttcctgggctcaggcaatcctcccacctctgcctcccaagtagctgggaccacaggagtttgccaccatgcccagctaattttgttttattttctgtagagacgaggtgtcactatgttgcccaggctggtcttgaacttgtggcgtcaagtgatcctttaatcttgtcctcccaaagtgcaggaattataggcgtgagccactgcgcctggctatgacttaccttttaaattgcacttctgttcccatcttgtccaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggtatgagaggcgccccttctaaacacctccagtgcgtgagtgctcagggggcccaggaccctatggggaaaggagaacatggcaatgtaggaaggtatcagggaacctgtggagatactatttttattttccaaaccaaacttctggacagacgtccagaaggggcatttggagatgtccccctcctaatgggggatgagacagttttatacttgaaattgaaactgcctagaattgaattctaggttgtgtacatctctttttccagatcagcaaattctgatttggcccgtgctgggtgctgggaatgagaggtgtttgcttgtactgtcactactgagatcttgacatcttttttttttttttctgagacagagtcttgctctgtcgcccaggctggagtgtagtggcgcaatctcggctcactgcaacctccgcctcctgggttcacaccattctcctgcctcagcctcccgagtagctgggactataggcgcccaccaccgcgcccagctaattttttgtatttttagtagagatggggtttcaccatgttagccaggatggtctcgatctcctgacctcgtgatccgcccacctcagcctcctagagttttgggattacaggtgtgagccaccgcgcccggccgacatctccttctaagattgaggttttgcctactttttctttaggttctgtcatcatttgttttatacattttgatgcaatgttattaggtgctcatttagaactaggttagatactttatgaagtttctttttatcttaaatattctttttgccttttattctcattttattcttatttattttattttatttttttgagatagagtttcgctcttgtcctccaggctggagtgcaatggcgagatctcagctcactgcaacctcctgggttcaagagattctcctgcctcagcctccttagtagctgggattacaggcatgcatcacgaagcctggctaattttcgtatttttagtagaggcggggtttcaccatgttggccaggttagtcttgaactcctgacctcaagtgacctgcccgccttggcctcccaaagtgttaggattgcagaggtgggccaccgcacccggccaattcttactttacatgagtaaagttatgagatacaagtgtgattttgtaacacgcatagatggtgtagtggtgaagtcagggctatcagggtatccatatctattccccaaataatgcacattgtacctattaagtaatttctcatcatccaccctttttgtcttttaaagtcaggtttgtctgatatcttgcttgcttttggttagaatctgcagggtgcatcttctcccatcatttactgttatcttttctgtatccttctacttaaggtgtatctttcaagtggcatacattgggatttgttattatccagtcttttagagaattgatacagtttatatctttctatttatttaaaaattaacataaagtctgggcacagtggctcacatctgtaatcccagcactttgggaagccaaggcaggtggatcacttgaggccagcagttcaagaccagcctgaccaacatggcgaaaccccatttgtacaaaaatagaataaaataaaattaacataaaaagaatacatatttatggcatacaacatgatgctttgatataatcaagctaattaacatacccattacctcaaatcttatttttttgtggtgagaacatttaaaatctgctcttttagctattttgaagtgtataatacactgttactaatgatagtcatcatgttatacaatagatttcctgaacttattcttttttcctaactgaaattatatttcgtttgaccagcatctccccagtcctcgccccatcccctaacccttggtaaccaccattctactttatgtttctttgaattcaccttaagattccactgatacagtttgcatttaatgtaattacttaaatacttgggttaaaagttgccatctactgttagctgtttcccatcttgcctttcccatgttctcctttggattgatttgatttgttatcccatttccccattttgttaatttattagttatattcttgcatactgctcttttcatgattaccccagcattcttcttacccgtatttcttcaagagaactaagccctacagaaagggatttgagcaactatttcctccattatctgaaggatgggacatagctagtaccatttaaaaatgcacaggaggccaggtgcagtgggttatgcctgcaatcacagcactttgggggggccaaggcaggaggatcgcttgagcccaggagttcgagaccagcctgggcaacacaaggagagaccccatctctacaaaaaaacaaaaaacaaaacaacaacaacaaaagattagctgggtgtggtggtgcacacctgtagtcccagtttctcaggaggctgaggtgggaggatcgcttgagcccaagaggccaaggctgcagggagctgtgattgtgccactgcactccagcctgtgtgacaaagtgagaccccttttcaaaacaaaacaaaaacaaaaaacccaaaccctgttaaatgcataggaaagaatttaacttattatgtatagtgaatgcctaatgacatcaggacttagctctttggtcaagaagagttgctagatattaaaacatgtatcctgggccgggggcagtggctcacgtctgtaatcccagcactttgggaggccatggtgggcggatcacgaggtcaagagatcgagaccatcctggccaacatggtgaaaccccgtctctactaaaaatataaaaattagctgggcgtggtggtgtgcacctgtaatcccagctacttgggaggctgaggcaggagaatcgcttgaacccgggaggcagaggttgcagtgagccaagatcatgccactgcactccagcctgggcaacagagcgagactccatctcacacaaaacaaaacatgtatcctggctcacgcctgtaatctcagcactttggaaggccaaggcgggtggatcacaaggccaggagttcaagaccagcctggccaacatagtgaaaccccgtctctactaaaaatataaaaattagccgggcatgatggtgtgtgcctgtaatcccagctactcaggaagctgaggcaagagaatcgcttgaacctgggaggtggaggttgtagtaagccaagatcgtaccactgcactccagcttgggcaacagagtgagacttcgtctcaaacaaaaacagaagaaaacatgcatccttggcttttagaaatctgttagtacttttagctcttcctggacaatgcaaagttcttgtttttgtttctgggttttttgggcgggggcaggggtttgagatggagtctcactctgttgtgcaggctggagtgcagtggcatgatctcagctcactgcagcctccgcctcccaggttcaagcgattcttctgcctcagcctcctgagtagctgggactacaggtgcaggccactacgccagctaatttttttgtacttttagtagagatggggtttcaccatgttggcctggctggtcttgaattcgtgacctcaggtgatccacctgccttggcctcccaaagtgctgggattacaggtgtaagccacctcacccggccctgaattactttaatcagaggttgaaatgagatgatttgaagctaggctttattccatataaggaccagcctatttctgattcacctttattctgaatgaaagtgagtatcagccctttttggagtcccaatccaaagcctgggggtttgccaagctctccttccttggcgagccctaaacttcagctttgttttttattttcttttttttttgagacggggtttcgcccttgtggctcaggccggagtgcaatggctcaatctcagctcactgcaacctccgcctcctgggttcaagcaattctcctgcctcagcctccttagtagctgggattacaggtgcccaccaccacgcccagctaattttttgtatttttagtagagatggggtttcactatgttggccaggctggtctcgaactcctgacctcaggcgatccacctgcctcagcctcccaaagtgctgggattataggcgtgagccactgcacccagcctttttttttttttttttttttttgagagggagtctcactgtgtcaccccggctagagtgcagtggcatgttctccactcactgcaacctccgtcttctgggttcaaggaattcttctgcctcagcctcctgagttgctgggattacaggcgcccaccaccatgcccagccaatttttgtatctttagtagagatggggttttgccatgttggccaggctggtctccaactcctgacttcaggtgatccacccaccttggcctcccaaagtgctgagattacaggcgtgagccaccacacctggacaaacctcagtttttattgtgtcagttccttaaatttcttaaaagctcttctcagtttctcagcctctcagttgccttttccagtaatagcattcacctctagggaaaacgcagcttcaaatactgggctcacctctttagctttcttttttttcacctagatcttggctctttaattctttgccaacctatttgtcctctgatatcttcagaaatgtgttttgcacatcgagtccagattttctggttattctcagctggagagttggcctgcatgcctctaataggcaggggagcgtcacagtctctgctctctgggttcttgttctctggttgaggaaaagtttgtggtagaggctggaggcctgggcagcttgttctgagacaggaaggagcctgagcagctccacagctcaatgcctctattttatagatgaggagctaggtccagaaaagacaagagactgacctaaggtcatacagccaagtaatggtagagctagccctagaatttggatctcctcaatccctgcctgtgagtacttgtactacaccaggctttggggggaggtttgtgttttgttatttgtttatttcattcattatttattattctttgtactacagatactttctttcatgcataaaagtagagaggagtataatgaatgccagtgtttagccatcacccagatttcacagttatcaaaacatagccaatcttgtttcacctgtgcctctgcttctccatgccactgggttattttgaagcacatcctgagacatcgtgtcattccatccgtgtatacttcagtttgtatctgaaatacgtcaggactctttcttctccaacattatctcaatagcattaccacacctaaaaaatgaacatgactatttttgtcagatattcagaatagtttaaatcccttattataaaattacaaatcattacagctagctgattttttgttagatttcttgtcaagaaagtttggggggcctttggctcctgcatttttttttttttctgtgcaatcatattgttttcctaagggaagaagaacgaacagtttcatttcatcccaatttgtagaagggaaaagagggcacagatgggtgaaggacatggccagagcctcagagggagtcagggccctctgctggaatgtgtttatgggagccagaaccttggcagggagacagctcattattttaaggcccactctgtcaacatggccaaccttacctgttgtactgagtacgcagagggataaactgggtgctgctcaccctgtagggctccattctctgcctttgagattataggaatcgagcaagggaaggcctctgttctcttatagtcctgctttctattctagatagaggcccatgaggcgtacctagcagggagaagtaggagggctaacctttggcagtgtgcatgggctagactttcctagtaggattaatactatgagaacaaaagttctgcaaggacaaggactgtccattccatttttttttctttttcctttttgttttttgagacggaatccagttctgttgcccaggctagagtgcagtggcacgaccttggctcactgcaacctccacctcccgggttcaagtgattctcatgcctcagcctcctgagtagctgaaattacaggcacccgccaccatgcccggctaatttttgtgttttagtagaggcagggttttgccatgttggccaggctggtctcgaactcctgacctcaagtgatcccctcccccccacctcgacctcccaaagtgctgagattaccacgcccggccttgtccattccattttgtagtcccatgtccagctcaggtcttagcacgcagtaggagctttcatctaacgcagagcctggagtttaagtagtgataacagccaatatttactgaggtaccaggtaatgttctcagtgatttccttgtattaattcatgcagtcctcatggttaccccatgaagtaggcacttactaggtaggcaccatgttatgaagatgcacggaaagattgagtaattttcagtggcaataaaggtggtaggtcccaacccaagaagtccagctccagagcctgggccctgaactactgtactctcctgccctgtcacacactttacagcagaggtggggaactgtggtctgggggccagatccagagctaagaatgtgttacaattttatacggttagttttaaaaagaaaaagggaaagaagaggaatatgtaacagagatcacatgtggcccacaaagcctaaaatatttactctctggccccttacagaaaaagtttgctgacttctgccctagaggagatgataagaagggcttttggacctgctccttttttcaggcttgccttggtgggtgtggtaggcagactaagttccaaaggtgagactggcaagctgtggttaagactttactttctctgggacacggggggctgagccgtccttgttttctttccttctccaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactagtgagtgacctccctccgcgaccctggcaggagcggggctggggcactgggcagggaggcatctcagcctgtggggctgctggggattgggctggaacactctgggagaaggagctctgctctgtcttctctgagattgagaaggaggttgtcctggttcaacaaggaggggtggggggcccgcccagctgcttggattcaaatctcaattctaccatttactattacatccacttttgcaagtcacttcaactccctgggcctcagttttttcagtattaagatggggatattagtattacttggttgatgatgaaactgccaatattcaactatttttggattcacaaatagtagtttcctttggttcaacctaatagccacttcctaggctcaggtgcattagcacacataaagctggaacatcatgcccaggccatcctgtttgctcatagtcctttgtggcagatctagtctctggggctctcgaacagtctttttggccaaaagcagacattctggaaatattgggctggcttggggtgatgtactgctgaaaaatgttgcccactccataaagagatccatttcctctgcaaaatgggataatccaatcccttagggtggtagagaggattaagtggaagtagctagcttatagatgcctttggccaattaacctttgactgtgacctcacccatggtgtagctctctggtgccccctggtgtctgtggatgcaaaatgtttgccctaggctggccagccttctgtactgcttcctggggaggcttctccctggctaggctgtgtaggaagaggaagtcattgtagagatcagactggcagccagcgagaggtcagtctgtccacgagtatctaccgaacactcgggcgtaaggccttgtactgggtcctgtgagggctccaagaatgtacaggacaccatggtctgttctatagagaatgcaaggtcattagggagttgacatgaaagccttggagttgaaaaaacagaggttcccggtagtgtgggatctgcagccagtgagcaaagccccagcagctagcctgggatggtgaggactgtattcaagaggggtggggccagagctgagccgcagcgatggaggagggcggggggcagggaggacacaccaggcggaggaaatgactggtgcaaaggcctgtagatgggaccgtgcagggagagtgaggggttgggaggtaagcagtcagctaggatgcaggtccaggcacatgggtggtgggaggtacaaatggaagcggaaccgccttgaaccctgaggggagggttgcaggttttatctcacattgcaggagggagtcagtaaagagcaaagatttttttttttttttttttttaagcaaaggagtgttttgatcatgtggggccttaagaagaccaacttgggcctgggcacggtgactcacacctgtaattccagctacttgggaggctgagggaggagaattgcttgaacttggaggttcaactccttgagccgagatcgcaccactgcactccagcctgggcggagacagagtgagactttgtctcaaaaagcaacaacaacaacaacaaaaacaaaaaaaaaactagcttgggagaaactgaggcagaaaatccaaagaggaagtgagacgataactataaaacagcgatccccttcaccacctccctagtgtgctcaaagtttcagtctctttactagaaaaccacagctttatgttggagttagtgttggagcttctgggggcaaggatatggctttggtagtagaagcagtaataataatctttatcgagtgccaggctctgtgcattattttatccagttctcacattaaccgtaggagacaggtagtgatagccccttttggtgagtgtgaaaactgaggcacccaaatatttagtgaagggcctgcgttttcgtaggtgacaggctgcagagccaggactcaggtgcctgtgttccctgcgtgagctctgtgtgtcaccactgtgactcttgcacatacagggcagccactaggattgggggtgctttgctgaaaggggggtgctatttatcaacctgctctttgtcccatagacagtgctgaagtaaccccgcctgtcctctctgtgatgggggaggccaccccagtgagcatcgagccgtaagtgcagccctgcccctggccgaggggtgtgggtggccacactggtgcagtgtgtgcaggtgggccctgggagcaacaggagggttccgtggggcctgcagagggctgagagggcctccttgagcttctgtatgtggccctgggctttgctgtccccgccctgcctctgtgtggaagttgcagggaagggcaaggaccggctcagcttgaacttatctctaggagagttgaaaggggggtccagaggctctttcccatctgtaaacctgcagctgcttctcccctctccagcctctggaccttgcctttctggtggtgccaggtcaggctgtcctcccaagcccctagaagccagactccctacacctagctgaggccttgctctgccggctccccctcatcttcttcccaccctgagggatcatcaagttctccgtccccgcaaggtgaggcctcacttcctgcccttttcactcctctagacggatcaacgtgggctcccggttccaggcagaaatccccttgatgagggaccgtgccctggcagctgcagatccccacaaggctgacttggtgtggcagccatgggaggacctagagagcagccgggagaagcagaggcaaggtgaggaggggcctgggggcagcaagtgagggcaggcacatgggtgggccaggcctcaccctgcccagccccgccctgaacgtggtttcctcccctccctcctcacgctcctgtggatccagtggaagacctgctgacagccgcctgctccagcattttccctggtgctggcaccaaccaggagctggccctgcactgtctgcacgaatccagaggagacatcctggtgagaaggcaaccccagcagagggagggcccctcagtgggggctggcttggatccatgtctgctgctcaggacctatggctgctggcatgcacatttgaggccagtaggagggtctgactaaggaaggggctgtaggggcttgacccaagggagccctagtttcagaccccgggttttgctgtgcagtgtcctcctgtccattcccatccctgattctgggtcagtggactcagactggatggttgctgagagccttctccagcagtgctgcctcccttggggccatggactctcttaagaggacctgaggcctgttttctgggcagccccaccccctgtgatctcaccaccccagtggaccccttatctctcagcagttaagggggcaagagtaagtgtccaccctactcgggattttatcagggcctagaatgctccgtccaccaccgacacccctgtcagtgccctgacccttccctcacttcccctccaggaaacgctgaataagctgctgctgaagaagcccctgcggccccacaaccatccgctggcaacttatcactacacaggtgggcctggctgcggtgggcatggtgcctggagcctcaagaggtctccagcatccatggggccctgctcagtgctgagtcacagccctgggtgggggcgggaggaggagggtagataagccaagagtcagagtgagggaactgccaccaaagctggggtagctctccaggggtttcctgtgccctggaggggaggggagaagggagtgggcaggtgggagaccatccaggcaaaaaagcccaggccacaaggacaggaacccatggagagccatccagattggcatcaggtacctggaacttagccccaggagtgcatgtcctgttctggtcactttaagaaggacatggaccgagtcacataatcctaacagccaatgttttccatgcatgttagtgctacatttcatctgcaccaggcagagcaccaagggtttcacatgcattatcttatttaatcctcaccacagctggtgagctaggtgatattagtttccatttcacaagcaagggagcgaggctgtgaggcacatggaagtgggacgaggagccggctctgatgcctgcagagaccatgggcggatggcctcacacttttttgcttgtcaaaattgccctgcagtggccagggccctgcccacctcactccctggctgcctctttgccccataggctctgaccagtggaagatggccgagaggaagctgttcaacaaaggcattgccatctacaagaaggatttcttcctggtgcagaagctggtgagctgggctctgtttcagggcaaatgagggccaggagctgcctgtgtgactttggggctccctctgccagtgaccaatccctcttaaaaagcagtcaggtcaatgctactgagtagcctcagagagaatttcctaaacaatacaagaaagagaaagataggtctcttttcccttttggttctaagcatcctttcctcacttcagggtagggtggccaagctctggggtctcaatccagaaggaggcctaagtgggcatcagacttaaaataggcaggaggaagatgcggaggagggtggcaagtagaggtgagccattccccagaggaagatgcagggggagggcaccctggggtgaaggccactgagagccagcaagtgcctgcggagctgacctgggggcctctgcccacttcctttgacccagagttgccttccagtaactcagctgttcaagcccacattccctagatttatcttgtcctctctccatattcttctggaaaagcagatgctttgctaatccaaggaattgcatctttccagccctgtctcacaaaatctgggctgtggggagagagaattgtgtggactgccaagggaaaagagtttttaaaaagagcatgccctttcctcttgggattgtagattgtattgggaacagccctggggactagacaaagtgctgatgatgaattcccctacaagggccctgttgtgaggagtcctttgctgtgttttagtaacacgctattccctgattgggcaatactgacgggaagtacacgcccgtgaaattcacggaggcgcccctaatgcctaatgaaatgagcagacctttagtcagtcaaacaaagggtcagagagaattgacagtaaatgtgtaaatggcctaattaatacatgtgtgacttggccatttctgtgagatgaaacatgtctgtttcctcctcagacacaaagggcccacactgacccctggcctctctggacaggagctcccagcccagcggtggctgagcaatgtgcgagcctgtgtggtggtgtcagaggaaacagcctctgggtgtgggaaagttgcccaaaaactaaacccagtggccaaatagatttatgcaatgggagagctagaatttcagagcttgagaggcaggtccctggagatcatctagtcttacttaaccccatttgctatttacacatgaaaaaactgaaattagaaaagtgagtgacttgcctaagctcgaatagctgtgtggtagcagagtcaggaggaagacttaggcctttcgcttcctcctcaggttttccagggctttcttgtgagtttcccttgagttcctcccccgacaggggacactgtgacatttctgtatgctcacttctcagccactgctccctggagagaaatgaaattgtttgcctggattaatgaaaagcgtctgtgttgccaggtcagggctggctttggatgtagatggtgcccagaccttttccctcaacttttcagtttgaaaaatttcaaacttagaggaaaatggaaagaacagtagaatgaacacccatccaccccggacttagatttagcaatcgttaacattggctatatttgctttctctttctctatgtctaaacatagacacacacatatacagctctctcttgttctctgattcagctaatcattaaaagtaagttacagtcatcctgtcacatgactaaaacctttcagcacgtatctcctaaaaaccaagatattctacaaaaccacagtaccattagcacgcccacgaaatttaacctgataaaataattcaggccaggcgaggtagctcacgcctgtgattccagcactttgggaggcagaggcagacggatcactcctgaggccaggagtttgagaccaggctggccaacatggcaaaaccccatgtctactaaaaatatttaaaaaaaactagctggttgtggtggcacacacctgtaatcccagctactcaggaagctgaggcacgagaattatttgaacctgggaggcggaggttgcagtgagccaaaatcgcgtcactgcactccagcctgagtgacagagcgagactctgtctccaaaaaaaagaaaaaaaaatacagtaatgccctctgatatgcaatccatattgccatctcccgagtggttccgacattgtcctttatagctttttttatttatttacttattttaaatagtgctgaagcattgattaattgatcagtggtttgttgcagagcaggcattggaaaaatgcttgtattgcctgggttggctgggtttcattttggcttgaagttaagggaaagatgcagggacgagaaaggctggattctccacaggcagatgagccaaaccagagggttctgacctcagttttgacttcaaaccagatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaaggtgactccttttccaacctcagctgcatagagcctgggctgggtctgggaccaggcctgagctgggagcccgagcccgagctctccaggagcctgcagagggcaggttgaggaagacagtgtccctgacagccgcaaggagccctggaccgctgggttctcctctctatactgctggtgtcatagtaataatacattgtgttgatacacagggtaattttcccacaagattcacaccagcatcatcttcctatctccgcttagcagacctctaacactgtttctcaaacctcagtcattcttgtatcacctttttgatttctgccatatctgcatcctaccatgtgtcgccattagaatttttgtcatattcatatactacttgtgccattacttaatattttcctttaagtcaactcattttttactcagaagggaagttttatatcacagtgataaatagaaaaccaaggttgtgtgctataaatagaaggtactggtaaaaatatatgtgaaaaccagtattactgaattctagctagatgctgtgttacctgccaaggctgagactgagggctgaccttgctttgttaaagagattatcaagtctagagaagtataaaagacacattagcagcaaccagagactgagtccttggcataatcaggattgaaagagaattaaaagggaaggttacttaatcctatgtccatgtatccacctagcatcatttttgggattgcaaatccacgcttggtgacatgctacggtaagacagggagtggtttgctgcccattttgcaggcaggaaggtagtagagctacagaaagcattacaaagatagtttggaattggaactcaaggcttctgcctggctcaccacatcattgccgaggatgcctcctggtcatctgtccaggaggatgggtggcaatggggagtgactggtatgtaccctccttgcccctcgttctctctcaggtgctcccagggcttgagactcttctgtccccatggctactatgccatggggacagagtccagagtcctagtacagaagactatgctgggccagccaggcgagcaggactagctggggctggtgaaccccccggccgggtcagaatctgtgctacagcagtgagacagagctctaggctcactgcccttgttcttgttccccatagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggtgagtgtgaccaccatgggctgagcccagggcaagcagggtggagctgggcctgggggcgtgggagggagggtagagcaggactgtgatcctcattataatcataatagcaggaaatgtgtgaagtactttgtgctgttaactcatttaatcctcactaccctatgtggttaggtattactgttattcccattttatagatggggaaattgtggcccaagataacacagctagtaggcagcctgaatccagagtctgcgattaatttttatactctactgcttctgtatctgagattcagagggaaaaaggttttgtgaaaacccagtaggtatgtgggtcactgagggagcattggtggtttgcagacagggctcccctaagagagccagagtccctgacaagaatgagactgagctgagaccatgggaatgacaatcataggccctcaggcatgatctctgcaaagtgctttcatttccattatctcattagttcctcacactgcagagttaacctctactctgcagatgggggaaagcagttcagagatgctaagtgacttgccccaggtccttggactcctagtgcagtgctctgtccaccatatcacaggccaagaaacaagactactggccatagttgctccttgccagggagagttctcccagaaaggggtaaggaggggaaggggtttattggggagctgctgcttttttagagtctttttttttagaaatgtatgtagtaggccgggcgcagtggctcacacctgtaatcccagcactttgggaggccaaggtgagtggatcacctgaggtcaggagtcgagaccagcctggccaacaaggtgaaacctcatctctattaaaaatacaaaaactagctgggcatggtggtgcacgcctgtaatcccagctactccagaggctgaggcaggagaatcacttgaacccaggaggtggaggaggcggaggttgcagtgagccaagatcatgccactgcactccagcctgggtgacatagcaagactccatctcaaaaaaaaaaaaaaaaaaaggaatgtgtgtagtacactcatgcttacagagctcccataaactgtaaacacacggctgtgtgcccacttctgagcctcgaccacctgcaccaagagctgtgctctgtgtagcgctctacagagttctgttgacttttgtgaactttcccatgagggtgccacttctgatggccacccggggcttccccagccgaggtcacctctgctccctctgctctgcactctgacccctgcccttgccctgtttggtgtccctgcagtgcgctgtcctgaagtagctacctgcgcatctgtcccttccaccagatcctcagctctgagggcagggatgcctgtgtcaacctctttgtccctagcatctggcccatcacaggggcctgaatctcatttatagaacagggcatgagcggactaaatgacagaaaacatcaacaggtaggtgcttcattaacccagagaccaagatcccctgtcaggcgcatcaaggcctctagcagctcgggctgccccacagaattactctagcagcaactttgtaaacgatagagctgaccagagatgcagagttggaggaggcaatggtcgtcatatccctggaaggacccaagtgcatgctaggtgactgtttggcaggaatatatatgacttttcaggcccccggttccctgcgattttagaattccagatctgcgcttgctcagatcactcaactctccttgtttgattttcttcaggccagtgacatcctcatcctccggagccacgagtccaacgcccctgggtctgccggtggccaggcctcggagaagccaagggaagggacagggaagtcacgaagggcactacctttttcagagaagaagaaaaaaacagagacattcagtaagacccagaatcaggagaacactttcccctgtaaaaaatgtggcaggtaaggtgggcagcgctgtccccgctgggacccccgcgggctggtgcgcggagggggcgggggtggggtggaggggagggggaagaggtacaggcggtgtccgcctcgtttctggttggctcagcgggtttctagggctgtgacgtcatggggcagctttcggaaaatgacgcgagctggccggccgcggctgtgcagcgtgggggtgaaggtgaaggctggggctcctcgcgcacccgcgctgggggcccccgggtgggctaggccggttctgagcaacccccacccggctgcagggtgttttacaaggtgaagagccgcagtgcgcatatgaagagccacgcagagcaggagaagaaggctgcagcgctgaggctgaaggagaaagaggccgctgctgccgccgccgccgcccaccagcaggccctgcgggaggagagcggtgcgggcgacaagggctgagcgcgggagccaggctggcccagtcctgggcctcggcccttcccgcaccgccgccagcgcccgcagacaccctggcatctcaagagggagtgaggagaggattgcagggacttttccctgcgaaacaaatgagacaatgacataaacggctcttttatttatgaaggccctgggagcagcgttaagggctccaggatccagctctctttgcatttggtctgtcggaagctgtcctcgtgctttcctggaccgggagagtcccggtcccctcgggagggactccaccgcctctcacactccgatttctgctgctctgctgccccgcagtcttttccctttatttgcttccccctcctcccctcggcctccaggaagccaccgtggccggccaagcacaagctcacccactttggagcagcatttctcctccccagaggacctcgaaggctgcaacggccctgccccaagccccagaaaaagaaactcttggagggagtctgcgggcttctctgagaaggggcgcagcctgacacctgtgctgtccctgcagtctctaggcctgtctgagctgctcccgtgaccgtgtcctgagtggccacctcctccttgggagggaggccgcggcaggtactctccctttgctgcttgctggcggccttgctagggctagaaagttttctcagcgttgggggaggggctagcgttcttgtccaaagcactcatcctgctgcagggaagggagctgtacggaggctggaagctgcagggttaggcccgagagagcttttgacaagcctggctcttcctgcttcccacctttttggctgaatacctttgggtcctggaggctgccaagggcgcttcgccttgagcaggtcccggagaggctcagcctgcccctcctgggggccagcctccttgcctctgctctgacctcagcagctacacctaaccccaccgcaccctacccagtgtcgatatccacaacccagcccccaggcctgcacgttggagatttctggatccttccctgggagggagaggtctcctaactcgattggacaggagccttcattccttgactcgtgtcatttgggagctatttatttattcttagtatttaatttttaacatcctctcagggaccaggggcctcctgcttttcagaggcccgagtgcatttatcccaaaacgaggcatcttgacatcccctatccccaccccctaaattcccaaggccctaaggtccctcacctggttgctctggaagctcttgctgataggaatgatagcaacactgaaagagcgtgggaaggtggagggtgtcaccagacccacacagagcaagggagatcaaggcagttcttgctgccccttctctggctgtgctttgcctgagggaagagttggcaagaggccagaattctagtttggtttatggggcctggattctggcttgaagaagccatatttggcatgggtgaagtgaaagggccaggaggttctggaggccccttcacttccagtcccatagcggggctcagctatttttctgatcttattcaactttagttgtgcaaaagaaattctaagtgaatgcgcgtatgacaggtcaacgtattaggaaggagccagaaagtattcatactgctactccttatgagatagccaagaagcatcatgtcagtaactgggagtggagagggagttttgttttgaaactatgcaggtatttttcagcatccatttgtacattagtatggttctacaggaccccagctgtggaagtaacaaatttcttctccctccagactcttggatgactacctagatccccagcttaccggttagtttcctccacaggcttccatgagctcagtgtcccaagacagcaaaaatctggtataccctgtagaagcaggggggtagcaaatttaggctctcttcgaaattacttgtacaatacgagtgccttcgcagcttagccccaaagtgctacttatgtttcccaaggtcttttctattcaaatcatatttggtttcaggcccctttatgggcatacggtaacagaaacctccatcattcatatgagacccttttgtcagtggtaacatcttgtacttggaaaaaaattttttttttttttttttttttttttgagacagagtctcattctgtcgcccaggctggagtgcagtggtgtgatcttggctcactgcaacctccgcctcttgggttaaaagaattctcctgcctcagcctcctgagtagctgggattataggcacacaccaccacacccagctaatctttttgtatttttttttttagtagagacagggtttcgccatgtcggccaggctggtcttgaactcctgacctcaggtggtccacccgcctcggcctcccaaagtgctggcattacaggcgtgaaccaccgtgcctggccggaagtctttaaaaaataaagtgattctactcttctaagcttacagagaccagaccaggtgaatgtaactggggaaaatcaagatggtacctctctgcattatcccgccagacactgtattttatgcattcatgtctaggatacagtgtgaaaattaaaaagtttagagggcagatgcaattgtggcaagtgacctgccaataaagcaggtgcagctatagaagctggcataggtatatccttaatggtgctttctccctgggcttgtctttttgttgtttttttccccctatattcagagctccttgagaagtgataaacacctccagctttctaacatcctccccacaccatctcaccatatccatctcccagcatccatctgcattcagctaagggcgggaaactgacctagtgcctgtgttgcagaccatttctgaggtctccaccatccaaggaggcacagccgtcattactgtcctccatgccttcagcagcccccctcacagctaaggtacataccaccccttctgccgcgcctccacccctggcaccaaggtcttctgctgcttatgtctaaagggatcacctatatttaactgcctcagtgacctaacctctttcttctcatgtgccagatgttaagatgaaggaggaatacaacacatactcaagcctcagcctgtttagttgttttcactggggctcgcttttctgggacggtatttattatcagactggcaagcctaactccataggtttacaggaagtagggatatttttataaaacaattgtgtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattccttttattttgaaacaaaaatgatcagacactgccttttgtgtgtttgctgcctgtggcatccttttttaaaaagactgttacatattaaaatagtgtacatatataaatattacctcttttgctgtacagttgtgatagagactgaagattttattttttgtgtgctttttataagaaaaaaattaatacactaaagaatcttgctgatgtgattgtaatgtacctatgtaacttatttacttttgaatgttcttctgtatctttaaaccttttattaaataaggttttaaaaattcagagttgaatgctttgttctcttgggattttcaccatctggggttgatgtaagtgcgccttgtcttgcttgcagggagattactcgacatttttgaaccataaggattctcttttagcagcctattgtcaatgatgccagccaggaaaaggaaaataatacactaatgtttgcctggctaaaagatgactcagtagacacagacagattgttacaaaattttagacaagaaaaagtctaaactcagtgtctcacacaaatacacagaaatggcgcactccgacattttggcttcattgggatgaaatatgcagggtgcacagtgtggtcaggggcaacgggaagccagggttctgaggagagtattttcacgtgcagggtggactggctgagcaacccgagtagacaagtccaccatgagggatgcatttccaacaatatcatcttaaatccactccaggattgggttattatttttaaaacacggtgcttagtagtagttgtttactgttaaaatgctaaattatgaaaaaggaaatgcgccatcagagaaacaaatgcccgagcccctcgctggctccacggcaaccgctcgacccccgcgagccgccggagcaggcgtgcctcgcgccggctgggacaccgttgccatggagacgcccgagcagctccgccgcgggggcgggacggggcggggcggggcggacgccgctcgccggctggccccatcctccactgcagcagtaacgtcgcggcgggttgcgggtaggactggacgccagagcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctgggga

SEQ ID NO: 1517 - DNA, 2983 bp, Homo sapiens
ttccctctgcaggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaag

SEQ ID NO: 1518 - protein, 920 aa, Homo sapiens
RGSHRQGSVGHIMNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIK

SEQ ID NO: 1519 - DNA, 48133 bp, Mus musculus
  misc_feature (1)...(48133): n = A,T,C or G
ttccaagtgctgggattaaaggcatgtgctaccatcacctggcaatttcctttttcttaaagactctggtcattgcgttagggctcaactaaatccagtgtaatctcatcttaactttattacagtgacaaaacccttgtgtgtacacgtatggtgtcttagggtttctatttctgtatgaccaatagctacttaggaaggaaggaatttatttcatcttgcacttgaggtaacagctgaatgctgaaggaaatcaggacaggaacttggagatgggaactgatgcagaggccatggaggggtgctgcctactggtttgctcctcatggcttgctcagcctgctttcttatacagctcaggacgaccagcccagggatgacactgaccacagtgaactggactctcttacattaaccattagccaagaaaacagcccacaagccaatctggtgggtaccttttctcaactgaagttatgtcaagtacatacacgtgtgtacgtgtgctcagttgtgtaagcctcatgtggcagtcatcaagtgtcttcctctattgctccccacgtttctttttgagacagcctctccccaaatctgaatctcacagttttagctgggctggctgaccaggagctctggaatctgcacgtgtccaccattcccccatccctttgggattacagacacacatggccattcctggcttttatgtggatactaagatttgaactcaggtcccctgggttttaaaacaagttcttatccactgaatcatctccctagaccccagatactgacaaaatttgtatgtccaaataaaacaatattcacaagtatgagagtcagaatttcaaacacactgttttggaactgagagttcaagagcagtctggtctacacagtgagttctggaacagctagagctgttacacagaaaaccctgtctcacaaaaataccaaacaaatacaaacaaacaaataaacacttctgtttttctacagcgtcagaatttactgactaattcgtaaggtgtggtggtttcattagtagcaattcgccagcggcctctgctttccttgatagctctggctgaagcaaacatagggtcttttattgatgacttaatagcactcacagtaaatctgtcacccatgtaactcatagagatccacctgcatctacctccccagtgctgggactaaaggtgtgtgtcaccacagccagcttagcttgcagaaatgtacttgttgatatttctagtgtgtgacaaattatatctttcaaagcagcatgttgaagttctgactctcatctatctatctatctatctatctatctatctatctatctatctatcctatctatctatctatctatctatctatctatctatctatctttctatctatctttctatttatcatctatatctatcatatatttatatcatctgtctatctatctatctatctatctaccatttatgtatttatcatctatatgtattatatatatatatatgatctatctctatctatctatctatctatctatctatctatctatctatctatctacaggttacagaatgactactaacggttaaagaatgtagaaatgtcaaagaagcctgagaagctggaggtctcaggagaggctctatgtggtattgtcgggcttctcagtctgagttgggctctagagttgaatccagctgcagaggctattgaagaacaaacgagggtgaatagagaaaggaccagacaggcaaacaggaagactggcaggtagcatgcgatcaggctctatcaacagcagggacaaagccaagccagccacgggacagctggaagttctcttcatatcagtctcttgatgcacaaccttaatggtcacatggcagttgaacagggctgtcaccaccacagggctaggagtctatctctttatgatgtccacgtaagagagtcagtcaccacatttccttgggatcttgtgtttggtaagttcttgggctcagtttttctaatataattttaatggacccacgggctccttaattcccaatgtatcctgacaaatgtataggttggtatcttctctgtcctagcaacaagactgggtcaggaaggagtatcagagcaggtgtctacacagggccacggccatcttccaaccttacctcgaggtcaggagctgcttgtaacagggagtttacaagcagcttaaagggcaaggcacagcctgaaaagcctaatgtttttacacaatatggaggaattcagaacagggcacagcctgatcctggatgcttctacccacaatagtcctatttctcaggtctccttctggctgatggctaggcctctgtagttccttgttacccactaactaggacaaggctctggaagattccctggggtcgggatgagttgctttggccatcatttgcatacattttggcgttattttttttctttctttctaagaaactacagtttcagatgaggcatagtagcacaggctttaaaccccagcgcctgggaagcagagacaatttttgtgatttctaggctagcctggtctacatagagagttccaagacagtcatcaaggctacaatatagacagtgagacctcatctcatctatatctttttttcctcaatacatttcagataactaaacggaaatgtaatctttcgacatgcccagcttagaaaggtgataaataactatttaagacagttcaatatccttcaatgaaaatttcattataacagcattaaaggttttataaaaatctaatatttagcaactttacaaaaaagcgtactactactagtggtcgagctactttgaaaagtttcctctatctgctagcctccctgtgacccgtacatataagttcttccagaggacagtgggactgcaggcgaggacagatagcctcgcttttgtgcaacatcatttaaccaaatattgtctatgtcttatatcatttccataccgatgatttttaggatgtcactggagtatatcattttaatataccgcagttatcttcagaggcctgtactgtcaggatcttagctttctcccagcattttactaccataaaataaacattttatgtgtcagggtttttgttttgttttgttttattttttttttattaaacatttttttcctcaggataaattctatcacttggtcaggggttaggcatatttatgattctttcaataaagtactattttgcccttcagaaagactggatcaatttacattgccttcattaatgtatgagcatatctagtctccccaggccttgcaggcatggattttcataagtttcaaaaagttcatttttaggtataaaatgaaagttcacacacagtaagtttagtttggagttgatttggcagcaagattagctgcatatttttaaagtcatggctttctttgtggtgtttctttagtaaacgactttcccgtcatttgtttaatgtacaactggggccagcaaaacagctcagtaggtaaagactcttggtgccaagtctgaccaacccgagttcgatccccggaacccacctggtgggagaagagagccaactccagaaacttgttctctgagcacacacacacacacacacacacactaaataaataaataaataaataaataaataaataaataaatgtaaaaaaagtacaatttgtgaggtttttaaaggcatatttatttttatgtgcattaatgttttgcctgcatctgtatctgtgagggtgctaaatcccctgcagacagttatgagctgtgccatgtgggtgctgggaattgaacccaggtcctctagaagatcagccagtgctcttttttttttttattacgtattttcctcaattacatttccaatgctatccaaaaaattcccccacacctcccccccccccactgccctacccacccattcccattttttggccctcagccagtgttcttaactgctgagccacctctccagccccacaacttgtgtttttaatagcttccttgtcatctttatctattttagttattaaatttttgcttacatgcgttttctccaccttctaaatttttaagtcttagctttatgggtattcattctctagtctatcaaaactgtaattatctaaataataaaagatattaatctttaagatttaatcttatcattttaattatgtttacgtgtgtgcacctgtgtgcaagtgtgtgcacatgagtgccctcagaggctataggccttgggtttcctggagctgaagttacagagagttgtgaactggtgtcttgagttacatatgtgctcttaaacactgagccatctctccagccctaaagctgtcttttaaaaggattacttattttattctatgcctgtgacatgcctgagaatatgcacaaacctgcaggagcctacaaaaagccagaagaaggtcttgtgatccccctagaactggagttacaggtagttgtaagctgcctcgtgggtgctgggaactgaacccaggtccttcgcaacagtgaagaagggagcacgtttaaccactgagccatctccccagcttcccaaaactgtcttctgaagtttgttttctatcagtaatcaaaaggagatttccggaactgttagcctttcctatgtgggtgcatatatttgttttttatttgtaaggtatttaattctcactctacctggaatgtttttcagagattggtgggaggtgtggacttataatatattatgaatatttctacatatttctacaactctaaattctattcataatccctttggacctagagtaatctttcgctactctctaccatttatttttccatacaaaactgaaaattacattatttcataaagcattttattctcaactctatagtaggttgtgccaagtggggctgggtcatggttctggcaaagctcagtctccgttaattttggtatctctatgggaatttcagcagaatactgcacatgactagaattctagcccttgactccagggggttttgatggttctgtcctactcttggtggctgcctgcttccattttcagactccatccttgtttccagaattccacagatgtctgcagggactttgcagattgccacaaagctctgtgcagtaagcttccagggttacaatgcctgggatgagctagcaaagtcagctcccatctccaagcgtctctagggctggagtcttgctcctcctgattcttggtaattctgcccatctcctctgcctcagacactcatgcttcctgtattttgttcagactcgttggtgactgtaggtgaggatgcaggctggccacagctaatccactccactgaaaaacagtgtctcattccacctgaatgttttcctttacctgctttaacgcatttttatttttatgtatataggcgtttttcctgcatgcgtatctgtgtgccttacctatgccccaggaggccagaagaggtcatcgggccccttgggactggagttacagacagtcatgagctgtcatgtggatgctgggaattgaactctggtgatttgaaccaccgagccacctccccagccccttcatttaccttcttatgttttagtactgaaagttcttctttctgtttgacttatttctcagacaaagcttccctgagttctaaaacccagctaaacacccagcaccctctacttctcctttaccactggcatgttattcaattctgtggacttgcctggtgcctctctcccagggtatgcgcatgctccttaagggaggacacttaccctgctcatttgcatatccttagtgcctgatgcaatgtcaggcttgcggcaatagtgctggaatgaacgaatgtttagtttttaattttccccttgtgttttagattatgtcctctcgagcgggggagacaccttagtgggtaaaggttcacgctgccaagcctgacacctgagctcactctaagctctgccaattgtcttctgatccccctcgtattcactgtggtaactacaaacacaacacagataataaataaatgtaatacaacttttattgtgacttatattttattcctttgcctcctcggtttttttttttaagattttatttattactatatgtgagtacactatagctgtcttcagacacaccagaagagggcgtcagatttcattacggatggttgtgagccaccatgtggttgctgggatttgaactcaggaccttcagaagagcagtcagtgctctgaaccgctgagccatctcaccagcccgcgtttgtttttaatacatttaactgtttttatcatttcttttgccttccatatttagtcacctttaaatatcagttttatcacttccttatttaaaaacatactcacactctaccttttacctttggctcctcctctctatccctgtctatccctgtcactcatcaggatacacttggctcacaacagggctgacctatgaggtaaatcctggtctgcactaccacctagctgtacaaaagaagcgggactctgagaaaaatgaaaataaaaactcggcttttaaaatatacgtgtataacaagatactcacaggaggaaatatggagacaaagggtggatcagagactgaaggaaaagccatccagagactgccccacctggggatccatcccacatacagccaccaaacccgaacggaaccgctattgtggatgccgggaagtgcttgctgatggaagcctgataaggctgtcttctgagaggctctgccagagcctgacaaattcagaggtggatgcttgcagccaaccattggactgagcgtgggggtccccgatggaggaattggagaagggactgaaggagcttagggggtttgcagccccatggagggagcaacaatgtcaacaggccagacccccaggaactcctgaaagactccgaaaggagtccctcactcaggtctcaggacaataggggacacccaagaactcacgatagacccagcttgttgcaaaccacatgagactttatttggggaaagccagagctctggggacgactcatatcccacacaggggtagaggagtcgacctcgaggggaaagaggtcccagtttttataggccctcaggggagaaaggagaagggggagagtaggggatttccagatctaaacaatgtctattctcaagaaatgggtatgggaggggtacaaggaaagagtctggtgcaggtgttgcaactccggattggccgnnnnnnnnnnnnnnnnnnnnnnnnnnnnnnnnnnnnnnnnnnnnnnnnnnnnncaaccaaatatcacaaacacctggcaatgggcttcatcagtgggcacacacatgggtcaaggaacggtcaaaacattggcagacacacaggttcaaggagtggccagagcattgtgcacctctatttttctaaatcagtgaagctagttctgctaacactgacatctatcttgccaatttcagggcttctgtgtccttttacattctgtcaggatctttcactcctggggactggaccaccaaccaaagagtacacagggaggaatccatggcgctggctgtatatgtagcagaggatggctttgttggacatcagtgggaggagaggcccttgggcctgagtgtgttcaatgccccagtgtaggggaatgccagggcagaagatgggagtgggtgagggaacaccctcatagaggcaggtggaggggggaacgggataggaggatttctgaaggggagacctgaaaaggggaaaacattagaaatgtaaataaagaaaatatccaataaaattaaatatatatgtatgtatacatatatatatatgtgtatgtgtgtgtgtttgtgtgtgtgtgtgtaactcaaagttttgcatgcagatttcagggaatgctttcactgacacaatacagctcgcactgcatagagaatgacagatagtttattctggagccaaatatgactgaccatggcctaggaacatagatttagattactccaaatactatgttctggtgtggtaaccatttatgaggtttttagggtgacagaacaaagacaatcatgaatcagggagctttaagaaagaaagaaagaaagaaagaaagaaagaaattggtagctccggttccaaggtaacctcgccctcttctggcctttgttagcaatagcatgcatgcagtgcacagacacacagcaagcaaaacacccacacacataacaaacaaacaaaaaggtgtgggtctaaagagctggctcagtggttgaaggcactggctgctcttccagaggaactgggttcagttagcagcacccaactggcagcttactgtcagttcacagcttcctgtaacttccgctctagtgcatacctcatggagtcaacacatggcatcaaaggtctggttggtccccttgcttggcacagcccacaccgccacgggactggatttagtcctgcatctcagctcagcttgcctcggccttgaaccatttctgactgggttacacaggtatttgttaatgccttgtctaagtaactacagtggttctctttgcagccttataaactccctgcctctgcctgctgtaagctctcttggaactgtagcttccttaatcactttgtagccattctgtaagctatacatgattgtgtaaagtaatgtgtgatctcagcgttaacactagtaattaagattgagaatagtgagctgcttctttggaaaacaaaaaaatgatgggtgactctggtgcagctggaggccctgggggacctgggcccaggattcagaggctgcagcagggttccacaaaggattcggaagtggaaagttggttggatggtattttgctgggtcaaacacatgaagaaatgtttagctaaagtgtggacataggtgaaagactaagaaagattcataaaggaatgtttagctgaagcagacatgtgaaaggacacgtgataagaagattctttgctaacaacatgcatgccttggtctgccttacattaagcaatagagctccatttgtcaggactcctaggactccagctgattttattcatgtgctgaggcaagactcgtgcagggagacaaggcatgtggaggacacgtgatgtttggaggatataaataggacttcacggagtgatggagacagagcttggcttgctggtacagctagctgtgcaatgcttgtgggtctcccgtctttgctgatcttcccttccctgagagaggcacagctgagaacttctcctggtgttcctgctggtctctcctgctgactcaagctgagcctgaggcctggctgtctctgctaggtcgtgacactgctgttactaaccagattttactatactgggctgctggtgtacctgtaaagcatgttcgagtgaatggagctgctgccctgtgaactgaactgcccatttccagacaaccctgatgggagttctaaacaggtccacttcccccataccctttctttcctattgtctctgataattgataggctacaagagaggttaaagtgtttagaaaccatcattaaaaataaaaattttaaaaagttaaagttgggggctggagagttggctcagcagttaagggcacaactgctcttccagagatcctgagttcaattcccagcaaccacatggtagttcacaaccatctgtaacgggatccaacgcactcttctagtgtgtgtctgaagacaactacaatgcactcatataaataaaaataaataaatctttaaaaaaaattaaagttgtaggatttggtagtggtctaaggggccatggccgtggtcgaggggggagggttgtggaggtaaagctgaagataaggagtggatccctgtcaccaagctgggccaccaggttaaggacatgaagatcaagtccttggaggagatctatctattctccctgctcattaaggaatccgagattgttgacattctcctgggcggatcctttaaggacaaggttctaaagatccttccggtacagaagcagacttgggctggccagcagaacaggttcaaggcattagtcgctgttgggggctacaataatcacaatggccttggtgttacgagctccaaggagattgtcactgccatccaaggggccatcatcttggccaaactttccatcgtctctggctactgggggaacaagattggcaagccccacactgttccatgcaaagtgacaggctgctgtggctctgtgggtatgtgttctcatctctgcccccagaggcactggcatcatctctgcttctgtgcccaagaagctactgatgatggccggtatagatgacagccacacaatagccaggggctgcactgccaccctgggcaactttgccaaggacacctttgatgccacctccaagacttacagctacctgacccccgacctctggaaagagactgttcaccaagtctccttctcaggaattcaccgaccatctgtgaaaacccacaccagcctgttcagaagacccaggctctgctgtggctaccacacaagggtttttatacaagaaaaataaagcgaattgaaagaacccaggactacagacagccatgccatcaagtgaaatcaggtttagctggtggaatacagccaatgaaactgatagagctttatcccgtcccgagggattcagttattcgtgggtgcgaggggggccgcaaacctggaaggagatgggaggaagaaaaagaggaataggagaccaggaagggcacctatcgaggtctcgtttattaggctgaggtgccttctttttaaagcatacatcgcggggaatatgggagggtcgagggggaattatacaaagaaaaaagaagtgggcaactgctgacatgggggccgaagtcaggcgccaggcagcgggcactctgcatcttatctctagaacatagatcctccttgacagccttgggtggcaggctgggctcaggtgtaactcatgtccttggatggcatgggagttcaggaagagataggaaagaggggactataattcagtgataaccagctcttagcacgaggccgtttggcctgttagggagattgtgaagggctcactttctcacgggatggtctctgacagagcttgtgaattttttgtcactcaataaattctgacattgtggaaagatgcagacatatctgtttctgacatactgtgctcacgatgatagtagttaattcccagaatattgagacatgacagtaatcagtgattattttctttctttctctctttctctctctctttctttctttctttctttctttctttctttctttctttctttctttctttctttctttcttttttcttttctttctttttttccttccttctttccttccttccttccttccttccttccttccttccttccttcctcccctcattccctctctatcttaaggcggggtcttgttttgtagggctggctggcctgacacccattatatagaccaagctagcctgtaactgatagagatctgatgacctctgcctccctagtgccagggttaaaggggtgcactgtcagaacaggctgattattgtcattttacgtcattaaattggagtagctgctaaaaaaaaagatagatagctagaataactatacaaaaatgtttaaatattaggattgctttgtataaaatgagagtcgttcttattgaagtttctttatgctaatgcatttaagtcactgacagatgataaaatttaagaaaatagttgataaggatggagaattaatttactttaattgaggcatatcactgacttaggcagaaaagatttgccaaaaaatcttctatggaggaaagattttctaatgtagtttctggctgttggtagctacaacgtccaaaggctacaagcttgagcctgtaaaggtgttgttgagaccttcaaggaggcacaggtagttggactgtgaaagacagtggcttgaacagctggtaactattccaagtcactgacttgccctcatcccatgtaattaaagacattttaaaatgtcagccccagttacatcctttgccagttagcttccctgaggaccagactctatgaaatgcatgcaacatgaactaagtttatcaggaagtgaccttgaggtagataccagtgaaaagaaggcacagaagttgaattaggtaaagaagtcactgcattcagggcccaaccgcagccttcattgatctctaagaagctcaccggcaaaatggctcaccagagctgtacaataaagatggagacattatgccatttttcattgtttgttgagacagatctcagtgtgtaatctaacgccttagctgatattacagccctgcaccaccatgcagtgaagctgagcctctgtgatccctttagaatctgtcactagatcggggttgtcccaggaagggtatgaccttgagcaaagtggtccagcatctgaggcaacccctgactgagcggaatcatttcctgaggccagacatcttccataaaaggcctctgcatggggcatccatcacgagctaagtgctccaaaagacaaggaaactcgtggctgattgcagcacatccattttgattctgagcaacgtcttttactcttagggtgacaatgaggatgactagtttcctgagctatgacaaaagggactcaataaaatgacagactgcctggagttttagggtaggttctccccccacccagaagtttttagcgccatacagtgattacagatgtataacggtattgctcccatcagcagatgatagaattacagcattaaaaatccatctgagagcttctgctttcctttctgccttttcttttaattaaaaagttttgtttcacacaatatactgatcgtgtgtttttctttctcccaactcctccaagatgctccccacctccctacctattcagccttattatcctttctctctctttctctctctctctctctcaagaacaaaaaaaaatcaagaagcagacaaaaaattaaaaacaaaaaagcaaaacataattaaaaaataaaaagccaaaacaaagcaagactatcttagaaactaaattctcacagcaaaggaggcttctaaccccagcagtaacttcttttcaaatttcatttcagggtttctagagaagtccctaccagtagagtgtgtagctgctactgattctgtttctggcttcatccatggccactgcctgcagaaacctttgtcttaatcatctccagttggtggccttggatctttctgggcctgctgctgtctgtcgttcttctgaattcagagaagagctgtgtggtaatggttttcctagggccttttcttccttcatgctgtgccattgcaaaatggaaaggacttggaaccggaagaccaagtttttcccaaaagtgtaagtatcacgtttaacaactgatgaagtccgctggcaagaaggcttggcagttaaaggagcttgctatgaggcaagacagtggaaattctgtctctgagtgagagggaaaacagtctctgacttatacaacctgttctcttgacttacacttgcacgtgcatggagcacaggcagacaccacacatagatagatacagatatatacacatttttatatagtcctctgctgatatccaactaggttgacttcatagcttagctattttgaatagtgctgcagtaattatcagtgtagaagtatctctcatgttgagcctgagtccttcagttatgaaagacactgcaggcttagccagtgaagaaaaaaaaaaaaagacatatgttaagcctatcagatatgagtaaaagaccaccaacccaaatggccaaattaaagcaagctttattaatgaatatggctgtctccccctaagacaggtttcaagagatcagccctgacctggggaagataaggtttttatagctcaggagtaaggtgtttctaacggggggggggggggtttgggaggcaaataagcagggttacagaagcagaacataagcataaggagttgtcatagcaacctcctgaaacaaagacatggctgctgtttcctggaagagcaggacagaataatttgtagctaaagttacaggtgggacttagcttagtccttgaaaaacaggaatgaacttggtttagtgtagaggaattttaatccagcgacatggctgctctggcaagggatcacatccaaagaccttctaggtttgtgtgatcaggcaggaatgacatacccttaagcccttacctggaatacagacatgcctttagtacacacttttaaccccaaacaatgaaggtaaagttagtttgtagaaggaagcagccatgtttgaaagtgatgcctaattgggggacagacaaagtgacaaatcagagaaagatttgacagaatgaatcagacaggatacacccaactctcaggaggacaggaaaagaaaagctatttaggagggagggagagagagaaagagagagagagagagagagagagagttagttagttagttcagttgagttcaggcaatgcagtttgtacagtcagtacagttcatggagtttagaggcagttttcccaagtggaacaattcagacagaagccaagagaagtcagtttgaatcagtccacttggagaggagttttgagccagaacagctgaattgaactagccagccagagttcagaaagaactagaaagggtgagcttatttagcagtaagctaccaagatggcaattatatctggtgactaaaagttagtttcacagcttatttttactataaaatggcttacaaactcaagatagaggcaggccagttcaacatatatccaagaggggtattatattctctctctctctctctctctctctctctctctctctctctctctcagctgtgtagtcccggttctcctggaactcactctgtagaccaggctggcctcgaactcagaggtccacctgccctggagatttttaattgtatgagttccaccgtgctgatttccatagaggttagagtacttgacaccccacctccagtatctgagggtttcttctctcaccttccccagcaagttgatttccttctgactactgccttgaggagtggggtggatttcagtctgatggctagtgatgttaaatatctcttcacttgttttttggttgattgtactttatcttttgaaaactatctattcgcttcgtgagtctatttattggtcttttttttttcttgacatttgtcgtgttctttgtatattctagatattaatcctctgttagaggtatagttagtaaagatgttctcccatgatgcaacctgtcttttgctcaactgtctcttttgctatgaggagatatttttatttcatgcagtcccatttgacaattgttgacattgcttcctgaacaactgggtcctttttagaaagccctgccttggctgatgttgaaatatcttcctcatttttttctctaacagtgttagactttcgggtcttacgttaggtccatttggaattggttttaatgcaaactgaaaagtggaactctaacttcattctcttacgtatagattcctagtcttcttaatactatctgttggaaaggctatctttcaacctactgtggtagttgtaactgcttgagtttaaagttctatgtaactgaagatgatctttttataatttttatttactatgtttatgtatatgtgtgtgtgccagaggccaaggaggccagaaaaaaagcatccaacccccctggaattggagtatagtgcacatggagtacagtagatgtgagctgctgactactgaacctctaacttctacaggagcaataagtgctcttaaccactgagccatctctccagcccctgtacctgtgtgcctttagtaactaagtcatgtactctgttctactgatccacgtgcctgtttctggaccagttttgcactgtttttgttatgaaggctacaggtttgcaatgttccttttattcttaatttcttcatggattttctcatagggcgatgttggatcttatcaaatgtcttttctgcatctattgaacgtgtaacttctgtccttgagtatattgatgtcaggtatgacatttattgattgacatatgttgaagcactcttatctctggagtgaagtgaacttgatcatggtgaataatttttccgatgtgttcttggatttgccatgtaagtattttactgagaattttggcatctatgctcatcggagagatgggtctatcctttcttcccagatccttttctgatatcagggtaatgctgattttgtaaaaagggggttgtgttgtattgtgttctccctttctacttcataaatagcttgaggaactctttaaagattcagcagtgggtcagcctgggcccgagccttcctctcgcctcttcacagattcgaacacacacttggtgactccgtttcctgtgtatcatcaacttcccaaatctacagttccactctctgagatacacctagttcttaatcgcgtcctgacttacagatgccttcaacatacgcttgaaaggtaaatatgtatcacctggccaaatgaaactcaaaaccttttatctgaagtggcccttaaaggggctggagagacgactcaggggttaaaagcccttgttgctcttgcagaggacacaggttcagttcccaaaacccacatggaagatcataaacctctgtaactcatctccctcagatcctgcatgaatgtaagacacgaaagctcctgaagaacacacatacatccacatgagaataaaaaataaagaattaatatcatgtgataaattcttacaaaaatttaagtttatttgggctattaaattctttgtttttttttttttttgtttttcaagacagagtttctttgtacagtattggctgtctggaactaactctatagaccaggctgccctcagacacacaccgatctgcttgcctctgactcccgagtgctgatattaaagacatgtaccacaccacctggcttcgctattaaactttaacttaactaatttttttgaatctgagttttctttacctaatgataaaggttatataacagctgtgtttgtgcttattttagtcttctgattttgtccatctctttgccattctatttttaagttattcttttacacttacttattttgtgtgtacaaatgtgtgtaggcatgcacatgccacagtaggtgtgtggaggtcagaggaaaactttgggaagtcagtcctctcctctaccattttggttctggatatcaaacttgggtggacaggcatgggagctcgtacctttatcagctgggctgtctcacccatggctctcctggaactcattctgtagaccaggctggacttgaactcaaatcctcctgtctctgcttcccaagagctgggattaaaggcgtgtgccaccactgcccagtctgtttcagtttttaatttcataagtcacttaaattcttaatgtgtgggaccctgtaacacacacctttaaacccagtactcagaaggcagaggcagttggatctctgagttcgaggtcaatttggtctacgtaatattttaggctagctagagcttcatagagagatcctgtcttagaaacgaaataaataagtaaaataaaataaatttttagtaaaggcagagagtgcttgaattaatttaatcttcttttaatctctaccaataacaatttacctgctcttcatatgtttaaagaaaacagttacctaccaagacctgtagaaagacaagttaacttattgaccccccagattgtacagcaagcatgtaacagccttcacttgtctggaatcctttcctttcttctattaaaagcgccctggattttctttgggaacaatccaatgaaaactgaaatcacctctgagtgtggaccatgtgacctagctcagccatcagttgtatggagagtttcctcttggttgcaataatgacctagaatttcccaatcataacgattcctggagcgcttctctgagcaccttgttcccatgcatcatagtcttgatggttaatatatactacaatgggcattcttgcctgaaatgggcctggagctgatagcagctgccatttatcatgtgactttcaaaggaaaaagaaaacaccactgaataatcaagaaaatcagagtctagagcagtggttctcaaccctccaacaatgagaccctttagtacagttccttatgtggtgacactcaatcataaaattattttcattgctaccgcataactaattttgctactgctacgaattgtaatgtaaatatctgtgtcttctatgaaagggttgttcacacccccaaaaggggtcatgacccacaggttgagaacagctggtctaaatagtgttgctttatcacctagatcaagctatacctgaggctagatacctggactgtatagtaatgagtcaatagatttcagtttttgcataaactagtataatttgtattttgtgttactgaaaaacccttaacagatgttaagttgttttcattgttattaattgtgcattcatagctcttccatctactgtgtgttatgacacactgggaagagcaggtgtcagatgagggcgggaaaggaagtctccaccaccagcagtagacagaaatgctgaataagtaagtctacggactcctcatctctagcaaggctcatggtgcttcacagccagatgctccaaaaggtgaaaacagccaaccagctgccatttctagtccttacagtagaggcagagaaactacgagtggaagggaaggtcgtgggtgaacacggaccacacacaggaagggaatgtcgtggctgggcacagatgatggacaaaccatgtaaacgcttctcagagcggcaaccgataatcatagactcgcgattcaactgcttagtccctagtcatgttcttttgagaggccctggaaactttaggagcaggatgacgtgcgcctcgtgggtacatccccggcttcttgcactctgctttcttatccactacgatgtgaactgagctattcagactgtcaccatgacagtcccaactcactgaaatgatgaacaaagaactactctgccatgcctttcccaccatgaagtccagaccctctgaaagatgaacaaaataagtccttcctctttttaagttgcttctgtcagggtttttggtctcactgatgtcaaagtaactaaatacacttctctagagaggacgatcagttcagcattgatttgctagtctatagctacaaaagacatctgaaacaatcaacaaagaaacaagacaattggctaagatttccagctccttctcccagtccctggcttcttcatttttctacttcctttctgttcattgctggtgctgtttccaggcacaaatttgtattccaaaataataataataatcggatgataggaaagtgtgttccctgattgttatccatttctgtgtgtcacgggaagttgtttttaataagtcctaaaaccggtagaaaaattataagcccggggggcattcacatctaaatattgtataaatgatattaggcagccacatgattttcaaatgaatgttattttcggtcagggactgtgactgagaggcaggagctgtcacagagatggcccttttatccgcactgtcagagaatatatttagcagctcatattgaaagatgccagcttaacaattttaaatggtgaagaggaaatgtctccagtcagttctattacaccactgttcaccttacatgcaatgatgagtggggatttttagcagcatttcctaagagcaaaacattttctctatgtgcttaaaaaaaaaaaagtgtcagctggccttgatacgtgatggactttggcacaagctctttcgagggatcccctaaccaggctgcatgcgtctgagcctatttgtattgcttactagctgtgatggtttgaaggagaaatgtctcccataggctcatacatttgaatgctcggcccgtggttggtagaactatttgggaaggatgaggaggtgtggccgagttggaggaggtgtgtcactgaggatgagctttgaggttgcaaagcccacaccatttccagtgtctctctgtaatctctctcagctacagcttcagctccatgaatgcctgcttgtcactatgctccccaccatggcagtcatggactctaacttacttctggaaccctaagccccgtatcaattgctttcttttataagtttctttagtcatggtgctttgtaatgtcaatagaaaaataattaagatactagctatccaaacttctccttaattacttaattacccaagttcctcatcttcaaaatggggaaacgagaaatgagtcaggccacaagcagggcttgaaatgatgtggctatggtgaccaattttggctgtcaacttgacaggcttgggataccgtcttagttaggatttgtattgctgtgaagagacactgcgacaacccttctaaaggaaagcatttaattggggctggattacaatttcagagtccattgtcattgtggcaggaagcattgtgggacacaggcagacatgtggctggagaccccatgggtagctgagagttctacatcttaatctgctgacagcaggaagagacaaccactaggccttgcttgagcttctgaaacctcaatcccatggggcccggtgacgtacttcctccaacaagaccacacctaccccaagaagactgaaactctgtagtgagaattttggtttccttaaaaacctatttatggttgggcgtgatggtgcacacctttaatcccagcacttgggaggcagaggcaggcagatttctgagttagagaccagcctggtctacaaagtgagttccaggacagccagggctatacagagaaaccttgtctagaaaaaccaaaaaaaaaaaaaaaaaaaaaaaacaaacaaacaaacaaaaaaacctcaaaaacaaaaaaactatttatgctatgttaatatgtttttgttttgatcccaggtgtgggatatggagctgcttcagtttgtccatagtggttaattatgattgcctcatgtactagcaggggaatgatccttgccaacacagagtttaagtctggagactctggaaagggaataaatgggagagccaccagaagacccatggcagctgctgccccgacttgctgctgcttttgttattgctggatctctttggatttctggatttctggattgctggattgctggattgctggattgctggattgatggattgatggattgatggattactagttggatttacccccaaggactctgacacctctaatcagcaggaagtaaagaagtctaagcctcttttcccttttaacctttctctcctacctagtgttgggggttggaagagattggggtggagtaagggtcagaagggtggtagataatagaacccaaaagagtagcccctcccccccccaatacaacaatgcatttcctaatagtgccacttcctatgggcctatgggggccattttcattcaaatcaccacagacaggaaacctcaggttggcctgtgagcatatctgtgggacagcttattgattgccaatcggtataaaaaggcctagcccactgtgtggtgttgctgattgcagggtctggatatgcaaagaggtgagagtgacaggccaggcaacggcagctttgggacactaccaaaggaggaaatgaaataggggaagcaaatgtcctggaggaacgctggatctggtgtcactttaaggcccacatgttaaaggtccagcctctagctaagtgctattgacagggggcagaacctttaagaggcagagctaatgggatgtcatggcggggtatggtctcagagaagatgctgagaaccttgtctctcctttcttgcacttcttagtcatgaggaacaggtttgctccaccacatactttagccagatgtgctgctcagcgcaggcccaaagcaatgaggccaattaattaatggctgggatctccaaagctaggacacacacacacacacacacacacacacacacacacacacaaacctttcccttttataagacaactggtctcagacatttgttctagtaacagaagatgactagcctaaggttggacatgtaaaacgacactaaggaaaaaagaaatagagaagaaaggcagaaaagactcctgggttctgccacagagcaccagatgctaccctgacttcactgagagtaagagcaagcccaagagaaggtagccaattcaagacgttcaagacacaaagatgcaaccctcttccagttgttacctgggaaacagaggtgcacaacatctagtcacaccattcgagatcactgagactggtttcctgacattattttctctgagaagtcaactattattttgtactctctaagaaggaaccaaactgaagccattttttttaaaataaaacctccattttgaatagggaccaaataaaagttgaagttcccaagacctctctgagtaactgacatcctggttggcagagagagacatgtacataggtaactggcatcctggttgccaagttgagacataaatgctaggcaagttgccctgccacagttgaacaacccaaccaatgggaacaggataagtgtaccacaaagacacattcctcaggaaatcccctatccctaagcactgattggtgggaaaatgtaaccataacttggcacaggtgtctgtggttttgaaacttaaaaggtctgcgaacctgtggctctgggtcacacagttccgctcccaagtctgttctgcagctgtgaccgatcagtggcagcttgattacaataaagttttgtcatctgtgttgacctggcatttgagctgtgctgggtctaaatggatctcataaaaactcagttcacctcatataattcagtctcctcccatctgtgcagctgaaaagaagaagaagaagaagaagaagaagaagaagaagaagaagaagaagaagaagaagaagaagaagaagaagaagaagaagaagaagaagaagaagaagaagaagaagaaagacaagtggaaccaatgcacaacacatcggttactgagagctgcaccttcatttctgagaaatgaaaactgctgactgctcagatagccgcgaggcccctcccccctctcccggttcactccgggagcagttttaactttctgttattcagaattacttttgtaattggtgggggaaataaggagcttattggagttacttacaggagcttgagtgaagggtttctcactcaaaaccaaatgcatcacaaagaagtgccacctctccatgtgaagatttccccccaaagctgtgtgacccatccccatccagattctttaactcaataactatattactgaggctgggtgttggtgtgtgccttttgtcccagcacttaggaagtggagacaggcatatctttgtgagtcccaggccagcattgtctacagactgagttcaggatagccagggcttcatagagaaactctgtctcacaaaacaaaacaaaacaaaacactcaccaaaaatatcgtttatattgttgaatatttggggtgctgtttaaaggtattatctggggcctaataagatgactcatcaggtaagagcacggactgctcttccaaaggtcctgagttccaatcccaacaaccacatggtcacatggtggctcacaaccacccataattagatctgacgccctcttctggtgtgtctgaagtcagtatatatatatatatatatatatatacagtgtgtatatgtataataataaatagatctttgggctggagcaagcagggactgggcgaatggagttgaccagagcaagcagagatcctaaaaaaaaaaaaaaaattcaatttccaacaactacatgaaggctcacaaccatctgtacagctacagtgtactcacatacataaaataaatctaaataaataaataaatgtattatctgtcttaatccattcagtccttaaaacaaaccaatgggtagatctccatttcatgggttctgtgaagtcttgggaagtggtagagtggcccaggcatccatgggtgcttgaactctctgccgggctctagagcactgagacactgtcccactttcccagaagagcaacgtccgtgctcatccacctcaatttttcaggagggcaaagggcagcagcctctgaggctgggcagcaggccaaccacggctcggaagcagtgcccagtggctaagcaaagctggagtctcggctggaacagaaatatatatatatattttgagcaatttgaagtgttttacactttattataatattaaaaaagaataaaactgtgtaaatactacgtgtcaatgaaaaatttgaagcaaatacgggattttctgagatcctgttcacgattcatcctaacaattgttgagtagctattgaataagatagggcctgtgttaaaagatagttattacaaagctgtcaaaatattttacaagctgaaaaatagaaaaaggtcaaagtttagatgctaacaagaaaattggccattttctttgagttatttgattcctcctacacacaggtaattaggcaaataattagctggcttcagttcattgagtgttctagtcaaggttatggtggcaccacgtgggtcataatgcagtgacagctgggttgattacataaaaacaagtgctttgccctttgccatcctcccctatcttctttcagcctgtgacttctcagttcctcatgagtcacacacaggctgacagagggctttctgtgccaggatatttgaccagcaaagataatggattgaaggagcctgccacacaaaagctttcagcaagcgaatttctttgtctggccgctgttcttgctgaggtacaaactttccccaaaacatcaagccttctctgcaaaagaggcttcaatgcaggtgcagcagctcacattctgctatgcaaggcttgctggggcaggggacccacagcacagcatagacctaccctaacacagccttcagtctaggtcatctctccaggccctggtgccctacatctggttctatttctgcagtggactaacctgccttaagggcaagagcttgctgtacaagctagagcagggcatttagggctaatgctgctgacacaggacgtcagctttacacttggaatcctgccctcccaggtccctgctgcctccaagtctttagtggtcccatttctctgtactggttttccactcatgtcagttaccctggctggctatctggttccatgttgcaaaatatgtttatcttttgttcattgttattttctttccaactctcctttttccttgccttgcagcctttatgataatttcagaagagtgagacaggagtaaagctcatgttcaatcttccattttacggctacttttgagtggttggtaaaaatggtagctattctacagactcacttctgtgagttctacaatattttacaactgagaaagtattaaaatgtctgcttgtatttgatcttaccctttaacttaaaactcaatgttttataatacacacagtatattagtataggacaattgatacaggtagcagacctcaaaagggttatagcaagggggtggtcaaacatgataggggaaaaaaattcaaggaaaagagattgaatttcatttcttgttcacaatcatgaacagaagagctagaggagacaaaatgtgactactaactatgtaaaaatttgttgggatttccacttgaccatctagtgaattcatctaaaattacctagaaatgaaaacagtaagtggccacaacgttaagttggaaatattagtccaattcctcaactattttataaaagtcacttttattctctaagtttaatcatcatcacagaggcttactgctaaagaaacacctttttttcagtcctttctgaactctagctgtgtggttcaactcagctgttttggcccaaaatcctctccaagctgactgattcaatctggcttctctaccattctgactgaattgctctgcttggccttaaactgactctggaaatctgttctaatcttgctccttcgcatcctctggcttgactctttacctggaacctgtctttgtaaaactgccttctctatcttcttctgcactgcatctcttaagtagcttctcctccatgttttgttcttgtgagagttggatgtagcctatctttgactcatctgtcaaatctttctctgatttgtcactttatcacgcaattaggcatcactttcaaaaatggctgcttccttctacaaactaactttaccttcattatctgagattaaaggtgtgtattaagggagttccgatagtccagccagaaggattaaaggtatcattctagctggatcatttagacttagaaggtctttggatgtgatcccttgccagagcagccttgttcctagattaagattcctctacactatccaataataacaataatctttcaaagttccctcttgcctcagagacttagctaaaggatcatggttcaatctaggaatgttctccatgaacctctatgctgagacttaatttcttttgtaggtatgggaagcctgatgaagagataagaagtccttctagtcaacaactaatgtagagaaagacctgtgaaaacctaaagacctattatactttagcatcatgaatatttatcttcttattgtggtggtgaggaaaatcaaatgctttatgactactgttaggctatccctcatcttttggtcctagacaactgtggtcccctatgtcaggtgtgctgaggaaagagtgggtttgtagatgggtaagagaggtaaaaactaccttcagcctagatactggtagatattgtggtggtttgatgaaaatgactcccataggcccatagagactggtattattaggagatgtggccttgttggcttggctgagaaaccaattctccccacctcctaatctcttgtcatggtgtgtgccttctatttgagtatctctaagtaatgtttaagagtgagttggagccctacattgggcgccatcaattacattaatcaattaatctactcaaatctcccagtggtggcacaagttccatactacctgtcccagtgttttgagtttctgaaagaaagacacacacacacacacacacacacacacacacacacacacttaaatatgccttaatcccaaatttccattttgctaatgcttccctccaatactcctgagttattacttcctagaatcgatattccatctttactctcctagtcccaagcgggggaccctctggggctgctcttttctgcctcttacatgattggtatgtctttctttttactctcaagcccagatcttattccttagacatggcgattctccttattcagtccccttgctagcaaatcctaaaatactgcctctgtctccctgcaaattagtcatttgtggccaacaattttatttaccaatcaaaaccaactggggacagggaccctcagcatcttacatgtgagatgcagattatacaaatttggaaacccaaataacataatcatacaagcattaagctaaatccacaattacccctaaactatttttatgtgctagactggctatttctcagctacacatcccaagttacttgcacatagttgtcctgtctgagctgaatttgctccattgggcattccctggttctgattctccatattatttctctctctccttgtggtccctacctgcacccctcagcctgtcaatcaaagctcctctcacctctagtctccccagtaactggctgtcagctacttttatttaactggtcagagaagactggtgagcaaagtttacacaacaccatttggagtacctgagaatgtgcttgtgggactgcacaaggcagatcctgggggccagagttttagagattgaatgcatagcagcacctcagcttgattcctggaacctacataaaggaggaaaaagagaattcacaccacaaagttgtctctgacctgcctgtgcctgctcacacacacacacacacatcatttacaatatgataataataaggaaacatttgtagtggaggttggtaatagatatcgcaactgtattgcagtgctgagtggattatgaaatggcccatcataggtagataatgacaacagctgtaatttttacgctgttactatgtgccaaacacaagctaagtgccctatatgaattatttttatttaaatcccataacagtcttgataacatccctacctgtttttaatagataaggaccttgaagtgtttgatgaatattgaccaagacagtggttgctcagcagtgagatggtatttgaagcctgccagagatggctttccggttggtctgctgagccaactaagactccccctagagtgagaaataaattagctgtaatgttatgctgttatggcatccattgtttttccaggtctgattatattctccaggaccctcataaaagtcagttgactcacaattaccagtaaccatgacaattatctttctcactgcaaattaagtaattacgattccagcttcataaagtaagtctcttgagtttgatttgtatgagtcagatcaactctgggtaaaaagataagattcaactgttcaacctgctgatctcaggacaaggtcctaagcccacattccaagatagtccaaggactctactcttcagagaacgtaaagaaagcagctggctgccccctctctgctatctccgtagctacagcaaaagcaaagaaggtttccagcagctcataatcagaaagcctgaaatttctcagtagagcccccttcccactaatctcagtgctatccaaacagaggtgactctcaaggtcaggcagccaagttctgaagaaatattcaaaactatgatattccatagtgagaattctggaatttagatttctttttttaaaaaagtgtcagaaatattataagaatattttttttaatcccaggagtggggatatggggctgcttcacagtagccggctataatttgccctgtgctttagcagaggtgcggttttgccagttacaaaatgcttggaccctgagaggcaaggttggtgtttgttggccattcagcaaggttggttatgtttattagtagtaaaccatagctcaaagaggaaacaataagaaagaaagggttgtttttttttttaggatttatttattatatatgtaaatacaccaacactgtcttcagacaccagaagaccccattatgcatggctgtgagccaccatatggttgctgggaattgaacttaggacctctggaagaacagtcaatgctcttaaccactgaaccatatctccaggccaaattcagtgatctttatctctttcccctgtatccttctttctctcctttctagtgatgggggtgggagacaggaataaagggtatggaagagaagaacctaccaaagacaagctacaacgttcagctttagctgagtaataaaatccctaggaatggtttcaaagattggtgtatcctacaccagtacccttgaccagttgaaataagactatctaggggtagtacacaggtgtctgcatggtaaaaactgaactcaacctgaattgagcaaccggaatgtcatttataggtagaatgtaacatctatatctctggctagttggaggttgccaggaaagggannnnnnnnnnnnnnnnnnnntgggaacaggcatgcctgtgaatagtcatgtgatgaggcacacgagtgttctttactgatgctcaaggaagcggagagaaaactggatttgaacccattcttaaggaggtcaaggtcggttatagagaaagaggaggtggatctgcacagcctgcctggtggttgaacttggaccttctaggagataatcagggcacctttgtgtgatgctagatgatattaacttctcaaatttatgttacgttaatctttgacttcagatggcagaatcagtcaattacttggatcttactgtttcgtgttagagccacgaaaagcaaagcttacccagaaatacatctgtcatcatcaaaataaaattcctcactgctaaaactcaccggcaagttgagggcacatgcaatcccaatttagaaatagaggtgaaaagcctggtgatggtggtgctctagggagacagaggaaagtaggtctcagtgagttcaaggtcagcctgctctacagagtgagttccaggacagtagggatacacagagaaaccatgtctcaaaaaaacaaaaacaaaaacaaaaacctccaaccaaccaaccaacaaacaaacaaacaaacaaaaacaaacaaacaaaaaggagacgtagaggcagggggattaggagttcagagtcagtttcagctacatagcaagtccaatgtcaacctgggcaaagaaatactgtctcaaaaaagaaggaaagagagaaaaggcaaagaaaaacatgaatcatcccaggaaaatgaccgagattaaaaagacaggaagggcttagagagatgctttagcagttggttaagaacattagctgctcttccagaggacctggattcaattctcagtaccatgcagctcacaactatctgtaattccagttttgggagttccagtgccatcttctggcctctgaagttactgcatgcatgtggtgcacagatgtgtaggcaaaaacaaaacaaaacaaaaaacactataaaataataataaaataaaaaagataggtaatgataagtgtcatgggggtaatatggactaggaacctttatttattgattgttagactataaaatgatacatctcttaggaaaagagatctgcagttactcaaacggttagaactaacatgtggtacagtgatttttttccccccaaaaggcatgaaaacacatatccacaaaaaattatatgtaaatgcttcaggctaatgttgtgttcctccctcccaattcaatttttaaaaagaatttctagtgatagcatatctgaaggagaggcctttgggatgtgagggcctctgtaaccaccacgaccagcaggcgttaagccacatgaggtaagaaggaagtctggctcaacaacacttagtagccggtgttggtttaaacttcaagggtccaacactgggcaatttatgttaggtatatttaagcacaacacaatctgaaaatagtttcctggtgatagttaactcaatcccgtgtgcacaataaatcttaagctacgaccacatcaaaattctttgtaaggaacatgtaacttcttccatcaatatgggttctgcagagtgactacaagtgacatcttaagggtctggtggagaatctggcgtgatttcagtcacacagatggtacaaaggtcaccaggctactaactacctctgccctcagccttctgggtagaaaacaggttattcaggtctctctttagagagacaaccaaccgtgtttaacattccaggtttccctagtacctatctgtgagcacaagaacctcggtgcctgctacactgggagatacattgggtttagatggaatctgaggagtgacggggaagacaggatcaacaccagctaaggactgccctgccctgccaggcccttccctccccttctcttttccttccttttactctcttccccttcccttcccctcccctcccttttccttttctctccttcccttttctcccctctcctcccctctccttcccttccctttcctcccataccctccccttcctccccacccccttgctctgtgtttgttaaaggcaaaagagcgctacctgcaaactacaaatagtgctctcacccagaacccaatcttattggatcctgatgccagaattccagtctccagattataagaaatgaatgtttatttgtgagccaccccatgcatatttgttacagcagccctagctgactgggaaatatctggattcacaattcagaaagtgggatatccagacaataggacactatttgaattgggggtggagggacgatgaatttacaatacattccatcacacgggtgaccttgcaaacatgccaggtaaaagaagccggacgcatacatgattccttttatagaagattaccaaaatgtattcagtgtgaagacagaagctatttttatggacaagaggttgtaggaaaaggaggaacgccagtgcatttggaattccttggagatgatgcaaatggctcaggacatgtaacagtgagcccagcaaatacactgggaactgctgcattgcacacttaataaagggcacagtttacagtgtacaaataatacctcaggaaagctgctcccaacagcacaaatcagcacataggatggctcagcaggtaagggcacttgccagcaaccggagtatctgcgttggattcctgagacccatacggtggactagagaaccaactcccacaagttgtccttagatttgaaaacatgtgccaagatgtgtgtgcccacacaaacacaataaacaataaacaacaaaacccaataagctgggctagataactagcttgtttggcacagtgctgtcttagaatgtgtagagccctgggtccaattccagcattgcataaaccaggcctggtgctgcatgcctgcaacttttagctatgtggcaagttcaagtgctagcataaagtgccatctaaaaatatcaaaaatcttggccactgagatggttcaacaggcagggggccttgcctccaggcctaatgacttgggttcaatccctgggtccacatggtagaagaaaagaaaccagttcttataagtggttctcttatcttcatgcaggcatgtgcttgtgtgcacatgtatacatgaaagcaaaataaaatgtaacttaaaacaaaaataaaaatcccaattttaaaaattctagggcctggagagatggttcagtggttatgagcactgactgatcttcccgaaagtcctgagttcaaatcccagcaaccacatggtggctcacaaccatctgtaatgggatcagtgctctcttctggtgtgtctgaagacagctacagtgtactcatattcaataaataaataaatttttaaaaaaattctagaaagtaggatatgaggccatattgagggaacaatttaatttcaatggctaaaaatgacctccatcaaatacagtctgctttttcataaatgttataaatgctaacggtatctgagttaaagtcagaaataaaagagagaaatcctattaactcaatgccagttaagaaagctgagtgacactgggtggtcgtggtgcatgtctttaattttagcactccagaggcagagccagatagatttctgagggttcgaggtcacccttgtttacaaagtgaattcagggacaaccagggctacaaggagaaaccctgtctcaatcgtcccaacccaccccccaaacccacatgacaaattataaaacttgattggtggaggccaaataggtacacttttaaaaacacagggtgaaataagagagagaaagcagtgatgttagaggggaatcagaggagcagcactggctgcccttctagaagacccaggttctcttcccagcacctacatggtagctccctgtactggctggttttgtgtgtcaacttgacagaagctggagttctcacagagaaaggagcctcccttgaggaaatgcctccatgagatccagctgtaaggcattttctcaattagtgatcatgggggaagggattgtgggtgacaccatccctgagctggtagtcttgggttctataagaaagcaagctgagcaagcgaggggaagcaaacaagtaagcagcattcctccatagcttctgcacccactcctgcctccaagttcctaccctgtgtgagttcatgtcctgacttcctttggtgatgaactgcagtgtggaagtgtaagccaaaaaccctttcctcccaaacttgcttcttggtcatgatgttttgtacaggaatagaaaccctgactaagaacactcgccaccatctgaaattccagttccagggatcctcttttgcctttgacactcaagtgctgtgcagacatacatgtagccaaaaactcatatacatgaaaggtaaaataaagaactattaataatttctcaaaatgcacaaactattcactgaaaaagagtgtgggccagggggctggagagatgactcaatgtggacttgctcttgcagagtttagcacctacatccatatgcttacaacatctttaattccagacctaggggtccaagcctctggtctccacaggtatctgccttcatatgaaaccctgccccacatactcaaaacattttaaattttttctataatgtattagtaagttgtatgttaatttaatttaactaatttacttattttgcattctgggggttgaaccctgagccttgtgcatgctaagcacacacaatgccaccaaacctgtattagttattgttatactgctgtgacgaggaaccctgaccaaggcaacttataaaagaaagcgtttaattgagggcttgcttacagtttcagagggtgaattcatgactgtcatggcagagagcttgacaccaggcatagccctagagaagtagtcgagagcttacacactgaaataacaagtgtaaggcagagagacagacagacagatggacagacacagagaacatgcaagctagctagaaatggcatgagcttttgaaacctccaagcccatccccagaaacacacctccttccacaagaccacacctcctattcactcccaaacagttccaccacctggagaccaagcatagaagactatggggtccctttgtattcaaaggtttacacctcctctagcaaatatactttagtttttacaagtgaagaaaaaaagtccaaacatatttgtgtggtgtgtgagtgcgtgtgcatgtgtatgtgtgattctgggatcatgtcttggtctaagttacacactattgtgtaaaagagtaggttttcaaactgagctttgctccgagagactccatttacaagcggcctttgactccttttcaaagatggaggatggccgtgccattgggtagatgcgtgcactgccccatttgccccacaccatccatgcacaatagactgataatttatctctgagagtaggaagtatgctaccctataagtttattggggtaaattatgattggcatttggccatattgtaaacatatagggaaatcaggccaaagactgtgtcagacacaccagaccaaggaaaatatataactacctcacctgaaccctcaaagatgtgatgggaatcccctagttctgtgatgggaaccacatccaccaagctgttatcttcagggactaggaattaaacagattccttgagaggcagatagacagggagaggggccatcactaataaagatggtgaacttccaagaggactcgcttcctccattccttctagatctgaggcaaaaacttaaaacacaggtctttgtagacgtcttctcctgccaataggtcccgacccctcaagctcatagtgaggtcaagacacagttacacaacagttgtgagagtgacccttgaaagactaaaaactcccagccttcagggataggtgggttttctgtgtgcctgctgtatgggtgtgttcttgcccctaataaaagcctttctttaactgctagttctggctgcttgctctctagcacaccccaggctgatgctgatgcacccttggccattcaagccttgggtggctttcactttctgttctgccaagatgtaaacaggaaagttttgttctcctctttccagtgtgaagaatcctggaaatagagcgatagaaagctttacttacaacaagttggcagaggtctaagagtggggggttttgtctgttaaaaagccatcttccttagaggttgtggcccagggcttttatagggatttttgtggggagcaggggaggtgaggaggcaagtcagatggaggtcacccgtgcagctgccagaagctggtgtcatgcttccctatgctaatcctggttcctacagatctcaaggtattcccagttccatgaagctaaagaaaggttacaagtgggaaagtctgatgagtgtacttttagtttctattcccagaaacagtcaggtctacagttagtcattaagattaaacgaacaggaagactgaaaaccaataaaaccccggaggcaggcccaaggcaactggatctgagagtatttacagcgattcacacaatagattttcccagcgttggagggtgggtcttgctgtatatctcaggctaatgtcaagcttgctatgaagctaaaaatctcctgcctggaatctcaagcttgtgccaccatatgctgtctagaacagttttaacccattagatgtgcttcagtctaaggctccatctacagcaaagctagaggagactgatggtaaaccctccagccatgtgatccccccaaattaatgatttgagagaaaaaaagtacatttagtttttattgatgtgtatgtgtgagtcaggatgagaatatatatatattctcatacatatatatacacatttagatgtacatatatgtatatatacaaatatatatatatatatatatatatatatatatatatatatatatatatatatgtgtgtgtgtgtgtgtgtgtgtgtgtgtgtgtgtgtgtgtgtgtgtgtgtgtatgtgtgtaccagatgtatgccgaagccaacaaaagccagaaaagggcattggaccttcaggaactagagttctgttgggccatttattcagcccttcaaattagtaatattcatttatttgtttgtttgcttgcttgcttatttgtttttttcaagacagggtttctctgtatagccctgactgtcctgaaactccttttgtagactaggctggcctggaacttagagatccacctgtctctgcctcctgaatcctggaaccaaaggtgtgtgccaccaggtctggcaaattaatgttttttgttttattttggtttaaagatttatttatttatttcatgtatgtgagtacactgtcgttgtcttcagacacaccagaagagggcatcggatcccattacagatggttgtgagccaccatgtggttgctgagaattgaactcgggacctctggaagagcagtcagggctcttaactgctgagccatctctctaggccccaaattagtgattttaaaagtcaactaaaagtggatttaggctctttctgccattttggcgcctgtggaggcctgctgggaacaggacttctaacagcaagtctgtctggaaggctgtggtacaaggccatttttgctggctataagcaaggtctccggaaccaaagagagcactcggctcttcttaaaattgaaggtgtttatgctcgagatgaaacggagttctacttaggcaagagatgtgcttatgtgtataaagccaaacacaatacagcgactcctggaggcaaaccaaacgcaaccagagtgatctggggaaaggtaactcgggcccacggaaacagcggtatggttcgtgccaaattccgaagcaaccttcctgcaaaggccattggacacagaatccgtgtgacgctgtatccatcccggatttaaactaatggagagtaaataaataaaagtaaatttgtgcagaaaaaaaggtggatttagaaagcttgatgttagcattttgtctagtctcagccccacagttatttggcaacaagcaggtgtacctgactcactataaaaggggctgcttggcccctcctctctctcttgccttcttgctttagctctgtcctttcacccctctcccctctccttattccccttcccgcccccatgcccccatgtgctcatggctggctctctctctctctctctctctctctctctctctctctctctctctctctgtctgtctctactaccctctcaactcctctctccatgccctgaacaaactcgtttctatactatactgtcttgaggctggtcccttaaggggaaaggataccttagcatgggccctcggaggcaaccccttcccccacatctgactacacatccaccaaacatattctctctctcattacctttttataaaacacaacacagcctcgcagtggtgtgtttaatcccagcacttgggaggcagaggcaggtggatttctgaattcaaggccagcctggtctacagagtgagttccaggacagccagggctacccagagaaaccctgtctcaaaaaaaaaaaaaaacaaaaaaaaaacaaaaaaccaaaccaaacaaaacacaacctttggtaaacaaacaaacaaacaaaacccccccaaaaaaacaaaaacaaaaaacagtatcatcatataggatgcaaacactgcctcaggactgtgtgaccctttataatgtttgtgttagagaaattctaggtcaaaattctcagccccgcaattcatcagttgtaaaacctccatcagttgcatgtatatattgtgcagagacataattactttacagtagtatcatgaggattacatgaaacaaactgtccaagtgcctggtacactaaaaaatctggggctggagaatggtccagcagtaaaagcattggctgtgttctagaggacccaggtctgttcagatcccagcacccatacgacagctcacaaccctctgtaactccattgctgggggatttgacttcctcttctggtcctttcaggcaccaggcatgcaagtggtgcacagatatctgtaggcaaaacactcagaaatcctccgttctctttcctgggttttcttaagttcactctgtcaatgagttgcttgctctgccttttgacctatggttgatgttactgaactgtagtttacagaaagctcttgggttaaaggtgtgtgctatggctgagcacaacaaaatccaagttttcccagttcacaatctcaaggttcacaaggtgataaaactatcctgcaacatcacccccctttgtctaaaataaaaaagactctttctcttacatcattaaactatacactacctggtaagaatgatattcacaatgtccagtctatttgtatttggcagccttggagaaactactctctatcctgtctctgtgaatgcaaagttctgtgcctgaatcactttctataacttgtattcatcaacctaattaacatccttttaggcctcaattgttttcttaaacctaaacaatttaagcttaacttaagactatggctatgtagtcttcaaccccatcagagatctgagaaggataaatactacccgagaaaacaggaagtgcagagcaagcagtttccaaaactgcagaaatgatagatactgctggctgcctggacagtcacacaagattcctctttaacaccggagcatccctctctttggtcgactggcccagaatatctgacaacttttcctgtgaggcagaagttatgaaggacttctctactttgtcctggtagaatttggcaattgactttctttgagtcctgcttggacagcatactgtcagcagttgaagcaagggcagtttcttgcccagtggcagcttgccacatctgaagcaaactccataaggaggttcttcaatgttcatcatattctctgaaattgaatgggtctgatgccaggagctgaaatatctcattgtccaaaaaagaaaaaaagacttaaattaattaaaaaaatctttaaatgccttgttctacagatctctgatgttgttgaagaccctgtaagtatctcagtatatttgaatagggaattgttgcttgtctctagttatttactatctggttaacgtagaaaacatctgagattaactaaactagttcttgtcaatacaagtttgacagactatatatttgcatttcttaattatctgaaacaatttgttattgtagctttcaaaagaactaaaactcatgttgcttttttatgaattacataggtaaattaccttaaaaggagttgatacatagtatgttttaactaaaatataactttaattctgtatccatttacaaagatctataccaatgtaaccaaataaaaccttaattttgtatcattatacaaagatctataaaaggagattatataatctaccctttcccctattattttttaaaatatatttattatttattttattgagatatgatttattttttaaagattatctatttatttatttatttatttaatgtatatgagtactctgtagctgtacagatggttgtgagccaccatgtggttgctggaatttgaattcaggaccttcggaagagcagtcagtgctcttaaccactgagccatctcaccagccctcctgtattattcttatgtcctcttttttgtttaaataaaaaggaaagattttaactctaacacagtaaatctaatgaaaagaatgaagctatttctgccaagctttccatagtgtccagcttggttgtatttggcaatcttaggagtaaatatttttgagttcaaagttccgtagaatgttcgtgtcagtctcatataaactcagcaccttgaatgtcctgagcagtttgtagtctgaagctgatctttgggcagtgtttgtcagcttagtggcaatcctggctatgtagagcatagcagccaagaatcatcaagagcagcaagtattcttaactactgagctacctctctaaccctgagagcctcgttttctttagccgttcatccagtgatgggcacataggctaagtccatgttgctggctatggtgacctgtggtgaggtagatgtaggtttgcaggggttaatctattcccagattgagcaagtaagtttgaactcggaaaaacaaatactgcatatcaggacgtgaaatgaggtccagagggggctaacagtgacaatgaagatgatcaaagagcacggtatgagacccattaattatttgtgtacaaataatgtatgctttaaggggggcaggcaggaatgtatgaagaaggggtggaaacagcgtcattgagggtacttcagtaatcctggtgagagaactctgaggaagccagagctgaagcatcagaagaggtgggacctaaacagtggacaggaggggtgctggagagagaggagccagtggtttcaccaggactacattttaataaacgtgtatttaacagtgactcatgtttttctggaaataggtctgagtgccctctgctagaaaatgaggcatctaaagtttgacccctagggtcctttccagctcagttaccaagtggccaaagctgcagagtggtctgctgtgttttctccaggagcagggggcggggcgtgagtgaggtgaccgcggtggtaacccatagggatatgctgtctgctatcttgattcctgcctctttctctttgtattccctgctgtgaactcacagatatgtatcttaatcttggccttagtcactgtattttagatgctttgggacccagtcaatcaaaatactgacactggtgtctacagaacctccattttatgctataggcatccatcttggtacccactagccattgtctgactccctaattcaatgaacaacccccccgccccccacccagaaatgtgtcaccatgactatgtacttgttatgataagactagtttttggcttctgaaacctgcttttgcagacaatcgagaactattttgaggtcacctttactacctaatcttggcggacagaacagttcttcacttgctgtgtagacgttcaaagtcttcttgtgcttttcctccataaaaatccttccgcacccccactttgtgtggaaatctcaagtttggctcagagattgttgtcctgctagcaaccagctttaataaacttaattaactatattctgattgagtctgtagtcttcctgaggtaaactccataacactacttctattaataataatgctaaatactactcctctactgctgctgctaaatactactacttactactaacaataatgctaaataaactccggcaaaccagtgagataaataaaataaaatttaaaagttaaaggatagtttgattttcctccccccgacttctatcttgatgttgttgtttttttttttttccattttttattaggtatttagctcatttacatttccaatgctatccaaaaagtcccccatacccacccacccccactcccctacccacctactccccctttttggccctggtgttcccctgtactggggcatataaagtttgcgtgtccaatgggcctctctttccagtgatggccgactagaccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccctggcatagtctcacaagagacattgatgttgttttgaggaaatagtaaatatctggatttttagcaatttttttctcttggagaggagaatgcccccaattagctgctggcactcattaagcaggggcagggcgacaggtttaatagagactaaatatgcttgtaattccagaaagatgaaccctgtagcctatttaaaaagaaacattcatgttctggagagatggctcaggggttaaaaaggatgcttgctgctcttgcagagggcctgggttcaattcccagcttacacgatagctctccactgtctataactgtagttccaagagatctagatgctctcgggcactgcatacatgcagtgcacacacaaacttgtgagcaaaacacgcacatgcataaaagtaaaactcctttgtttactgaggggtggcatggtacgcatgtgccagtcaggggtgcctagcaagggctggtttttgccttctactctgtgggctccaggcatcaaaaccaggttgtcaagtttggcagcaagtgcctttaccctcggacctagctcactggctctgtggtctacttttgtctctatagcaacctaaattcactaggcagaaaaaatatggagaaaaatgatttttttttcaatcaaaagtgaaaacaattaaaagagttgttttgagatgttggagctacacaaacaccaacctaaatacctccacacaccactgcatattgtatgtgtcataggaaacacccagaagtccaacctaaggacacagtaacaaggaatgagggaaaccacacagtctgttgtatgtaaggacctgactttatttaatgcagataataacaccttgcaaaagaaaaaaatccaaatgtcattgagccctccaccacgtggaatttgcatgtgcacactggatgaaataaaagatccagaacttaacagaaaccatttttttcttctttagagtaaatttgattacaagattagaagacagaaaatgatcagttggtcttaatgataaacacttggtgaatcatccaaagggaaagggtctgaaccggatgcagaaggcagctatgatggtgcaggccttgcacttggaaggctgtggaagcagatcctgagagctctgcctaggatacatgcaagaacctgggcaggaggtgaggcaggagggtcagagttcaagaatagccttggctacatagggagaggccagtctaggttacatgagaccctggctcaaaaaaaaaaaaaaaaaaaatctaaacaaacaaaaaaaccaaaatggggatgaaagtaaaagttagcacttctacttattggttatgtcaccctcagtgattgactactgtgctctgtatatgagttttctgttcaaagaatagagctattaatcagattgatcccatcaatgttaagtacttacaggataagtacttgattaatacttcctattaatatctggccaaaatggttttatgtatgtgcatatgtgtcttaaggagaaggttagggtgtcatctaccattttggagagtggctggaatacagatcaccaggtcattgcctgctgtggttttcttctaacttggagaaccacttacagtgaactgtgatgtgccatccagactctacagtaggttgaactttctcctttactcctgtccagggaaaggattagaaagactatatatgagataacagactgctgggattcgctcaaaggattaaaaaacaaaaagccactacattgcaggtagcaaatactgtgaaatattaaactaagggaaggctatttacccgttaaaacttgaaacaatatatattctaaaagtacaacataatgtgtagggaagaatataaaaactatgttgcacttctgtggcagggcaagtgcatcctctaggacaggttccatggatcaggggagagtagagcccaaattcaaggcttagtcagtgtctaatcagtacaagttggggtaagaaaactattttccaaatgaatgtcacggtctcaagtcatctctctcccgaagatttggggaacatatctttttatctattcactcctctgctgagctactagcatcttgagtcaggcagtagtcacacagtatctcctaggctctgtgtcctgaaaaatataagtctttttgttctatttattaccaaaagttgcctcatctcctggaaacttctcttgctatgggtagggaaggaaatatgagtcttttccagccaaacctgtttgttgttgttgttgttgtcttttttttttttttttcctagacagggtttctctgtatagccctggctgtcctggaactcactctgtagaccaggctggcctcgaactcagaaatccacctgcctctgcctcccaagtgctgggattaaaggggtgcgccaccacgtccggctgccaaacctgtttttaaagttcccatttatacaagggtttcactttcccacttacacaagggttcaggaagagattaaaaaataaacaactaatgtattgctacagagatggacatgaaaaagaattatgggatggaactcactggcctagggtttaaattccaacatcaaaatcaaatcaagccgaactaaaccaaaccaaatcaacccaaaccaaaaaagctaaaaccaaaacccccaaacaaacaaacaaacaaacaaacaaacaaaaaaccaggcaatgccagcactcaggaggctgatataggcagatctaagttcaagaccaagctggtccacaaattgagttccagagctatgcagtgagaccctgtctcaaataaacaaagcaaacaaaaatcagggaaggttccattatgtaaggacatagaagatgattacagactcacccaacaccccaaccgtaacacaagaatgacgtcagatttcttcagcaaaaattgaaatcctataaaactataaagttttcttttctatctccccgctccccagtgtgtgtgtgtgtgtaggtgtgtatgcagaacagaggatgatgttagatatatttgtttctgtcttcctaatatttgttttgagacaaggtctcactatgtatagctggctgtcctgggacttggacactgtagaccaggtgaggtctggaactcagagattgcccgcttctgccttccaagttctgacattaaaggcatgcacccccatgtcccgatccaccttatttcttgagataaggtctctcagtgaatccagagctcatggttttaactaggctagttggccagtaagctccaggaatcctcctgtctctactcaccagtgctaagattacaagtgcatgccaacacaccaggcttttccatggataatttcagatctgagctcatttcttcatgctttgtagacagggccattccccccagcctgtgcctgtagagtttgccttccatgaaagagtgccagccactctagaaaagactggcaaacagactacttaacatgaaaaatgttacaaagtcgttctagaaacagattttggtctgtactatccagcctcctgacacatgtcttttgagagtggacagacatcttccctgcagtttccttactcaatgccttttgctttcagctcctccttgacacgtttcaggtaatcaggatcagggtagccaaaactgcaggaagaaaacaagaaacactttagcttcttcccaaagaattcttaagaatgtgtatgacagctggttattgtggcacaggtgcgcaacactcaggtgacacaacagtcagagctctatgagtttgaggccagcctgagccacataaggagactttgcctcaaaacaacaacaaaaactgtaggtactacttacatttgagcatctagtattctgggttccaaacattctccggcaatccagacagtgactaatatctagtcatccaagtgcctggctggctgaccagcatctgttttctagacagattgcttaaattcttaacttattctaagtactgatgcacataatgttataactgtcatattctacagaggcagtagtagtcatacacttatgggcaaacacaccagaagaaggcattggatcccattacagatggttgtgagctaccatgtggttgttgggaattgaactctggacctctggaagagcaatcagtgttcttaaccactaagccatctctccagcccctgtgggcttttcaaattgggggatctgaaaaggcttcatgatatatttcttttggatgccagaggtagaggaattcagtcagatttcctggaatatatctcccaccatcttgggaccctttataactaagacttctgctaccatatattagtcttgtgagttcagtatcattgtggactgatgggaagagagaggcgaggaagagggcgaggaccttaaaaggaatcaaagccatgctggagagatgactcaatggttaagagcaggggctgcttttacagaagacctgggttcaattcccaacacctgcatggcagctcacaactatctgtaacttcagggcatctgacacccttacacaaacatacatgcaggcaagccacgaatgcacataaaaataaataaacctaaaaaagaaaaacagaaatcaaaggcaaataatgttcctacgatctatcttttaaataaacatgaaaccctaaatttaatcaacttgggtagtattcatcttgggctctgaaacccctttcttctgcagcagaactaaacaactgagtaataccttatgaatggcagggtagaaggttgggggaccagtctttttatctttgaaattatcattatgggctattatgtgtatgctgtggctgttggctagttttatgtcaatttgacacaagttggagtcatcatagaggagaaaacctcaattgagaaaccgcctcctggggggggggtggtggcaaacaacctcaatcccaacacttgggcagcgaaggcaggctggcctggtctacagagtgaattccaaggcagtcagggttacaaagaaggctgcctccataagactgggtggttggtaagcctgtaagacattttctttctttctt

SEQ ID NO: 1520 - DNA, 903 bp, Mus musculus
atgaagatcaagtccttggaggagatctatctattctccctgctcattaaggaatccgagattgttgacattctcctgggcggatcctttaaggacaaggttctaaagatccttccggtacagaagcagacttgggctggccagcagaacaggttcaaggcattagtcgctgttgggggctacaataatcacaatggccttggtgttacgagctccaaggagattgtcactgccatccaaggggccatcatcttggccaaactttccatcgtctctggctactgggggaacaagattggcaagccccacactgttccatgcaaagtgacaggctgctgtggctctgtggaaacctttgtcttaatcatctccagttggtggccttggatctttctgggcctgctgctgtctgtcgttcttctgaattcagagaagagctgtgtggtaatggttttcctagggccttttcttccttcatgctgtgccattgcaaaatggaaaggacttggaaccggaagaccaagtttttcccaaaagtgcctgctgggaacaggacttctaacagcaagtctgtctggaaggctgtggtacaaggccatttttgctggctataagcaaggtctccggaaccaaagagagcactcggctcttcttaaaattgaaggtgtttatgctcgagatgaaacggagttctacttaggcaagagatgtgcttatgtgtataaagccaaacacaatacagcgactcctggaggcaaaccaaacgcaaccagagtgatctggggaaaggtaactcgggcccacggaaacagcggtatggttcgtgccaaattccgaagcaaccttcctgcaaaggccattggacacagaatccgtgtgacgctgtatccatcccggatttaa

SEQ ID NO: 1521 - protein, 300 aa, Mus musculus
MKIKSLEEIYLFSLLIKESEIVDILLGGSFKDKVLKILPVQKQTWAGQQNRFKALVAVGGYNNHNGLGVTSSKEIVTAIQGAIILAKLSIVSGYWGNKIGKPHTVPCKVTGCCGSVETFVLIISSWWPWIFLGLLLSVVLLNSEKSCVVMVFLGPFLPSCCAIAKWKGLGTGRPSFSQKCLLGTGLLTASLSGRLWYKAIFAGYKQGLRNQREHSALLKIEGVYARDETEFYLGKRCAYVYKAKHNTATPGGKPNATRVIWGKVTRAHGNSGMVRAKFRSNLPAKAIGHRIRVTLYPSRI

SEQ ID NO: 1522 - DNA, 26147 bp, Homo sapiens
  misc_feature (1)...(26147): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatggactcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaggagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttttctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagaagccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctccca

SEQ ID NO: 1523 - DNA, 960 bp, Homo sapiens
gctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttc

SEQ ID NO: 1524 - protein, 144 aa, Homo sapiens
MFNPTRPRGGASSFSYRHLGSCGGLLGTGLLKGTMSGRLWSKAIFAGYKRGLRNQREHTALLKIEGVYARDETEFYLGKRCAYVYKAKNNTVTPGGKPNKTRVIWGKVTRAHGNSGMVRAKFRSNLPAKAIGHRIRVMLYPSRI

SEQ ID NO: 1525 - DNA, 25849 bp, Mus musculus
  misc_feature (1)...(25849): n = A,T,C or G
ccaagtgtattaggggaacatagggggcattttattattgatcacagtcactattattgttattatattgctatttttattaaacctcaccctgctacagggtggggagtgaaagaagtatttatctctttaaacgccatattcctggaagggataggctctgatgctccaagatgtgacaagaaccaataaagccaactttataagctgctggcttccctgcctaggtctgtcttgctgtgcaaaaatgggagtgtggaaggaggaggagtggtggggatcacggacagttgagagctggcctcttgagagcattgtgtgccctcaacaagaccacagggcaactttggatagtctccaggagctgtgattttgggcgggattttttgttctggcttggctcattggttggtgttggttgctgtccatgtttttgtttttgagacagagtcttaactatgtatctctgatggctagcctggaactcagcttgtagaccaggattacctgaaaatgcctccaaaagcctctgatagaattaaacatgtgtgcccctacactgagcctcgttgggttgtgagatgggttctctccttagccatcttcaggctggcccgctgaaccgtcccaggcacctgctctcccctctgaagagctgggattctaagctccaccccagctgctttctcacctgtgctctaggcaccaagctcgggttcccaggctcgcacagaggcatttcaccagcccagccgtcttcccagacccctggcctgtagctccaagaatcggatgtcaggggctaaagaaacgcttcattgggtaaaagcactgcttgctcttctgaaagatctgggttcaattcccggcaatcccatggtgcttcaccaccacctgcaaggacagttctggggatctgttgccttcttctgacctccaggcacaggcacacacacagtgcacttaaacacacaagcaagatactcgtacacataaaacaaaaaaataaaccctcaattccagcactcagtaggcagaggcaagcagatctctaagtctgaggccaacctggtctacagacagccagggctatacagaaatcatagatagatagatagatagatagatagatagatagatagatagatagatagatagatagatgtcctagatagatagatagataggtaggtagatagatatcctagatagatagatagatagatagataggtagataggtagatagatagatagacagacagacagacagacagcagacatgctcaaagagggtacatgggtacagtttgataatgaaaggatggcttacagatgtgtaggcagtgttaggcagcctccccaggagggcggtaccctagaatcttaccaggacggggatcgtgccccatactgtctgtaggaagacagtcatgctatctgacagccatggcctgcccaagacaaccttggctatggctgagcagaaattcaggcctgaaggtaattctctttttattctgtacccaccctctcccttctcttgccttcaggcaaacccaggcagcatcagaggcccttagagttcaggtttgcagttggtagaaggccaccttgaaggtgtggtcagtggaccgggtaggagtaggtctgaggcctgctaagggcctctgcagcgctgatgctcgaacacgtaaggcatctaagaagtgggaagggcttacgggtgttttacctgttcctagccaggggttccatgactgggtagcatctagacctccagactgagctagacagagagaagtaagttctgaaccctgggaccagggcagaccataaagctggagagaaagtaggtcaagaagatggggcaccaccaccgtgattgagaatgagattgcagatgcactgcagaattagagggcctgagaagtgtgagctagcgagtcagacccaaacgatgttccagcacccacatggtggctcgcaatgatccataactctgttccaggggatctgttgtcttcatctgatgtcaatgagcagcaggcgcacacacaatgcacatagagacatgcactcttacatgcaaaataaaatcctatctcacaggaggatctagcgagacgctggtgccgtggcaatgccaaacactgccaggctgtttggaaactgtctcttctatccattggggaacacaggatctggctgagatgtggggcagacggaaaggatgttctagcaagttgagacctaaacccatccctcatcaaactggagacatggctgctgccctgacacccagaaaagttggccaagggctggagagatggctcagcggtcaagagcactggctgctcttccagaggtcctgagttcaattcccagcaaccacctgtaatgagatctgatgccctcttcctcttctggtgtctgaagacagtttcagtgtactcatataaatgaaaaaaattaaaaaaaaaaaaaaaaggaggctggtgagatggctcagtgggtaagagcacccaactgttcttccgaagttccagagttcaaatccccagcaaccacatggtggctcacaaccatctgtaacgagatctgacgccctcttctggagtgtctgaagacagctacagtgtacttacatataatcaataaataaatctttaaaaaaaaaaaaagaacaagccgggcgtggtggcgcacgcctgtaatcccagcactcgggaggcagaggcaggtggatctctgagttcgaggccagcctggtctacaaagtgagttccaggacagccagagctatacagagaaaccgtctcgaaaaaacaaaaaaacaacaacaacaaaaaagaacaaaaaaaaaaaataaaaaataaaaacctgaccgaattctactctcattccaagttcttactttttttgtacttttaattacattttttaaattgcatttctttctttctttctttctttctttctttctttctttctttctttctttttttgttgttgtttttttgttgttgttgttgttgttgttgttttttttttgagacagggtttcctctgtgtacccctggctgacctggaactcactctgtagaccaggctggcctcgaactcagaaatccgcctgcctcctgagtgctgggattaaaggtgtgtgccaccacgcccggctccctccgtgactcttaagtgggttccaggaatcagagttaggtcctcaggcttttgtctgacaagtgcttttacccagcgaaatgtcttagctagcaattagttacaggttttgaaaagtcaattttcggggttggcaagatggctcagtggttaagagtgccgactactcttccgaaggtcccgatttcaaatcccagcaaccatgtggtggctcacaaccatctgtaacaaaatctgatgccctcttctggagtgtctgaagacagctacagtgtacttacatataataaacaaataaatcttttttaaaaaaagtcaaattttccaattctttgcttatttttcaaaatagagtttctctgtgtagcctggatgtcctggaacaggctctgtagatctgtttggtctcaagctcagagatccaccaacctctgtttccagagtgctaggattaaagacatgcactacactgctcagcaatttttccagtctttacatacaaaaaagttacttttagctgggcagtggtggcgcatgcctttaatcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtatctgttggtccagtaatacccttctctctgggcctcctttttaacagtatcagtttgggaacacttagattggcatctgcattgtagttcctctctccagtttcccttggtctataacagcaataacccttaacaacaggcacactgtgccatggcttaagacatcttgcttcatagaaaacctgttagtcattcccacgactgattcaaacttacaaccttcagctgctgcacgccaagcatagcatcgacagctgcttctaaccgacaggacttcctttagaaagtgggaagtcggttgggcagtggtgcacaactttaatctcagtactagggaggcagaggcaggtggatttctgagtccaggtctatagagtgacttccaggactacacagaggaaaccctgtctcagggaaaagaaaaagaaagaaagtgaaaagtttgtgctcattcacttctgacagccggtgtctgagaggtgatattcagcgccatcctggctgaccacctaggcgatacgacggataaaagctgcatgaagtaactttcaagaatatgggccacgcaagagcagctacaattgcccaaagtttccaacaccctgcccacaaaacaccgattttaaaaggcttgaagttcagagcagaatcaatgcaaacctgagttcagagcgccaccgccacctagtgtaacagctgtagaagagcatacagattctgaccacaaaagaccaacgtattttgggaaagtcagtttcggtgcccatcccatgttctttccaggactcagatgtgactggtttgctgaatctgacaaacaggcccgctaaatgatcttctgcagtactgtggagctattctagggctggctgtcgtggcgcattctgtggttgccgctctgtagttggagactggaggatcaggaggtcaaggtcatcctccgctgcacagcaagtctgaggccaggtcataggactcctcctacaggactgatgaacccttgtctcaaaggcaaacgaagaggcttgagagatagccctggcttctgtgccccttgcttgttgcttcattgtcagctctcctatcacactgtcataaggtgacaaattcaaagggacccacgccagaactgccgttgtgagctaaagaaactcattgtctttatacaagtattcagctttaagtctgggacagaagtgaaatggtgggctggtacatcatttggaaataggttgtaagcactgtgagccttgattacctacgtaccatgttaggatagactagagacctccctggattcatacattcaagctcttttataataaattagggggctggaaagatggctcacaggttaagagcactggctgctcttccagaggttctgagttcaattcccagcaaccactggtggctcacgaccatcttaatctgatgcccctctctggtgtgacagcaacagtgtatttacataaaacaaataaatctttaaggaataaaaaattatacataaataaaaaataattagtattttaatttttaagtctgtttttgttttgtcttgttttgggttttttgttttgtttttttgttttttggtttttcaagatagggtttctctgtatagccctggctgtcctggaactcattctgtagaccaggctggcctcaaactcagaaatctgcctgcctctgcctcccaaggcatgtgccaccatgcctagcaattttttttttttagtaattttttttattgaagtttatgtgtacgggtgttttgcctgcatgtatgcctgtgttccacatgtatcatggaagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttaaaatgcatgggtagatgtagctggatggtgatggctcacacctttaaccccagcactcaggcagagacaatcagatctctctgagtttgaggccagcctggtctacagagtgaattccaagacatccatggctacacagaaaaaccctgtctctaaaaacaaaaaacaaaacagacaaacaaacaaccaaaaaagaaagaaagaaagaaagaaagaaagaaagaaagaaaggaaggaagaaaggaagaaagaaagaaaggaagaggttctgcttgtatatgtgtgtggtgtctttacacctgtgtaaggagctgctcagatgtggaaaacagaaagatcacatatccttctttatgactctctctgtcttcttccctttacacaggctctctctctgaacctgcagctaggtcgttaggcaggaagtcccaagaccctcctccctttaacccccacactgaccccattccccatccatgccctataatgctaggattccaaacgtataagtgaattctgggtatttgaactcaggtcctcctactggtacaacaaaaggctctcagctgctacatcatctcctcagcttcatctattgaggtcttggtctcagacaaaaagacttcgttttggaaacagggtcattacagacttcgtgaattaagatgaggtcatgaagccttgtgggaggggtggtgccatgtggactggtggtgaacatctataatcccagcatggtggaggctgaggcaggaatattgtgagtctgtggccagtctgaactaaaaagcaagatcctgtctaaggtaaaactgaccttgaacttcctgatttttttttttcttttctttccttaattttattttacctatgtgtgtgcataaggtgcctgcttggagcctgcagaggacagcagagaacattggacctcctaaagtggggctaaagacccagttgtgagcaaacatgtacatactgggaacgcagggtcctgagccagagccgccagggctcttaactctgagtcatctctgaagtccaccctgagttccttgcctctaatttcaaggactggtattggatcatagaccagtcttgccttgagctcaccaaaatccttctgcctccgccgtactgtgttcagccttgcattctttttaggtgtggatgtttcgtctgcctttttatgtgtgtgcaccaagtcaagcttggtggaggtcagagaaaagcatgggtcctctggaagtggagttacagatggtgagccacaatgtgggtgtggggacctaaacttgatcccaggtcctttgcaaaagcaacaagtgctctgaacagctgaaccaggtctccagcctccttgtagtgttttagagcaacagtttccctcacatcttaaactggccataatacacactgcaggggcgctactgcgcctgagtttaatcctaggactacaatctcccagaagtcacggaggaacttcttctggcgtgatcctagatgaccaatcgttgaggagctcagcttacccgccctggagcagcaggactacttcttccataagccattgcgggtttggctgtcattttcagatttagagagggccgggtgagcaaggactccccatttcccagcaggcagtgcggccataggaggcgcgggacttcatttcccagcaggcttcaggcggcgggcgccgcggtgccttgtgtgggatgtaagcgcggaggtgggcgcgggggaccgaagccgggactctccttgggacttgtgggaggctggtttgggtttgccttctggacaggctccagagggccgggtagagattgtagggactggaggggcggcctttgagggtccccaataggtctttgggagcagcctcatcggggctgggggtcccggaattgtaaggaactagaaggccctatatagccttggttgaagggtctcagaaaccgagccgccgcccgtgagcacaggacgaagcggctggcgaagcagaattgtggcggagggtagagccttagccgagcctgggagggggctctctcgccgagcccgaccctccctccctcggctcgcccgcaggccaccgcccgccgccatggggctgaaggccgcccagaagacgctgttccctctgcgctctatcgacgacgtggtgcgcctgtttgctgcagagctgggccgagaggagcctgacctggtgctcctgtccttggtcctgggcttcgtggagcatttcctggctgtcaaccgtgtcatccccaccaacgtgccggagctcaccttccagcccagccccgcacccgaccctcctggtggcctcacctacttcccggtggccgacctatccatcattgctgccctctatgcccgattcaccgctcagatccgcggcgctgtggacctctccctctatcctcgagagggaggtgtttctagtcgcgaactggtaaaaaaggtctcggatgtcatatggaacagcctcagccgctcctacttcaaggaccgggcccacatccagtccctcttcagcttcatcacaggttggagtcagacaggtggtcaggagagcaaatgagtgttgtcttacctcttctcatgtctgaacaatatggcttatagcccttttgagacttgtaaaccttgtgtggtggggcaggtattatttctccttcgcagttgtggaaagagaattctgaagaggggaatgtcagaatgacagggctgagactggaacctggtcatttggtgccagcttttactccccagtctttcaacagtcccagccctgccattgaatagccagagggatctggcagcccaacatatggggaaagaaggtggtagcagactggggaggtaggacaaatgggtgggtacatttgagacaattaagattatacctttgaaaatattttgaaaggaagcacgggcttgactaaggacaaagtgcttcagctctccgtgcaatgtactgagcaagcatctgaggcctcttgtgagctttgaggaaaaaagtgcagagataaatcagaacatgaagaagggaggggtgggggttcgtggggtcatgggcttgctctccttgacacagtctgatagctgtacaatagacactgggttaagtcattatgttaacagaagtacttggtgtagaaaagggaggggcagtttctggctgggtggacctgagatccagaagggttctggggttgggttattgggagggagctgctgcgagcataaaagggtgaacatagtggatagggtgtgtgatgcctggatacaggcttgagaggtgctagagggggcatggctcccttcttccaggacagagctctcatgactgccctttaccacaggcaccaaactggacagctcgggcgtggcctttgcagtggtaggggcctgccaggctctgggtctcagagatgtccatctggccctgtctgaagatcatgcttgggtggtgtttgggcccaacggggagcagacagctgaggtgacgtggcacggcaaaggcaacgaggaccgcagaggccagacagtcaatgccggtgtggctgagcgggtattgtatcttccctccattgtgcccttttccttctgtgagtctaagtgacctgagggattctgctccccaggccaggctcccctaccactgtccctctgtgtttatgtaccaaggcggggggcggaggcagggcaggtgaattgatttacgttgctgtgccctagagcaggctcaaggtggtacatcctgagatgtctgcttttctccctttccaagagctggctgtacctgaaggggtcgtacatgcgctgcgaccgtaagatggaggtggcgttcatggtgtgtgccatcaacccttccatcgatcttcacactgactctttggaactgttgcaactacagcaggtgaggagactgccccagcccaggaccttcccttccccttctgtacagagaactgatcctttccaatgcacacgaagggctttgtgagtctttactcctagcccttctgtggtgggagggcgctgtttcctctggtcacttctctagctgactggggctcccttctacttaccacgcccctctccctttggctctagaagctgctctggctgctgtatgacctcggacatctggaaaggtcagtggaaggctatgatcagataggctttgtggggatcagggaactgagtgatagcctgattttatgatctgttcccagataccccatggcgctagggaacttggcagacctggaggagctggagcctaccccgggccggccagacccactcaccctttatcacaaggtgagggcatctcagaaaacagcagctcctttctggggatggagaggagagaggtgaaaagggaagaactctgtgtgttggagggtatttcctgccttactttgtgtagggcatgtgtgtaatgagggtagttctgtgtttaagaagagccctggctcccccagctaggagtggcagggcccgattgatcccacaagccctgcagttttcagctgccctttattatcctggctatagcctgtggtagcactgtggagagatgttagcttgctcattgtggtaggaggctggttgggcttgaagtctttacacaggaccatgtggtgaagaaacctgccccaggcttgagtgtttccctgctcctccctaggccttgttttgtggggtcaccactcctactgtctgcccttgctttagcaagcaggcttgtagatccaggcctggaatggaggtgggagggagtatggaacaccaggcaaaggggccagcagtattagagacagggaggaccctttagcatcctttttctgtagcgtatcagtgatgaggcagctgggggctgcctccctgaggttcctctgctccatcctccagggaattgcctcagctaagacctactaccaggatgaacacatctacccctacatgtacctggctggctaccactgtcgcaaccgaaatgtgcgcgaagccctgcaggcctgggccgacactgccactgttatccaagagtgaggattcccctgccagggttccagcctgccctttgtctctatgactttccaatcggtcatccagttgtgagaccttgtctcagctctgtcctctctgatcagcccctatacagtcaaggctaccattacttgggaactgagaacccctggttagctgctgctcctcctcatgcctttctgtcactcctctctgcccagtttttcctgctttatagtcagttgtgttatccatggtgcttctgtctctgcccaacttctagtccagtccccacatcccactccataaccttgcctttgactagcatgatcacatctgggtgaacaaggactccagcctcgcacccagtcagtgggatgtcccattgtgggacaactgtcaactgaatcctgtgtgttctcacagctacaactactgccgggaggatgaggagatctacaaggaattctttgaagtggccaatgacgtcatccccaacctgctgaaggaggcggccagcctgctagaaacaggcgaagagcggactggggagcaagcccaggtgaagggctggcctccattggcgcaccctccgtccggggcacattgatgagaccgcaaggacaggattgggaattctcttttgctggagctgatccctgggcgagggtttgaaaggattttagggggttttagagctaaagcttttagagaaatgggttgatggtccatctctctgatggtcaggttctaacctgggctaggctgtaggtgaggaaaggcacgcccctcctcccctcactcgcactaagggttggttttataaaaggaaggaggtcctgcctgcatttgccttccctgaaactgaggctttgcccaggtggagggagcctggcctgcacgctctgtgacctctgctgtaccttccctcttatccagggcacccagggccaaggttctgctctccaggacccagaatgctttgcccacctgctgcgattttatgatggcatctgcaaatgggaggagggtagccccacaccagtactgcacgtaggctgggcaactttccttgtgcagtccctaggccgcttcgagggacaggtgagaggggcctatccagggcatgggaactacaggtggtgacagtagttgtaggggagtgaggttacattgcatgtgtatgagtacagatgagaggacactgctagaggggtggccaggagctgagcctagaggtcccacggatgatcctcagcctttcacttggcttgcgcttttgctcaggtgcggcagaaggtgcacatagttagccgggaagcagaggcggccgaggctgaagaaccatggggggatgaagcccgagaaggccgtcggcgtggtccccgaagagagtccaagcctgaggagccaccaccacccaagaagcctgcattggacaagggcccgggctcaggacaaagtgcagggtcgggaccacctaggaaaacgtcagggactgtcccaggtactacccgcggtggccaggaagtcggcaatgctgctcaggctccagcacctgcagcatcgccacccccagagggcccagtgctcactttccagagtgagaagatgaaaggcatgaaggagctactggtggccaccaagatcaactcgagcgccatcaagctgcaactcacggcacagtcgcaagtgcagatgaagaaacagaaagtgtccacacccagcgactacacactctctttcctaaagcggcagcgcaagggcctctgaactctgattctgtggcaaggccccaggcctgccctcactcccagcaggcttcaccctcatcctctaattcaagcctagactccgccctcagtcctaggggacccagagctgtcctgcagtgactaggagccttcatttagcccctcttcaggccccagagccctggctcagttcttagaatgtaggtgtcatccccaccagccggccaattggaacctcattgtaggtccaatcccccgaaattcagtggaccatgacaggagcccaagtcacgcctgaacagtagggcattcctcccacttgggggctagattgaccttagccccagagcacagttgctacctggaaaccaaggaccattcagtccctaggggtagatttccgcactttatagagttccatcctttgggaatccaaatcccttaccccaaagaacttacatattgctgcccgaatttggaaatcttcctcgtctccctagcccctgagtacaggacatgaagctccgactctaatctgtgaatactgagcctcgcccccttcctgaccaaactggcgcaagaacagagcaggacctcttccagccctctgggaacctccctgaggtcccaggaggaaatctgcacggggtgggggagggccagcctcttcctgttttgtacatagatttatttttcagttccaagaaagataaatgcattttgttaagaaaaaagagatgtatgtatgtgtttcatctgagaaatcggggatggggcgggagtggatatctgcttttgctgttttaggattttgaactttatgctctgcacctgtagcgcggcgagaattgggaggggtacctaagctccgcccctgcttctgggacttccccgcgcaaccagggcgcctcctctcggccaggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcccgggtggggcctctgtgctcctgggtaggcgggcgggtgagctggcgggggcagagagttaacattttctagacccccccgtgaagccgaccccaggagaaactaaggtttggcacctgctcggcaaggagagaaatactctatgctcattttgcacatagggacagagtctaggctattcgttccccccccccccccataatgccttgtgctccccaggggacgacatcagctctcttcagcaggaaatcaccatccttcgtgaatgccgccaccccaatgtcgtggcctacatcggcagctacctcaggtgaggttgtttatcctcttaccctcttgtgccttgcattgtgccaccccagctctctgtctccccaggaatgaccgattgtggatctgtatggagttctgtggaggagggtcactgcaggagatttaccacggtgagatccagactccatggacatggcctttcccgatcccaacataggggtaggaaggcatccttctggctgcacttggactcctcttagcttctgactggctgtgtgaccttgagagaaatactatcctcctctgggctcagtttcccagcctgagtctggaagaaatttggctaacatcactttgctgtagtggtgcctgctgctccccactctgcagggtgggtagggagggtcagcatatccctcaggctctttctcttcagcccccattctgtatgtttcagccactgggcccctggaagaacggcagattgcctatgtttgccgggaggcactgaaggtatggggctcataggcagcacccattttggaatcctcaggagtgtgggcccaacacatctggccagtgggagattgggaccttgggatgggctgactcagggggtggaggtcctagcaggagggggccccccagttctgttgccggaagcagcctatttccctcttggctcattcacttcctgcttggggagaggggtggaggaagcagcttgggtggggggcccagtcctgaggaggggctcagaagagataattagtgcaaagcagctgtcctcagagacttctgtttgtctccaggggctccaccacctgcattctcaggggaaaattcaccgagacattaaggtagggggtcagccaagggcatggttcaaatgaggaggaagccgccaggcacctgacacaatcctttctgtgtgttcccccaacagggtgccaaccttctgctcactctgcagggtgatgtcaagctgggtcagtacccgggggacactcagggaccatagaactgagtgctggagatcccagtcactttactgtttgagcctcagtgtccccatttagaagatgtagcattattgcctgccagtagttggctgtatgagattggctggggagggatctgacatggcattgtttttagagatggaagggtggggacccctctcagaagaggggcctggcctggcttggtacagttgtggctggacccaagccctacctggtatagcctgggccctggggtgggaggtaagtgaggccctgggtctggtaagagttcttttctgcagcggactttggggtgtcaggcgagctgacagcatctgtggccaaaagacgttctttcattggcactccatactggtgagatggtgccctggcaataggggtggtgggcacaaggagggcatctggccatctcgtatgtgaccctgattctaggatggcaccagaggttgccgctgtggaacgcaagggtggctacaatgagctgtgtgacgtctgggccctgggcatcactgccattgagttgggcgagctgcaaccgccactgttccacctgcaccccatgaggtcagccttgcacttgccccttgcctgctccttgccctgctgacctttgacccatgcgttcacatcctccctagggccttgatgctcatgtcgaaaagcagcttccagccacccaagctaagagataagacgcgttggtgaggcctcgcccacagctgagataccttttttccagcctagtcccgtggggtagaggcttttgcccaagattgaccttggtttccactgtaggcagtgggcagggagggaaggaagggctggtggcttgtgatggagggtcttctatggcacaacgacagcactgcccaagttgctcttcctttggcagccggcgggggcagccgacaggatgcttctttgcagagcttaacttgggtttgggtgggtgggtgggtggggctttttggacccaccaggacccagaatttccaccacttcctcaagctggccctaaccaagaaccccaagaagaggcctacagcagagaggcttctgcaggtgggaggcagggggtgactggggacttgagactcaaagacaaggcctggaggacagggagcgacttcatcaccccttgctcctccagcacccattcacgacccagcatctccctccggccctcctcacccagctcctcgacaaggccagtgacccccacctgggaaccctctcccctgaagacagtgagctggaggtaaaggggggctgggagccaggtcagcctggcctggtgggaaggtggtatagatgagaattgttggcagagccgctctctagtcaagcccactgcacatcctcgggcccaagccagccatgactgtgactaagcagtcctcctttctgtgtggcctttggcaagtgtcttgatgtttctgtgccagttttcccatctgtggaaaggaaggctgttgtatttcatagtaatcttagagggctgtcaggaaaacaggacacctgatgggtgaactcctggcaagaggtgagtgatgggtgcaggtctgtcgtttgtgttctttcttagacccatgacatgtttccagataccatccattcccgcagccatcatggtcctgctgagaggaccccctccgagatccagtgtaggtcttctgatagggttaaatgcacccgtggatctggtgttatttggggggtccattctgagacttggacccccttttaatctaatacatcggttccctagttcaccaagtgaaattcggtgctcctcgccggaaggagacagatcctctcaatgaaccggtgaggcactggctatgtgtgtgtagagggggttcggggaagggaggcttgggtgtgcagatgcaggtggaatgtcccaaatcacagccagtctgaagcaggggttgcctgtgtcatctggggactccccctgggcttgcgtcacctggggtcctgggctagaggatcccctccgccattttcctttagacagtactggaatgtggaagactggccacacccttttgaaacctaggtttcacaggactaagggctccccacttggccatattcctcagtgtgcctgtcacaggaccacatcaccccgtctcctcttactgtccgtcactacttcctttctccgctccacagcacccatccctttgccctgttggctgctgtctccctccagctccctctcttgccttttctctcttatttttgttgttttgtctttcacagtctttgcctgttgcagaatatttccatctgggttgctctgttctctcccgcgctctctttgctgatgtgagcaggatattcttacttgctctcactgggcttgaacttctcctgtagtataggcctgccttgaattccaggtccttcctaactctccctgtccatctcctgaaacccctctcttttgtgtctcacctctcttcggtatctctgcctcggtctcctccagtgggaggaggagtggacgctcctgggaaaagaggaactgagtgggtgagtgagcgaggttggggaagcggaggggcaggctgggtcttatggaagactgaccactgaccccttcctctggcccaggagcctgctgcagtcagtccaggaggccctggaggaaaggtgagggacccacacttggggtgaagaggggcctccaggcctgggggacagtcccctctcacaccccatcatgccatgtgctgtgtccctgtaggagcctgactatccggccagccttagaactccaggtgtggattggaagagggtagagctgggaagtcacccgtgagcctagagtgctgtggggcagaagtgcatcatgggacacctgctgatgaccaggctgctcctgatcctcttgacaggagctggactccccggatgatgccatcggaaccatcaaacgggctccatttttggggctgccccacactgagtcaacatctggtgacaatgcccagtcctgctccccaggtgaggcccagggctggcaggccacagggaattctggggtagggctagggcttggagtcactatggtctgtgcatacaggtaccctgtcagcacctccagctggccctggcagccccgcattgctgcctaccgcctgggctactctgaagcaacaggaggatcgtgaggtgagaggacagcagaagggtgggagtggggctgcagggtgccacctaggccctgactccttccctcccttgcccacagcgatcatcctgccatgggcttcctcccacccccaaggtgcacgtaagtggtcactggctgtccctagggcctgctgtcctggcactgccactgggtccctcgccagctaatcacttcctccccagatgggtgcctgcttctccaaggtcttcaatggctgccccctgcagatccatgctgctgtcacttgggttcaccctgtgactcgaggtagatcggggtagagcagaagcaataacttaggacacccttagcttgggctaggaacatgtggcagcctctgaccttatgcccatgcctgcagaccagttcctggtggtaggggctgaggagggcatctataccctcaacctgcacgaactgcacgaggacacaatggagaaggtgaggcttgttggctgttggggacagaggcacaggatgctggctgctgaccacctgtccactgtctctggtcccagctcatctcccagcgctgctcctggctctactgtgtgaacaatgtgttgctgtcgctctcaggtaggaggcggcgggtgcagaggcagccagggcagcattctccaaacttcctctgagccctatgtggtcttcctgttccgcttcagggaaatccacacatatctgggcgcatgacctcccgggcctgtttgagcagcgaaggctgcagcaccaggcacccctctccatccctaccaaccgcatcactcagcgcatcatccccaggtcagcaggtatggggtacaaaggaggtcagaatagtgcctgtgggatgggactccacccactcctgagactgccagggtcttagctaatcacataggcacttcccgtctctgaagctgtttcctcctggtcggtagttggtggccttccctcctgtccacctggcttgttgaaaagcacaaaaggatgtgaacgtgaatgtgttctgtggacagcatagatggtgggcttcatcctgcagttcagcgggccggggctgggcctggcaatgtgtccagagaaaccctgctttagagaaacgaaggacgtttgtggcagactgcttggttcagggtaggggcgggggtacacctggagagagtgctctgaaagccaggaggcagagacagaattagagggtgcattccaaggttctaggggaggggagagtgaataccggtgagaccaaacagcaaggcctggagagcctgtgggctttagcctgagggtggagagccagccgcacaggtggctgaacccttcctctgttgcctgggacttggtctgtgtctggtgtacagcggtactctcagcgtttcagaggatcttactgtgtactggtcagtgtgctcccttccattgatggttcagctcactgtctaagagccaggctggtgtggtggctcgtgctggacatcccagcactagggaggatgaggcaggagaatctcaagtttgaggccagcctgggctacatagaagatacttcgtctcaaaaacaaaatccagctgggtatggtgtttcatgcctgtaatctcagtacatggcaggtaggggcaggagaataaggaattcatggtcatccttgcctattgagtttgaggccagcctgggctatgtgagttcctgtctctgaaaacagaatatactggccatagcaagagctacagtaggactggtatttggggagccgaatggtcaggtctggagagcaagcagagggcccagtgcaggagctaagtagcccagcactgacacgcggtgctaggctgcagcaatttagcatgtaattatgcagctggtgtgtgtgtgtgtgtgtgtgtgtaaaggaggtagatggtagacctagaaaaatgaggctctttggcagtgatggctcagagcaaacaccatggagaagagcgggctgaggaagaagactttaaatggctgttttgaaagccttcagtgagaaagtgctatttgagccaagacggaggacagggctgaggctgtagggtactgatgaggtgaggtgaggtgaggtgaggtgaggtgaggtgaggtgaggtgaggtgaggtgaggtgaggtgaggtggcttgcctagcatgtatgaggctctgggtttagtccccagcactgtaggaataactaggacttagaggagtgtggggctggccagattgctcagtggtgaaaagagccagtcagttgctgcaggctattcgctggcttccacgtgtgcaccttgatatgtatacacacttgtgtgcaaagaaaaaaattgtacggaaggcagaggcaggcggatttctaagttcggggcctgcctggtctacagagtgagtttcagcacagccagggctacacagagaaaccctgtctcgaaaaacaaaaaaaacaaaaaacaaaaaaaaaaccatgtaaaaattactttatgtgcattggtgtgagggtctaggtcagatcctctgggactggagtgacagacagttttgagatgacatgtgggcgctgggaattgaatccaggtcctctggaagggcagccagtgctcttatccgctaagcctttttccagccccaataaatgtaattttccaaagaagctagaaatctgtagggaaggctcaggagaagagacgacaggcgaacacaagggtccttaggacagacgcaagtctgcctcctcagagaggccgctggtgaggtgtgattggcactgaggtcttcatgggctctcttctgcgggtggccagcagcgggggtgcgggctgcagcgggcgtgcgggctgcagtaagagtgaaggaagtgagagatggtctggttctgctgttttacaagtggagccagcagggtttcctggtgatgattgagagggaaagggggtgggggctgagggcgaagcttttgacctaggttgaaggaaggatggagctgtcaccagctgtgagtgacggaggagtctgctctgaaattggttttgccacattaagtaaattaaatgcctgtcatctcagcattcaagcagttgaggctggaggattactggaagtttgatgctatagtatgagacccatctgaaaagtcacatttccaaagatgccgattctctgagtgggaccttcctagtccagctgagagagctggagcgcccagaagcgtgggccaggaagcggctctaacattagtgtgacctggttcatggggccagcagcactggggagaatggagaacagccttatctacagcgctcacaccaagcctgtattggtgccctgtgccccctgggcttcctgagcctctgttctgaccctttcggcagagggcttgccagactttgaacatgaagaagaggaaatcatggagtttttcttttagaggaaacaccagatgcaaaagtatcagcaccagactgcccgaggcctagccagatgctagctggggatagagtgggaggaagagggagggcagagggcagcaccggaggcggggcagacaccggcttcctcccgggggctcattctggcaggggcacaaacagaacctgagtcgctgaaaggaggagattgcagtgttaacagcccagttcctcagatgaagaaagaggctcgagtggtcagtcccctgagggcatgggggactccccataagacagccattcacctgcctcacagggtcagagccccacctaggtgcagaaggcaggccatttgctatttgaagtctttccagctgccagggcctgtttgtccgtctttgaaagggactgaacatactcaagctgggacctgcctcggcttctggtctccacactgtctgccagcgagcagacaggtcgagaggtcgggtgacttgttaaaactacacagaacctagagtggtggcttttaccaggaaccctagcacatgggagactatggcaggagactatggactatgctacaaaccccaggctaacctgggctacggaggaagacttctgtgtcaaaactacatgagggcaggtacagcagcttacaatctcagggacccacgtgatggaagggggaccagctccgacaagctgtcttctgaatctttacatgtgtgacatgatgtgtatcttcgcagtcaaccagtcggtgtaaagaaatgctttatttacaattgttttaaatttagtatcattaggaggaagaggagtagttttgtttgtttgttcaagacaaggtctctctgtctagccctggctgtcctagagctcactatgtagaccaggctgaccttaaactcacagagattctcctgactatgccacccaagtgctggattaaaggcattattgggggggggcgggtaataccccatctactacagtatacaagtggaggtcagaagacaccgaccgtacaggagtaattttcctgggtatagcacacggagcccaggaattgagttcaggttgtaagtctgacggtagtagatagctgtacctaaggagcgatccagtcagcccaaggaaaggtaaaaaagaataaagaaaaaaggtgtgtggtggtgctggatctggtggctcaggcttcgaaggtcagcgcctgggaggattcagcatgatcagaagtttgagagcagcttggatgacatgaaccttgcttttctccaaaaacttaaacacaaaagtggactggaaggatgactcagtggttaggagccatccctcctcccttcctactcttccagaggccctggattcagtttccatcgtccacatgataactcacagacacctttaacagggaatctggtgcagtctcacctttgcaaacataaaattagtgcacattacatacatgcatacacatacatgcatgcatgcatgcaagcaaacattcacatacacaaaaataaactttaaaaagtgaaacccaaaacaaaagaacaacctccccccagcccccataagtgcccaggctgaggagcccaagatgcccacagagcctcagttccttacagctcttgcaggccggcacactgctgagcctccctgagtctagggtc

SEQ ID NO: 1526 - DNA, 2973 bp, Mus musculus
ggcggcgggcgccgcggtgccttgtgtgggatgtaagcgcggaggtgggcgcgggggaccgaagccgggactctccttgggacttgtgggaggctggtttgggtttgccttctggacaggctccagagggccgggtagagattgtagggactggaggggcggcctttgagggtccccaataggtctttgggagcagcctcatcggggctgggggtcccggaattgtaaggaactagaaggccctatatagccttggttgaagggtctcagaaaccgagccgccgcccgtgagcacaggacgaagcggctggcgaagcagaattgtggcggagggtagagccttagccgagcctgggagggggctctctcgccgagcccgaccctccctccctcggctcgcccgcaggccaccgcccgccgccatggggctgaaggccgcccagaagacgctgttccctctgcgctctatcgacgacgtggtgcgcctgtttgctgcagagctgggccgagaggagcctgacctggtgctcctgtccttggtcctgggcttcgtggagcatttcctggctgtcaaccgtgtcatccccaccaacgtgccggagctcaccttccagcccagccccgcacccgaccctcctggtggcctcacctacttcccggtggccgacctatccatcattgctgccctctatgcccgattcaccgctcagatccgcggcgctgtggacctctccctctatcctcgagagggaggtgtttctagtcgcgaactggtaaaaaaggtctcggatgtcatatggaacagcctcagccgctcctacttcaaggaccgggcccacatccagtccctcttcagcttcatcacaggcaccaaactggacagctcgggcgtggcctttgcagtggtaggggcctgccaggctctgggtctcagagatgtccatctggccctgtctgaagatcatgcttgggtggtgtttgggcccaacggggagcagacagctgaggtgacgtggcacggcaaaggcaacgaggaccgcagaggccagacagtcaatgccggtgtggctgagcggagctggctgtacctgaaggggtcgtacatgcgctgcgaccgtaagatggaggtggcgttcatggtgtgtgccatcaacccttccatcgatcttcacactgactctttggaactgttgcaactacagcagaagctgctctggctgctgtatgacctcggacatctggaaagataccccatggcgctagggaacttggcagacctggaggagctggagcctaccccgggccggccagacccactcaccctttatcacaagggaattgcctcagctaagacctactaccaggatgaacacatctacccctacatgtacctggctggctaccactgtcgcaaccgaaatgtgcgcgaagccctgcaggcctgggccgacactgccactgttatccaagactacaactactgccgggaggatgaggagatctacaaggaattctttgaagtggccaatgacgtcatccccaacctgctgaaggaggcggccagcctgctagaaacaggcgaagagcggactggggagcaagcccagggcacccagggccaaggttctgctctccaggacccagaatgctttgcccacctgctgcgattttatgatggcatctgcaaatgggaggagggtagccccacaccagtactgcacgtaggctgggcaactttccttgtgcagtccctaggccgcttcgagggacaggtgcggcagaaggtgcacatagttagccgggaagcagaggcggccgaggctgaagaaccatggggggatgaagcccgagaaggccgtcggcgtggtccccgaagagagtccaagcctgaggagccaccaccacccaagaagcctgcattggacaagggcccgggctcaggacaaagtgcagggtcgggaccacctaggaaaacgtcagggactgtcccaggtactacccgcggtggccaggaagtcggcaatgctgctcaggctccagcacctgcagcatcgccacccccagagggcccagtgctcactttccagagtgagaagatgaaaggcatgaaggagctactggtggccaccaagatcaactcgagcgccatcaagctgcaactcacggcacagtcgcaagtgcagatgaagaaacagaaagtgtccacacccagcgactacacactctctttcctaaagcggcagcgcaagggcctctgaactctgattctgtggcaaggccccaggcctgccctcactcccagcaggcttcaccctcatcctctaattcaagcctagactccgccctcagtcctaggggacccagagctgtcctgcagtgactaggagccttcatttagcccctcttcaggccccagagccctggctcagttcttagaatgtaggtgtcatccccaccagccggccaattggaacctcattgtaggtccaatcccccgaaattcagtggaccatgacaggagcccaagtcacgcctgaacagtagggcattcctcccacttgggggctagattgaccttagccccagagcacagttgctacctggaaaccaaggaccattcagtccctaggggtagatttccgcactttatagagttccatcctttgggaatccaaatcccttaccccaaagaacttacatattgctgcccgaatttggaaatcttcctcgtctccctagcccctgagtacaggacatgaagctccgactctaatctgtgaatactgagcctcgcccccttcctgaccaaactggcgcaagaacagagcaggacctcttccagccctctgggaacctccctgaggtcccaggaggaaatctgcacggggtgggggagggccagcctcttcctgttttgtacatagatttatttttcagttccaagaaagataaatgcattttgttaagaaaaaa

SEQ ID NO: 1527 - protein, 665 aa, Mus musculus
RVSETEPPPVSTGRSGWRSRIVAEGRALAEPGRGLSRRARPSLPRLARRPPPAAMGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYQDEHIYPYMYLAGYHCRNRNVREALQAWADTATVIQDYNYCREDEEIYKEFFEVANDVIPNLLKEAASLLETGEERTGEQAQGTQGQGSALQDPECFAHLLRFYDGICKWEEGSPTPVLHVGWATFLVQSLGRFEGQVRQKVHIVSREAEAAEAEEPWGDEAREGRRRGPRRESKPEEPPPPKKPALDKGPGSGQSAGSGPPRKTSGTVPGTTRGGQEVGNAAQAPAPAASPPPEGPVLTFQSEKMKGMKELLVATKINSSAIKLQLTAQSQVQMKKQKVSTPSDYTLSFLKRQRKGL

SEQ ID NO: 1528 - DNA, 27204 bp, Homo sapiens
cccggctatttttttgtatttttagtagagatggggtttcaccgtgttagcccgaatggtctggatatcctgacctcgtgatccgcccgcctcggcctcccaaagtgctgggattacaggcgtgagccaccgcacccggcctatgttaaatttcaaacctgcagaaagatggaaagaatatgaactccggccaggcactggctcacgcctgtaatcccagcacttcgggaggctgaggcaggcagatcacctgaggctgggagttcaacatcggcctggccaacattgtgaaacctcatctctgctaaaaatacaaaaactagctgagcatggtggtgcgcacctgtaatcccagctactcaggaagctgaggcaggataatcacttgaaccagggaggtggaggctgcagtgagctgagatcgtgccactgcactccagcctgggcgacagagcaagaatccatctctaaataaataaataaataaaaatttaaaaaggcctgacgtggtggcttacgcctgtaatcctagcactttgggaggctgagatgggtggatcacctgaggtcaggagttcaagactagcctagccagcatggtgaaaccctgtctctactaaaaacataaaaaaaaaattagccagggcgggtggcgggcgcctgtaatcccagctacttgggaggctgagacaggggaatcacttgaacctgggaggcggaagttgcagtgagctgaaatcccactactgcactccagtctgggcaacagagtgagactccatcttaaaaaaaaaaaaaaaaaaggccgggtgcggtggctcacgcctgtaatcccagcactttgggaggccgaggcgggtgaatcacgaggtcaggagatggagaccatcctggctaacacagtgaaaccccatctctactaaaaatacaaaaaattaactgggcgtggtggcgggcacctgtagtcccagctactcgggaggctgaggcaggggaatggcgtgaacctgggaggtggagcctgcagtgagccgagatcgtgcgactgcactccagcctgggcgatagagtgagactccatctcaaaaaaaaaaaaaaaaaaaaaaaaaaaaaaactccatatactcttcccctagatccaccaataaacattttgctgcttctgcttcctatctatatagcatgtattttgctaaaccattgaaagtaagttgcagacatcttgaatctcacatctaaatatttcagcaattatgtcttaagaataagaagccaggcctggtacagtgactcacacctgtaatcacaacactttgagaggctgaggcaggaggattgcttgagcccagagttcgagaccagcctaggcaatatagcgagactctgtctctacaaaaagtaaaaaattggccatgacaattaatttatgttgtttaagtcacctactttgtggtacagttgtgtcaaaaatgttatttggcaaggtaccgtagctcacgcctgtaatctcagcgctttgggaggccaaggtgggaggatcacttaaggccaggaatttgagatcagcctgcacaacatggcacgaccctgttgcctaacatggccctgtcacccaggctggagtgcagtggtgcaatcatagttcattgtggtcttgaattactgggctcaagtgatcctcctgcctcagcctcccaactagctgggattacaggcccatgcctggtggatttttttcttttttttttttttttgtagagacaaggtcttattatgttgcccaggttggtcttgaactcctgacctcaagtgactctcctcaagagcctcggcctcccaaaagtgctgggactacaggagtgggccattgcacctgatctagattaaactttgtttttatttatttatttttccattgccccctagattaaactttttaagtcaagaatattacctagctgggcacggtggctcacgcctgtaatcccagcactttgggaggctaaggcgggcagatcacaaggtcaggaaattgagaccattctggccaacatggtgaaacccaatctctactaaaaatacaaaaattagctgggcatggtggcacgtgcctgtagtcccagctactcgggaggctgagtcaggagaatcgcttgaacccaggaggcggagcttgcagtgagccgagatcgtgccatttcactccagcctggcgaacagagtgagactctatctcaaaaaaaaaacaaaaaacaaaacaaaaaaaaagaatatacctagctggtgttattttaaattaattttaattacaacaatacacaaaattttttggaaaagaaattaggggccgaattcccctttgactccctcccctccacccatgagatgactttctcttagcttgttcaatgcatacccatattggcgatgtccagagggaccaccctcccagggcctccttgtctttagcagcagaaatcccactggagcttcagacccttccatcccctgtcctcacactcacagctgggccccccaacccccagccaacctcgagaccctcagaagtggtcttgccctttattgctgtgtgtcatttcaccacaggaggctcagatgttccagggacaactccggccatccccttttctgactccatctccacccctccccagctcctggcagatgtcctctgttccctctgggggtgatggtccatcgttagcaaaatctcctggtcttcactaccttctccagacagttcctatccctcctgctctagcagaaaccttggactcctgaggtcaccaccactcctgtctcccccgcaaccccccgcaggctctcctgcacccctcctgcgatgggcctggaagagttggggtaggcatcctccataatccctcatcacttatagacattctgctccctcctcttttgctttcctttttattttttttctgcccaagatagtacttcacctcctcctttcaaacactcaggtttgaactccagttatcagctgatgccacccacttggtttctgacatctcccaacccatgacggcccagttctagatcattttagttcctggcttgccatcactccaacctacttctgtcttaattcttagacatgttgatatctatgctgggcctcccagttccttgaagccctcttcccactggatcttgtcgtctatcctacctcagccactcactcccacaatcatcctggagagccgcactgtcctatacaggagcccagccacacatggccacggagcactgcatctctcccgaattgagatatgctgtgagtgcaaaacacatactagatttcaaacagtctgtgtgaaagaattgtaaattatcattaataatttttattattttatttatttatatattttgagatggggtctggctctgtcacctaggctggagtgcagtggcatgatcttggctcactgcaacctccgcctcctgggttcaagcgattctcatgcctcagcctcccgagtagctgggattacaggcgcatgccaccacacctggctaatttttttgtatttttagtagagatggggtttcaccatgttggtgaggctggtcttgaactcctgacctcaggtgatccaccagcctcaccctcccaaagtgttgtgattacaggcatgagccactgcgcccgacaataattttttttttttagatggagtctggctctgtagcccaggctggagtgtagtggcgtgatctcggctcactgcaagctccacctcccgggtttaagcaattcttctgcctcagcctcctgagtagctgggactacaggagcccaccaccacacccagctaattttttatatttttagtagagatggggtttcaccatgctagccaggatggtctcgatctcctgacctcgtgatccgcccacctcggcctcccaaagtgctgggattacaggcatgagccactgtgcctgccccaataatttttatatttattacaaattgaaatcgcattttcagatatattgggttaaacaagatataggattaaaattaattccacctctgtcttcttttatttttatttttatctttttgaagacagggtctcactctgttgcccaggcttcagtgcagtggcgtgatcatggctcactgcatcactgcagcctccagctcctgggctcaagtggtcctccagtctcagcctcctgacctgagtaatcgggaccacaggtgtgagcacttggctaacttttggggttgttagagacagggtttcactatattgcccagcctggtcttgaactccaggactcaaacgatcctcttgcctcagcttcccaaagtgctgggattacaggcatgagccactgtgcccggcttcttacttttaaaaatgtagctacttaaattagctgggcatggtggcacacacctataatcccagctactcaggaggctgaggcagaattgcttgaacccaggaggcggaggttgtagtgagccaagatcgtgccaatgcactccagcctgggcgacagagtgagactgtgtctcaaaaaaaaaaaaaagtagctgctagaaatgccaaaatcgtattgtggctcatgttatatttctgttgaaagctctgctctagatcttttctttgccaataatgacaaccccctccccataatttcaatctcaagcatcctactctctctttttttttttttttttttgagacagagtctcgttctgtcacccaggctggagtgcagtggaacgatctcagctcactgcaacctccgcctcccgggttcaagcgattctcctgcctcagcttcccgagtagctgggattacaggcgcccaccaccacccccggctaatttttcaaccgcctcagttaagtgctgggattacaggtgtgagccactgcccctggccaagcatcctactctctaaccaacaccactctctttccagcccactctagcaccccaactcgaattgacggttgaccccacagaaacctgcaatccattgatattactacacatttgctgtctgtcacccttctcttgtccttacatgcctcctcacacagcctacattccaggtcaatcattaatcatgactgctttggccaggtgcaatggctcatgcctgtaatcccaacactttgggaggccgaggcagatggatcacctgaagtcaggagtttgagaccaccctggccaacatggcaaagccctgtctctactaaaaatacaaaaattagccgggcatggtggcgggcacctgtaattccagatactcgggaggctgaggcaggagaatcacatgaatccgggaggtggaggttgcagtgagctgagattgtgccactgcactgcagcctgggagacagagggagactccatctcaaaaaaaataaaaataaaaataaaaaaacaatagaaaaataaaaacaaacaaaaaccctactgctttgcatgcatgcgtgtattctttagcaaatatttgttgaacacctattatgtgccagacactattctaggcccaggggacacatcagtgaacacggcagacacatttcctgtcctgtagagcttatcttctggtggtaggggacaaacaataaataaatcaggccaggcatggtgactcattcctgtaatcccagcacttcggaggctgaagtggaaggaccaccttgagcccaggaggtcaaagctgcagtgagccatggttgcactactgcacaccagcctgggcaacagagcgagacctgtctcaaaacagagaaacaaagtggtcatatcatatgttagaatagtggttctcaagctggggctattttggcatcccaggggacatttggcaacatctggagacatctttagttgtccccactgcgggagctgaactggtggcatccagtgggtagaaaccacagatgctgctcgtcatcctacaatgcacaggacagccccagtcacagaattacccgacctcaagcgtcaacagtgcctccttccagagcccgtctagaaggtgttaatgctaacaaagcaaacaaacaaacaacaacaacaacaacaaaaaaaacgtagagcgggctggccgcggtggctcatgcctgtaatcccagcacttagggaggctgaagtgggcggatcacctgaggtcaggagtttgagaccagcctggccaacatggcaaaaccccatctctccaaaaaaacacaaaaattagccaggtgtggtggcgtgcacctgaagtgcacctgaagaggccgaggcaggagaattgcttgaacctgggaggcagaggttgcggtgagccaaggtcgagccactgcactccagcctgtgtgacagggtgagactccgtttcagaaaaacaaaacaaaaagaaaaaaaaaatataaagcagggttgagggatggatagaggaatttcgagtggagggtgtgatttgaagtagaatggtcaggtctgtgtcagcctttttgaggtgacgtttgagcaatattgtgaaggtggggaacccggtagacatctggagagaagatggtaacccactgggcttcctatttcactgagaaaatctaattacccaccacatatgcccaggtagtaggccttctttccagtccttgcgaataaactgcctgtgctcctagccaaggccaaacctgccactcaagaatgcattcccactctctgtccaaggccatcgctcccgcaattctcttattaaccagcaataatctatttgacccccctcttctctagctatttaatgcactctcattttcctccttccctttgctgcaaagatcccaaaagacttctgtattatcactgtctccaatttctttcctcccattggtcctgagcccaagcctacaagacttttgctcccaaagagccttttattttttaatttttttttttttatttgagacagagtctcgctctgtcacccaggctggagtgcagtggcgcgatcttggctcactccaacctccacttcccgggttcaagcgattctcctgcctcagcctcctgaatagctgggattacaggcacgtgccaccacacctggctaatttttgtatttttagtagagacggggttttgccatgttggccaggctggtctcaaactcctgacctcaagtgatccgcccacctcggcttcccaaagtgctgggattacaggcgtgagccaccgtgcccagtctggcttttgtttttgttgttgttgtttttagggacaggatctcactgtgttactcaggctggaatacagtggtgcgatcacagctcactgcagcctcgaactcctgcctgagcttcctgagtagctgggactacatggtgcacaccactgtgcctggctaatttaaaataattttttttttttttgtagaggcagggtcttgctttgttgctcaggctggtctggaacttttggcctcaagcagtcttcctgccttggcatgtcaaagccctgggattacaggtgtgagccactgagcttagctttgactgtttttgaaacacaaagtggctaaagcctgtaatgccaccacttctggaaggctgaggtaggtagatcacctaaggccaggtgttcaagaccagcctggccaacatggtgaaaccccatctctactaaaaatacaaaaactagccgtgtgtggtggcgggtgcctgtaatcccagctactcgggaggctgagacaagagaatcacttaaacctgggaggcagaggttgcagtgagccaagatcgtgccattgctctccagcctgggcgacagagcgactctgtctcaaaaataaataaataaataaataaattaattaattaattaaattaaattaaactcaaagtcgcatactcccgagttgcctcagttctgggccagcttggaaggctggttaccctgtttactagtttttctactgatgtcctttttctgttccaggatttgatccagaacaccacattgcatttagttgttctgtctccttggtctctcatctgcaatgatttgtgggtctttccttatctttcatgaccttggctcttttgatttcttttgttttttgtttctgaggcggggtctcactgtgttgcccacgctggagtgcactggcgtgacagctcactgcagtcttgacctcctgggctcacataatcctcctgcctcagccttctgagtagctgggactacaggtgagcaccaccacacctggtcaattttttgtttttgtagagtccgggtctccctatgttgcccgggctggtcttgaactcctggcctcaagcaatcctcctgcttcagcttcccaaagtgttgtaattacaggcatgagcctggcatgaacttgacactattgagatatactggtcaggtattttgtggaatgtccctcaactctgttttgccagatgttttctcatgattagaggagagttataaattttgaggaaaatccagagaggtgaagaggtgaagtagggcagaaatttaatctgttttatttactgctatataccgagtgtctggaacttggcccatggtaagtaccaaaaatctgttttttttgaatgaataagcaaataaatgagtgaccgtggaaatttagtattatttcaaagtttcaaagcgttgttgatacaggccaggcacagtggctcacacctgtaatcccagcacttttggaggccgaggtaggaggatcacttgaggtcaggagttcgagaccagcctgaccaacatggtgacacccctgtctctactaagtaaaatacaaaaattagccaagtgtggtggcaggcacctgtaatcccggctacttgggaagctgaggcagaagaatcacttgaacctgggaggcagaggttgcagtgagccgagatcaccccactgcactccagcctgagtgacagagcgagactctgtctcaaaacaaataaacaaataactactctttggccgggtaaggtggttcacgcctgtaattttagcactttgggaggctgaggcgggcagatcacttgaggttaggggttcgagaccagtctggccaacatggtgaaaccccatctctacttaaaatacaaaaagttttctgggtgtggtggcggacgcctataatcccagctacttgggacttttttttaagacggaatctcactctgttgcccaggctggagtgcagtggcaagattctggctcactgaagcctccgcctcccaggttcaagggattccccgcgcctcagcctcccaagtagctgggaatccctgtctctgcaaaaaaaaaaaaaaaaaaaaaaaaaaatatatatatatatatgtgtgtgtgtgtgtgtgtgtgtgtgtgtgtgttatatgtatatatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagtgcccccggactacattttccagaaggcactgcgggcacgcttcctgcctggtcggcctgaagggaagggccaatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggtgagcagaggctgaagagggtggggaagcaggggagctgtgcgtgtgtcggggcgggtggaaccttagcggaccctgggaggaggctccccggccgaacctgcccgaccctccctcccccggcttgccttgcaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggtgggaatcttatccatgacccacttcttcaaaaccctccatggtttacagaacccttttaagaactgtaagccttgtgaggttcggcaggtgttattttcctctttgcagttgggaaactgaagcccagagaggggaaatgatatgccaaagtcacacacggcatggcagggctggaagtgaagcctgatcacttggctccaaatcatcaacctcacctctgccccctcagcacccccacccttgccactgaacagctacaggagttctaagcatgagacacagagggcggcagcagatttagggggcaagaagatgaaattgggctgcatttgaggcagttaaacaaaataatggctatgaagatttttttttttttttttttttgagacagggtctcactctgtcccccaggctggagtgcagtggtgtgatcatggctcactgcagcctcagtctccctgggctcagagatcctccaacctcagcctcctgagtagctgagagtacaggcatgcaccgtggtgctggttaattttttgtattttttttgtagagatggtgtctcactatgtggcccagactggtcttgaactcttgggctcaagtgatctgcccgcctcagtctcccaaatgctgggattacaggtgtgagccaccgcaactggtggcctatgaaaattttttttttttttcagacggcgtctcactctgtcgcccaggctggagtgcagtggtgcaatctcggctcactgcaagctctgcctcctgctttcatgccattctcctgcctcctgcctcagcctcctgagtagctgggactacaggagcctgccaccatgcctggctaatttttttttggatttttagtagagacgaggtttcaccatgttagccaggatggtctcgatctcctgacctcgtgatccgcccgccttggcctcccaaagtgctgggattacaggcgtgagccaccgcacctggtcaaaaatgtttgagacagagaaggggcttgacctcaaaaggcttaagagtcagggcttgcaaagagctttgcaccaagcccggttgactggcaatcccatcctggtgtgccatattgagaaggaatcagaggctgcttctcagcttagcaggaaaagagtgcagagataaatgagggttatttgttggtgggtgtatagccagagagtgttggccagcgtcctgtttttgccattcctgttttaacctagtaagtgcagtaaaatggaatccctaaatccatagaatatataatagagttgcagagaaagacgaggtagggccaaaggctgggtcagctacaggatatccagaaaggtatcttgttggacatagagggtgtaaacagggagagagtctttgaacacgtgggagggaagggatggagggatagtgggcaggagaatctgaggttgggtcacaggcttggaaagggagtgggagggagtgtggcccatcactacctggccccctttccccatgttaaagcacagaggaccctctttcattacctcccccttccacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcaggtgagggctgagccaatggggcaggactgggctaggccagacttgacttgctgtgggaccctgggcaggggcactttcccttcctgagcttcagcttcccctcctggaaaaatgggttagtaattcctggcctggcctttcccagggctcttgggagagtagaattgagatgtgaaattgctttgactccattaaagggctggtcccagaattttggcccttccacatggtgggtggtccctgttggttctgacccccacctctgcccgataggctaaggacccgttctcctccctgttccgtggctcataactctctccttcggctcctagaagctgctctggctgctctatgacctgggacatctggaaaggtcagtagagggaagtggccaggctgcgcctggtgaggccggggggctgggtggcagcctgaattatgatcctttcctaggtaccccatggccttagggaacctggcagatctagaggagctggagcccacccctggccggccagacccactcaccctctaccacaaggtgggggcatctaaggagggtgcagaagggagaccctaacagtggctgaggcaggggccctcatctgggcagatgagaagagaactttgtgtgttggggggtatcgcccatccagtctcactttgtgtcaactgtgtgcagaatcagttcagtcagggctgtctgaggggtgtccagggttccccagcctgggagtggcaggggctgcatttgtcccctcagccctgccttttctgccactgcttactgtccttcctggagtataacagaggtcaaatgtggtaggagcactgaagagggggtgttcacttggtgggtgtaggtggggaggagggccattgggctgggcttgaaagtctttggtgatgtgtagaagagtgtctgagaaagagaagggccctgagctcggagggcaggccccacccctgcagtctgccccaggcctcagccagcagtcctgtagacccagggaggagaccaggtagaagggctggcagcgagtggaggtgggagtggagatggagaggactccctgggatcttcctgtggccccttctgggtgtgccctggtggggcatttgtgccagcagggcagctggggctgcctccctgaggatcctctgcctcacctccatccagggcattgcctcagccaagacctactatcgggatgaacacatctacccctacatgtacctggctggctaccactgtcgcaaccgcaatgtgcgggaagccctgcaggcctgggcggacacggccactgtcatccaggagtgaggatccccctactagggcctgcagcctgtcctttcttcccctccatcagtttccaaccaccctcgtccaggactgaggcctggctcccacgccccatcccctttccatccagtccctaggcagcaaggccaccattacccaggaggtagggaccctgattaaggtgtcacatctttccctccctcccctctcctcctaattttttttttctcagaacagtctcaaatctccaatgtttaaccaccatcatccagcagtgggacttccaccctcggccccatgcccccctcctcattcttgctttcttcctctgggctgacccagacagcatcattttgcagtgaggaccccacctactcccccagcccctgggggctccatcccccgccaggtccctggggctacccccgatggtgagaccccttcagaccctacagagaccccactgctctcacagctacaactactgccgggaagacgaggagatctacaaggagttctttgaagtagccaatgatgtcatccccaacctgctgaaggaggcagccagcttgctggaggcgggcgaggagcggccgggggagcaaagccaggtgaaaggctggagctccagcctgtgtccagcctcccacctggacagggctcccttccacaggccatgggggctgcatgtacgggattagggatggcaggaggaaggtggccctgagcagacagctatgttcccttttgctataactgaggtcctgggcccacgttggacgggactgaaggtattttagaggtttctaccctgtgccttcagtttcatggccagactccctccctcagctgaggggtggaggtagggatggtacgtcctggctatggattggctttataaaaggaaagaggttctaagaatgttcccaacctatgcttaccttttctggagccaggggtctttgcctaggtggggggcctggcctgtgccctctgctaaggggtgagtaagagactgatctgtgccctcccttccccctcgtccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgagggacagctgcacagaggtctgggcactacaggtggtgacagcagccacgggcttgtcagacttttctggcccaggggcagcatctgcccatccccttcggtgccgatgggactgagaccccctgggtgggatgggatggccagagcagggtcctggagttccagccactggccggcaaccttgctctcaccttgctctccccactggcccaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaatataaagcgcaagtccatgtttatctgggaaattggggatggggcggggagtggagcgccccctcttccctctgtcttctggctcccgggactttgcgctccctacctgtggagcgcgagcgacagtggcggcggaaggacgtaggctccgccccggccttggggcttcccccgcgccgccgagggcccgtcccgcgggcgcctcctcccggactggcggtggggcatccccggcgcggccccgcccccgggcttcagccccgcccccgcggcttcagagccacgggcgcccgccccgccccgcgccgccccgcgccggatccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggtgcgacgggacgggcgggagagccgggaggagggtgccagccccgcaccccgcggcaggatctagcccccggccccgccccccatcccgcttcaccctccgcccctgcaggcccgcgacacggtcacgtccgaactggccgccgtgaagatagtcaagctagacccaggtgagggcccgggtcgggcctctgcgccagaggaagggcagagcgcccgcgggcgcggggtgcgggcggagggttgacgtttccgagacccctgagaggcgtgccccgggaggtgctgtcacctgcacctgcctggcccggagggaggcactctgtgcccattttgcagatgggggcactgagtcagggcaaccccagcgcgccttccccatgatgctttgtgcttcccaggggacgacatcagctccctccagcaggaaatcaccatcctgcgtgagtgccgccaccccaatgtggtggcctacattggcagctacctcaggtgaggctgccttatcctcctggccccaggcagcccccatgtgacctgctttgtgcccaccccagctctttgtccctaggaatgaccgcttgtggatctgcatggagttctgcggagggggctccctgcaggagatttaccatggtgaggccagggctccaggccccagcaggccccagccttcccccacccctaccccactggggtaccagaggggactctgggccctggacttgggctcctctccactcctgcctggctgtgtgaccttgagagaaatactgtccatctctgggttcagtatcctagactaaactgggaggggacgtggccaacaccgctttcatttaacagtgcctgctgcttttcccacacacggtagcctgggagggtgggcatgacccccgggcccccaagccagcctctcccttttcctttcagccactgggcccctggaggagcggcagattgcctacgtctgccgagaggcactgaaggtagctgggcctgtgaggtgcccacacctctggtctccagaagctgtgggccaggagcccagatgaccagcagggaggcgggtggagtgcctcgggtggggctggcccgaggggctgtaggtcctggggaaaaggggccccagccctgttgccggaagcagtccatttccctcttggctcagtcacttcctgtttggggagaggggaggaagaagcagcctgagtggggggccccagtcctgagagggggtttggggaggtgggacagtgctgggtggctgctctcagggactcctctttgtcgccaggggctccaccacctgcattctcaggggaagatccacagagacatcaaggtaggcacctagctgggggcactcctggggagggaggaggaggccctcgggggcaccagatgggattgtctctcctccattcccacagggagccaaccttctcctcactctccagggagatgtcaaactgggtcagtaccctggggacaccatcagggtgagggctctgtggaccctccccggctaccctggactcaagggttgggtgtcactgggcaagtcactttgccacttgagtctcagtttccctgcttagaagatggaacggtactccctccctgctggaaaatagaggaggttgggtctgcacggagttgacatgggaccaggcactccgtcagggatagagggtggttgacccctctcaggagagggacctggccttgcctagggcctgcggcagctgtgaccaagcggggccacctgcccgtctgagccctgccaggtgcagccgagccagagccctgggcgtgggagggtgagtggcagccagagggctggtgagagtggctgtttctccccacagctgactttggggtgtcaggcgagctgacagcgtctgtggccaagaggaggtctttcattgggactccctactggtgaggctgcgcctggggcggaggggtaggggccacagagcagggcacccggccatcccatctgtgaccccacctctaggatggctcccgaggtggctgctgtggagcgcaaaggtggctacaatgagctatgtgacgtctgggccctgggcatcactgccattgagctgggcgagctgcagccccctctgttccacctgcaccccatgaggtcagcccaacacttgcccctcacctgacccttgatctgcggcctgtggcccctgacctcgcgccctccacagggccctgatgctcatgtcgaagagcagcttccagccgcccaaactgagagataagactcgctggtaagggccacaccctgctgccgggacccccttttctgtcagccccatagtggacaaacagcctctgccaactcccggggggcaaccccaagagccctgtcctttctgggctactacagaccatctgagtcaggggcctggtccttctgtgggttgaagacccagcgtggtcaggaaagaagggcagagggttggtggaggagccgctgtgtcgcaaggcagcgttgctcggccagtggcccttggcctcggctggctccttcctgggtgggcccagcagacgcctctggaggggtggtagggcagctggcaggacaccctgcacgagggctaacctggatctggcgctggggggctcttgtgccttctaggacccagaatttccaccactttctcaaactggccctgaccaagaatcctaagaagaggccgacagcagagaagctcctgcaggtgggaggcagggggccgggagagaggcccagtactcaaaagcagggccctggatcaggggccaacctgatcacccccctcccccactttccagcacccgttcacgactcagcagctccctcgggccctcctcacacagctgctggacaaagccagtgaccctcatctggggaccccctcccctgaggactgtgagctggaggtaggtgaggggggctggaaagtgagtcttgggctggtctgcttagaaagagcccgagggtgatgttggtggaggtcctttaactggcaccattccagctcagggagctggcctcagctgagccctcccattaggagtctctgtcatgctgacttttgtttcctgtaccacccccttgataggtccctgcccttgagtccaagctgaccatgaccacgactgtgccattttcttgctttctgtgtgatctttggcactgctctgtgtgggttctctcatctgtgaagtggggttccattttattttacagtagtcccagagggctgtcatgaaagcaaaacgcactggtgcgtgtgaagctcctagagcagccccggcatgaggcgcgtgccaggtgtgtccacactgtttctgtttttccttagacctatgacatgtttccagacaccattcactcccgggggcagcacggcccagccgagaggaccccctcggagatccagtgtgagtctgcagcaggggctgtgtgtgtgcagattttggggggcctgtgtgcacatggatttggtgtgagtagaggtccatcctgagactccagctccttcactcttgtactctgggccccccagttcaccaggtgaaatttggcgccccacgcaggaaggaaactgacccactgaatgagccggtgagtgggcaggccttgaggggaaggtggtgcccagaggtggggcagggaggtcggatggaggccgagcagctcaaatcaagggagatttgaagctgggtggcctcgggccttgggccttggactgtccaagcaagcctgtcctacccagggacctggagggttaggggctccttcctgggccaagttcttttaggtgggtgtctggaaggtagcacagagaccatgcctttcccaaaaggaggccgtcatgtgcctgagccctcaccctaccctgctcagcctcgttttcccacctgtgtgtccccagtggtctgactttctgtctctgccctcatcggctctgtcactggtctctcctcaccccccagcctgtctcttcctccctcgctgtctgttgccctttctttcacagtcttcagctctgcctcccactgtctgtctctctcatcttctgtgtgtttccatctcacctttcccgtctgtctgtctgtctgtctttcctttcctgaatctcttgagcgccctctcacgttgcatctgtctctgcttcttccccggtctctaccttggtttcccccagtgggaggaagagtggacactactgggaaaggaagagttgagtgggtaagtgaggtatggggaagctgcagggggtggcaggggcggcagaaaggctgacctctgaccgggcgtggtggctcatgcctgtaatcccagcactttaggaggctgaggtgggtggatcacctgaggtcaggagttcaagaccagctttgccaacatggtgaaactccacctctacttaaaatacaaaaattaggctgggcgggtggctcatgcctgtaatcccagcactttgggaggctaaggtgggtggatcacctgaggtcaggagttcgaaaccagctttgccaacatggtgaaaccccatctctacttaaaatacaaaaattaggctggctgtggtggcttacgcctgtaatcccagcactttgggaggccgaggtgggcggatcccaaggtcaggagtttgagaccagcctggccaacatggtgaaagcccgtctctagtaaaaatagaaaaaattagccggtgtggtggcaggcgcctgtaatcccagctactcaggaggctaagacaggagaatcgcttgaacccgggaggcggaggttgcggtgagctgagactgcaccactgcactccagcctgggcaacagagcgagactccatctcagataaataaataaacaaacaaaagttagctgggcatggtggcccacgcctgtaatcccagctactggggtggctgaggtaggagaatctgggaggcagaggttgcagtgagccgatatcttgccattgcacgccagcctgggtgacaagaatgaaactctgtcttaaaaaaaaaaaaaaaagcccgggtgtggctcatgcctgtaatctgagcactttgggaggccgaggtgggcggatcacaagggcaggagatcgaaaccatcctggctaacacggtgaaaccccctctgtactaaaaatacaaaaaattagccgggtgcggtggcgggcgcctgtagtcccagctacttgggaggctgaggcaggagaatggcgtgaacttggggggcggagcttgcagtgagccgcgattgcgccactgcactccggcctgggtgacagagcgagactccgtctcaaaaaaaaaaaaaaaaaaaaaggaaaggttgacctctgaccccttttccccactgcccaggagcctgctgcagtcggtccaggaggccctggaggaaaggtgagggatgtgggcctgggggaggggcaaggggcaggtggccttggtgccagtcacacctcatgcctcacgcctcatctccctcccacaggagtctgactattcggtcagcctcagaattccaggtgccacacagagggaggctggagctgggatccaggccactgcagagggtacgattggagtgggatgtggttacagggcaacctggtaacggccgggctgggccctgcccctcctaccaggagctggactccccagacgataccatgggaaccatcaagcgggccccgttcctagggccactccccactgaccctccagcagaggagcctctgtccagtcccccaggtgagtctcaggcttgggaggccaggaggcagccccagggtgggggctacagcaggaaattacagcacgcctgtgcctgcaggaaccctgcccccacctccttcaggccccaacagctccccactgctgcccacggcctgggccaccatgaagcagcgggaggatcctgaggtaagagggtgctacagtggggtggggagacgggcggctacagctgtcatatcagccctgactcctttcctccctcccagaggtcatcctgccacgggctccccccaactcccaaggtgcatgtaagtgtttgccccaagccctgcagtcccacagccctgccacccaccacccctgcactccctcgccagcctcttgcctcctctgcagatgggcgcctgcttctccaaggtcttcaatggctgccccctgcggatccacgctgctgtcacctggattcaccctgttactcggggtaggtgggggcagggaggaagcgggagcccaaggaatccctcagcttgggccaggggccatgtctgacctctgaccccatgcccaaactggcagaccagttcctggtggtaggggccgaggaaggcatctacacactcaacctgcatgaactgcatgaggatacgctggagaaggtgaggcccggctggctgtggggggcagaggccttgtgggggcctggggtgctgaccatctgtccctctgtggcctccagctgatttcacatcgctgctcctggctctactgcgtgaacaacgtgctgctgtcactctcaggtacaaggtgggatgggcagggaggcagggcccgcaggggctccagcgcctcagcatcctgcccaccaacaccccaggcctggcctcttcctgtttctgcagggaaatccacgcacatctgggcccatgacctcccaggcctgtttgagcagcggaggctacagcaacaggttcccctctccatccccaccaaccgcctcacccagcgcatcatccccaggtcagggatcttgggcgtgcagggagcgggaggcagaggggcagggaggggctggaacatggccttgccagttcctgggattgcagcaatcttagacgtgttgtctctctgagcgcccgtttcctcctctgtcaatacaattgatggccttcccaccccctcccgccggcttgttgggaggcaagaaggagacagtggatgtgaaagtgctttccaagttgtaggagctgtggttgttcggatgtggggcttgacagttaagcaaacgtttactgagcacttatgctatgttggcccctatgctgggcttcgggacatggagaatcccatgagtcctcgctttcaagaaatgggggagatgggcaagtccttgctttcaaggattcccatgagtccttgctttcaaggattcccatgagtccttgctttcaagaaacagcggggctgggtgtggtggttcatgcctgtaatcccaatcctgtaatccgaggcagaaggattgtgtgaggccatgtgtttgaaatcagcctgaaaacacagggagaccttgtctctacaaaaaatcaaaaaagtctgggcgggggggctcacgcctgtaatcccagcactttgggaggccaaggcggatggatcacgaggtcaggagatggagactatcctggctaacatagtgaaaccccgtctgtactaaaaatacaaaaaaaattagccgggcgtggtggcacatgcctgtagtcccagctactcgggaggctgagacaggagaatcgcttgaacctgagaggcagaggttgcagtgagccgggatcacgccactgcactccagcctggccgacagcaagagtctgtctcaaaaaagaaagaaaaaaagcccaaaaaatcaaaaaatggggccaggcgcagtggctcaggcctataatcctagcactttgagaggccgaggtgggcggatcatgaggtcaggagtttacgaccagcctggctaatatggtgaaaccccgtctctactgaaaatacaaaaattagctgggtgtagtggtgcgcacctgtagtcccagctactcgggaggctgaggcagaagaatcacttgaaccctagaggcagaggttgcagtgagtggagattgcaccactgcactccagccagggcgacagagtgagactgcatctcaaaaaaaaaaaaaaaaaaaatcgaaaacttagctgagcatggtgatgtaggcatggcgttgtgtgttggtggtcccagccactcaggaggctgaggtgggaggattgcttgaacccaggaggttgaggttgaagtgaactgtgatcgcgatcgtaccactgcattgaagcctgggcaacagagcaagaccttgtctcaaaaaaaagaaaaagggaaatgtggacagttagcagccggtactgaggtccagttagagggagagctgggaggtgtggagaggcctcagagaccgggcaagcttgggaggttcgaaagtgtgtcagggtttctaggcaggtgaggtagggaatggcactccaggcagggggaagagcaagtatatgttagtatgtgttggggcggagcagcctggtgagctggggagctgttaagagtttgcctgggggccaggcacagtggctcacgcctgtaatcccgcactttgggaggctttggcgagtggatcaactgagtcaggagttcgagaccagcctggtcaacatggcgaaaccccgtccctagtaaaaatacaaaaattagccgggcatggtggcgggcgcctgtaatcccagctactcgggaggctgaggcaggagaatagcttgaacctgggaggcggaggttgcaatgagccgagatcgcaccattgcactccagcctgggcaacagagcaagactccgtctcaaaaaaaaaagaaaaacagaagagaaaaacagtcagattctgattctcttttgcaagttgagccagtaggatttcctgatgaaagagaaagaggagtcaaggatggctccaaggtttttggcctgggtgtcaggaagaatgcagctgtcatcagctgaaggtggagcagtttcagggggagctgaattcaattttgttgcatgaacatgcttattagatgtgcaagtgggacctgcgtcagtccatggcttggtggggctgggctctgaagggaggggccctgggctatgggcccccgacattgtcatgaccaggtgggtggtgtgggaagcagtggactgagtgcagagggtaggggaggccaggccagtggctgcaacagctggggagctcaggagcccccttcctgcaacgtgctcactccaggaccacatctggagcccggtggccttggggcttcctgagctcagtccccaagtgagtctgctttggcgcaggacctacaggaaacaggcccatcagagccccaacaggtcacaggcagctttgagcttgtgttcgggaaatggcagaggcacagtgagcactttgaatgcaaagaacagagaactggagttgtttggagaaaaaacaaatacaaaatatatgcctttgtcccatccaaagaccagatggggaggagagtgggaggaatgtggggagagggagggacgaggaccagggacagtgagagacagacattggcttcctccatgtcctggcagaaggtacaaacaggacatgggccactgggtggaggtggcagggctgctgacaggaagccccattccccagaggaagaaacaggctgagagggtcccctggag

SEQ ID NO: 1529 - DNA, 2767 bp, Homo sapiens
ggtgtccggagccgcggacctagagatcccagaagccacagcgcagcggcccggcccgccactatttccaggctctgcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaatataaa

SEQ ID NO: 1530 - protein, 639 aa, Homo sapiens
RSQKPQRSGPARHYFQALRGRGRRPPPAAMGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 1531 - DNA, 48829 bp, Mus musculus
  misc_feature (1)...(48829): n = A,T,C or G
ccagagaggtagcagttaaaagctcttgctgctcctaccaggggaccagagtttagttcccagcacccacatgctggctcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccctcagccttgcgttctgcagaaagaattgtttgggtttctttaacctttatcgcagacttatcacactcaacccattcattatctcaatccattccccccaccccacccccttgaaccttctccaaaacacgtcttttaagttagggagaccataacttaattagatctctcatttccagaggattctcgtggctcctccaaagaaataaattaaatttcagtcagctgtatttcattggggggaagggtgcaagacaaagaaattggatgctctatataaatagcacattgtctgggctgaaaatgagttctcattccaattgtttttgggaacaatgggtccttctgggggcattgaatggcctccaactcctcctgactggtgggcttctgtgtttaggtggcttctctacctgaaaaaaaaaaaaatcgggaggcatgggtctcagcctgggacagctgtcaaaggtgtggtagtggagatgagtgctccctgcttctggctggttttgaccagcttcctttcccaggggtctgcctcacttctctgggacttcatctcagtgagttaagtctgtatctcacagtgctgctccgggtagctgatcacaggggagccgggcctgacttagctctcagccatggtagaaccgtagcccgtctgctaagcggtacctcagccaggctcgctttaagcagacttcctcacatctctccactggagtttagcttgggagactgaagaaactgggttcacaaatgatgtctgaggtccctcccagcctgaccgagagactcacccactcgtggttctgagtggtccatggagaagggggggtcatgaaagagagagagccaggttccacgggcgagaaggaaaagaatgcttgggaagagtgacagttcaatttgaattccttcccttcccttctgcccaaggaccccaagcccttagtggaagggtcacaaaagtgatcaaatattgatgccctgctttgaaaatgatctcttactggctgccacccgtgatgtgtcaggcactggccaaggctccatgaaataattcccatctttagattcgatggcagagtagaggtgctaagtgtctttcaccaccaggccactcactcccagtgagtcgccaccttacagttcacagcgcctctgcctcagtgctgtcattagacctctgtatgctgtcaaagttcccaggcattccctccattaccattaccattactatttctatttctactattgttgctataactactactactaccactactactaccactactactactactactactactactactactaccactaccaccactaccactaccactactactaccacgactactactactaccactactactactattactactactattactattgagtcaaggtctcaccttgtagccctggctggtggggaattctctatgtagtataccaggctgacttctgcttcccccagtgttggatcgaagatgtctgccatcatacccacttccctccacagttcttgcccccactataatcagatagttagcttctagctcctgtcttcctgcctactggatggaattccacagggacagggaccatgtgagttttgttccccgcacccagagtgggagcgggatgtgaacccagatctctgtggctctgtgacctggccttgcagggctcactgtagagagtctcctgtagctactggcccatcaggagggctttgagcagtctcgccagaagtaactggtagtagcacctcctggctctgtttttccccaaagatgtctgtaaaataattggtgatgatggatccccctgggtcactgggcatggaaaaagaagaggaatcacttcctttatgagtttatgcaagtgtccttgtagctatttagcacggcatcttcatgtccttcctcacccattccatcaagggcggtgagtaagaatccgctcagtaggggatctaggtcattgggaatgagtgggtgagaatcgagggagaaaaagcaaagacatgacaacttttagggaagtgaaaataaaaccctaatgtggaaacaactgaaaatagatggtgggatgtcgggatgtcgggctgcatgcaaatccaatgctaattacatggaaattgatgactccacctgccttcctgggaccctcagggagcccctgctgcaggcatctttcctacgccacatacatagccgtggagggaacgcaaactctgatgtcgcccctgcccactccaccctcttgagaagagctgaggggaaggctaaaaatactaacaatagatatttgatttcttttcgcagacaaaaagctctggcatccacgggaggaagaagcgttcaggcagcatgtgactggttggtatgaaataaataaattgagaaactagcatgtaattaactctgagtgtctgtgatgagtgcgggtgtgcagtctttttctactggacccttcctggaggggaagagacaggcccacttatcaagctgactgcctcctctgccctggccccagggtgtgtgtatctccttggatctgtttaaaggctttcaaaatcctcccagatagaggctcccattatctgaggtctgccagtcaccccaagattcgctgtgcactgtggatgctgagctggccaattgagaaaaatacctcactcgtttaccaggatgtcattccctgggagaagcccacaggccaccctcctggaccttccttctgctttggaggcgtaagagctccggagtagactgagctggaggacggagtgtgtgcaaggaaactcctctgtggggaagagatttggagttaacccaaggatgcttcctggagagcggcttgggtttttttttagggagttgtgggatggggagaacagaagcctctccatctgagagttggttgggtgtgtaagcttcaaaggatggattctgatagcacaaatggaagcccttctccctgtggtcctggggtgggaaacctcttcccttcctcctcatccattgtcctcccagcaaggccttcttgtctctcttatctcccacaggttgttctcccatgtgggtgaccccttcctggatgaccccctgcctcgggagtatgtcctctacctccgcccgacggggccattagcccagaagctctctgacttctggcagcagtccaagcagatctgcgggaagaacaaggcccacaacatcttcccccacatcactctctgccagttcttcatggtgagccacattgcaccccctgtctccccggtgtttcagccagcccctgaggaccggaactgaagatcggagcttttctggaagaccaaggagatatttaggatctcccagcactgggtggacctcccaggggtcagtgtggttcacagtgaaggcctcaccttactttcagtcttctggcatcggctgaggccctagaacatcggggttcagtgcatgaggacagtgatatacttctacaactggaaggatagataagcctgacccttggtgggtggaaatctggcctgtcagccattgatgtagcttcttcatgtgtgtttactgtctattcactccactcttaggataggaatatcagtgtgagtgagtgtgtgtgtgtgtgtgtgtgtgtgtgtgtgtgtgtgtgtgtgaatgcacacatgagcaccttatccacctcagatgtaatttctcagaagccatccatccaccttgtagtctagcctgaaactcactaaggagtccaggcaggctgaatggccagtaagccccagagatatccccagtctcgcctccctgatccttggatcgatcacaagcgcatgctaccacacctagctttttttaggtggttccgggctttgaacttacatcctcgtgcttgtatggtgtgtactccaagtgagcttcacttcttcctgtttatttttgagacagagcctcatagcccaggctagcttgaagcttgctacatcactgaggacaacaggaagctcctgatcatcctcctgcctcaacctccccagtagtgtgattataggcatgtaccaccatgcctggccaactctctgggtggggaggggaaggaacggagagagtagggatcacgataagaagcttacagacagaaaaagccacttccctcgcgtgatatcagcacgaggtcttactagagttttctagagactgagagataactctctcctgccacagttcctcatccatgccctagctgtgggaaagcttgcttacaggctaaggcaatcctccacagcacaacagctgaagcatccatcccttacctccaccccccacagtggtgcagttgacttacccgcggacttcacaaagcaggatggtagccttttaaaacgatttttaaaaatatattttgctttgggtttttttttcccccttctggatagaattctcacttcgtgtgtgtctcaggtaaataacatgttcctaacaccttgtctctagcaactcactctgaaaattaaatcgattatcacttcctctgaatcatcccaggatcttgcaggaaagcagttagggtttagagacactcatgcttcctccaagccgaagagggtaggtggatgatgtcaccgctccacaggctcattctttcttcttccaaagcatcatgggaatggtgatgaagacagcagctgtctgaggagcagctgaaagagtgctagaggctgtgttcctacttctttgtttgtctgcccccacccccaatctccccattcctccttctcctctccctggtcctcctttgaatctcaggtaccttattctctagaaacagggcctctagttgaactggaacctcactttggggaatgggggaacaggctgactaagtgagctattgggttccaacaatctcaagtttcctgtgttgtgctaaccaacacccacatgatggttcactactgtctataactacagctccaggagactcaacacaatataactccagggtgccatgcctagaattaaaactcccgaccccatgcttccaaagcaagctcccactcgcattgattcatctccctaggctgcctttttggcaggtgcaggtgcagagggcagagtctcgagtctcccagtctaacctggaacagagtcaagctgagcatgaccttgaactactgatcttcccaccttcgctttctttctcagtactgagtttgtagatgtgacctcaccacatctgaaatatttctccccgcacagttttatgtggggctggagatggaagccttcacttcctgcatgctaggcaagccctctaccaactctgcgacgccctctgctccaccctccagattatggttacattttgttttattttaagtttataggtgtaggtctgtgcactagtcccatgcctggtacacacggaggccagagaagggtgttgagtgccctggaactgtagtgagaaagccttgtgaaccatcatgtaggtgctgggagccaaatgtgggccctcagcaagaacagtatcttagagttttactgctgtgaacagacaccatgaccaaggcaactcttataaagacaacacttaactggggctggcttacaggttcagaggttcagtccatcatcatcaaagcaggaacatggcagcaatcaggcaggtgtggtaaaggcacaactgagagttgtacatcttcatctgaaggctgctagctaggatgagggtcttataactcacacccacagtgacacatctattccaacagggccacaccttctaatagtgccactccctaggccgagcatatatcagccatccacaaacagctagtgttcttagcctctaagagccatctatctccccagctccaggaacttacataattgacagattttggtatctggtgtgactgttgatttatgtaagcattataggatgttgactgagccatttcctatatacactgcctatcgtctttgttggcttgtggtaattccttgaccacctactaccctcatcttcttgcttgcccttgaggctgtgaattgagcacaaggcctctcacatgctaagaaagggctccaaccctgcaccctgttcccagatctaaaatccacccttttagcaattttcaagaatacattgtgtggcttctagctgttgttaccataccgtaatatttactctgaaactgtgtttcccttaaccaacaactggaccctagccctgggttttgttttctgcttaacaaatcgggtagcattctggcaaggttcccaggatcacaacagagcaagaggagggcaagaggtgtcatgatgcatttcttagtttcatttgcccactggatggatggatgggtggatggatggatggatggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcagcaagtactgaagacccagagtatagatagtggaaacggccacaagcacccatcgcatggactcaccctacaaaaacaccctgcagtgtaattggaaagagactaaatcccagaataccagttttctgctctatctgacctgctattctctgagacttgactgactcccttaatttcttcttggttctctcctgggaagcagacaggtttttctcatgaagcgtacaaagggggattagagctcacccctcatgttgctaggtttgctccgctttatttttagtgttttagaataatggtatgcacccttcaaatgagtgggccacaacccggagcagtgtcaccctggggggacatttgctaatatgaggcatgatttgggggttatgacttggggtgctgctgccatccaggggataaaggctggagggggggtgttactgaatactctgtggtatccaggacagctccctacaagtaactattcacatacatgttgttaggaaagcctacttcatactgtgagatgttccccaggcccctctttttcaccacgctcccagaatccaggaattcctatcctagatgaagacaaccgctccagcagtccctcagtcacaaaacccgcattgtatttccgcatcaatcacattggccttttagatctcctttgcttcttctgaatggaggggctggtgatgagtccctggacttgtcaggaggagtgagccaaaaagattaacccggaacccatcctcagctcctgctgaaaagccatctgtcgtggggctttctatctctggaacagtgggttgattggggcctgggatccacccctttaattccactgctacctctctgagggactggcttctttgttatttggggaacaggacacctctctgggccctttctttcttctcctccatggttgtgatttcctctttctatccccctcttttcagaagtgcatgtggagcctcataagaagcagctgcatgtgacgctggcctaccacttccaagccagccacctacccaccctagagaagcttgcccagaacattgacgtcaagctaggatgcgactgggtggccaccatattctctcgggatatccggtttgctaaccatgaggtaatgcttccctgtagcccccaggcaaaacccacggagatcggagatcgtagttaaagcatgcaaggtaccactgggtgggcaaaatttttaaaattttgcacttaagaagttttaagggccaatgaggtaactcggtgggtgatgtcacttgctgtcaagcctgacaacctgagttcaattcctggaacccacgggttagaaggagagaacggaatcttgtgggttgtcttctggcctccctgtgcatacacacacacacacacacacactgaatacacttataagaaaggagctttgagtccagcaagggagagaggagaggcagatgtaagaagagatctctcctggtccctttgagaggctgtggactctacaatggaagatgtgagtgaatatactaataatatatataatatatatagtgaatcctactatagacaaatgggtctaagttttagcatccctctttggatgtagtcagcatggcttctcagtcaatcacgtggctctcagaaggacgaatcttttagtccttgctaatctttttttatcttaaagaagactcagaggttgactgtctgctgtgaagcggccgtacaattgaggccacaggagacagattcagtcttttgatcagcataggcaggtgatctgcctaaggaaagaccgcatacagtaatcctgcggtgtctgctgggccccttactctcacgatttcagccatcagaagctaccatttcacaagtagtgctagggagatggccccgtggagaggtaggagcgcttgctgtgcaaacatgaagatgtgaattcaagtctccaacgctcgcagaagcccacgttcctgtcacctcagagttgagaggccaacagaagaattctaggagctagcataggtttatgatgagccccgggatctgagagagaccctgtctcgagagaataaagtggtgaccaatagaagaagacacccaacctctttctctggactccatatgtgtgtacacaggctcacaaatgcacttaatgcacccatgaatgcatgcactacatacacagtacacatatgcacaaactcatgactcttcagtaactttattacaatttattattagaacttttctattttattactggttttgttttcaatctataaattaaatttgaccatagctactaatagaaaataatataataaacatggagagtgtgtttggcactatctacaatttcaggcctaccctctgggttttggaatgaaccccagggttagtggatagctactgtagtcagatgaaaaactggcttctagcttaattacatttattaagcaatagttacatgtttctcaatttttcaactacgccaaaaggttttttgttgctattgctgttagcctacaggtcctttagacaattcttttgtactttcttaatatgtttaaaaaaaaaaacagaaacagacagaaagtcttgctgtgcccaggcaacctagtggtttgggaagtgttaagagtgagtctaagaaccaaagcttcgaggtatggcactccgggagtggtgaggccaggccttgcctgactttcctgctgcgaacattcttcagtcattggtgctgattcctcctgagacagacctaagcagactacatctaatcgtaagaatgttggcatctcctggaattaccaagattgctccttaaggatactagacagaaatgtgatggtcagactcttttccaaggacaccggcagaatgaaaggtcagggttgattgtacactggcctcagaggagttacctttgtaagaagagaaggtgccatggaattttacaggctttgtcttcgaatgagcactgccctccggttaactccaagggtaactgcttttctgcatgacccatattctgctcagtctgtgtagaaggaaagaggctgcaaatgcccacatgaattattctaaaaataacttggccccctttatctcttattttccaaagctcagttattatagtctcttttgataaggcacccactgccccgctaggttccctgtctcgtttttttagtctcccaccttcctcctccttcattctgttcccagaaggaagacggaatagaaacagacaatttctgtaaattacagactcagaatgtagctcggtttgtagagtgcttgcctggaatccatgaatctctgcgttcaagtcctatccccacataaaagtggatatagtggtacacacctgtaatcccagagaaaggaggattacaaattcaaggttatcctcaggtacatagtgagttcaaggccagcctgggctacatgagtccttgactaaaacaaagcaaacaacaacaacaacaacaacaacaacaacaagcccaaccaaccaactgaaaagcaagcaaacagacacacaggctggggagttggctgagggcaagcctgggggccagaattcaaagttccagcactcatatcaggatatcaaaagttctgtgcatgtacctataatcttagtgttagggaggcagagataggaggatccctgaacttccaggttcagtgagagtccttgtctcaaaaaataaggcagaagtggaatggagagatagctcagcaatgataagtattcaatgacccagcgcccatgccaggggctcacaactgcctctaaaggggatactgtgcccccctctggcttccaaaatcactcaacattgacccctcacctacacacgcaccaacataagggtgtacccataaggtgtatatattgttttcagttcttagttttctctacggtggagatgtttcctagactgttgcaaggatatgggggatgtgtggaaagctgttgccataacagctacctggggcagatgcaacaaaatcgcatccctgccgatgtccttcagtcagctacctttgtgtttggtctctggtgtaatgagggagaaagaactaagctcgatacgagactggttttagtattatttttattttatgtgtatgagtgttttgcctgcatgtatgtctgtgtatcatatgttcacagtgcccacagaggaccaaagagggtgtcagatccccccagaattggagttccaggagaccgtgagtgctgggagctgaagccaggttctctggaagagtagccggtgctcttagctgctgtgctctctctctctcaggaattcttagaaacagaccataaacataagacaaaagttagcatgatgtagggcaagtgaggcctgggtctggtacctctcagatttggtcaagatttttgtatctacttttgggggtggaaagaaacagagaacacttgggcctggattattgtttgtgtgtttgttggtgctggcgactgtactcagaatcacatgagcatgcattccactgctaacttacacccccagcctccggttataatgttaaatctgcttaactcctccattattagaatataataatcaaagttatttactgtccctttatcatatccctaggatattttgtcttcaatcttccttgagccttgatattctcaaggatgtctgggatgggatactcagcttgttttgttttgttttgttttttgtttttcgagacagagttgctctgtgtagccttggctgtcctggaacttgctctgtagatcaggatggcttcaaattcagaactcagagatctgctttcctctgctgggattaaaagtttgtgccaccaccagcgggcatgatactcaacttgaagtgctgggctaggaagacttctaagttactctaagttcttcaaagggaagactgtactaccaggccagaggtactctgagccaaaaatgtgctatgctcaagtagctgagcagagttttgactatgccctgttccagggaaagcaatactgcctttccctgcccacccagaaatgagcttaaaagagatctctagtgagtaatttttgtcttttaaaatagtttaaaaaacaattcatacaggctcttggcttgcatgaagattggagagggacagggaggagaggtacaggaagagagaaaggtgattagaggacagacagacaagcaactgaaaggtaattggagaattaaaggcagaaacaagaaccctaatttgaaaaccatggagacaaaagcctgcattatcaactttggcctctgagagaaaccagattttcctggcttttccctttggagacttccagaaaatggtttatttggtttggtttggtgttttattttgaaataagaacttgctctgtagcccaggcttgcccagactcactatatagaccaggctggcctcaaggtgatcctccatctcagcctccactgggctgagatttcagctgtatcccacacacagcagaactctgtctttatagcaggttttggtggctcacagtaacatcagcaagctggctagttcagacctcccagcactggccttaggccccaggattaggaatcccaggtcacaggaagtacccagaaccctgcaaggctctgtcctcctgcacttccttagaagtgcaactcaggagtcttcctagcccagcacttaaagttgagtatcatgcccggtggtggttgcacaaacttttgttctccttaacctttatagtgcaggcactaatggaaaccaaagctgaagactctgaagatgggaatcagagtatgtagcctgtctcttccagatctagagcctttgggaaggccgtgaaagctacctttctggctgtctggaaacacataaggttataattataggttataatttccttcctatgaggtctctcactggtgataaaaaatatataaaataaatgacgaagatttttttaaaaaaatatctagaattatgatgcttatatacaccaagaaaagaagcaccccccccccttcaagtaggacacatgggccacatggcctggcctcatggctgccctggggtcttttcctgagctcagagaatagacatgtggcctccatctgctctctagcggaagtggtttctttctgtttacacacgttggtgtctaagagagactgcttgttcgttcagggtctttgttaccattgtaggcttaaagacagcctcgacagcatgggctgtgctttgtaccgtatcctgagtcacagggaaagggccatccttcccgagcagctcggagcactggctgctcctgcagaagacctgggcttggttcccagtactcacacgacactcacaatgttctgtaacacaattccgaggaatctgatgccctcttctgtcctctgagggctcctgtatacacagacatcacatacacacacacacacacagacagacatcctttattcccatcccagtagaagtgactcccactggcctgtctgtgagcctatgtagaagccaagtctcctcgcacaatccccatctgcctactgcttgcttgccccagcagatgatgcaggggaaataaatatctgtatgtccagcaattgcccagaagaccctcccagctttctgtgagttccaggaagcacttgcttcagagtcttgtcaggaagtgaaaagcatggctgggattctggaaggttctagaacaccaggcagctctccatccatgagacattggtgagagaagtgctttctgattagaagcctgtgaccccagggactcctatatgcagcgtactttgtcatcgtgtatattgggtacagtctaggacctcaggtgctcaaaagaacggtagatgagtctgatctcatgggtcttctccttgtttgcagacgttacaggtgatctatccctattcacctcagaatgatgacgagctggagctggtcccaggggacttcatcttcatgtctcccatggaacagaccagcaccagtgagggctggatttatggcacctcgctgaccactggctgctctgggctgcttcctgagaactacatcaccaaggctgatgagtgtagcacctggatcttccatgggtaggtacaccaactctcctgccccatgcagggtcactgcctatccgggttcctggtgggcagccaacctgaggctgctgtccatctctggctggagagcagcaatatcccacgctgagtgtgcactgcttcgtgccttctgtttatctcatcctgggccattactctgggggcgggccgacttctcagagcaactaggccgactccttccatgtcagccagaccagtgacagaaagcttcaaaagtcaggaaccctcgtttgttaggtgaccctgaacaagggtgacaggcagcttgtctgaactgaataggagcatgaaacctcacattctttattaaggtgacacccacctgcccctcactcctctgctctccttagcccagactggggtccagtttccagaatgaaccatgttgtgtgaccagctttgccccagatagaaataaatagggacacaaagtgccttcctccttcccactccaaggagttcaaatccagccccaggttccacatgctggtttggttttccctctcccttgtttcttccatgttacggtagtgtgatagagaggcagaagccctgaatacacactgcatcattacctaccccattagtgcctgtcttaagggatcagattgggggattcctgcaaatatttctcctggaggggaaagaacaagactgcccatgagccctagacaaaccatacgctcaggatagcggccactccttcccgcctctgtctgtgtaatgcccctccccagcccacaggcatccagatacttcatgcccccaagtgtctgggtttttttttttttttttttttagaaatttttctgaagctgcgactatagaagttgagtttctgcagccaccatcttatcccacaaagataaataagagctgaaagaaagagactgaattggtgaagtatagctgcccacccctgtaattccagcactgagaaaccggagatggggtgtggagggttcagccagtctaacctacttagtgagtctgaagatagtgccttaaaagaagaagaaaggtgaatggctagcaacgtgggaaaggcatttgccatagagcctggtgtcccaagtcctaactgcagggcacacatggtggaaggaaaaacccaattcactacacacatacactgcagcatgcacacaaactcaaaggcaggcagacagacagacagacataaatgtcctaaaaatgtgctaatgggggactggagagatggcccagcagctaagagccatcataaagaccagcgtgttcagatcctagcacctacacagtgcctcacaagcagctgtaactctagctccagaagatctagctctctcttctggcccctgagatcgccacatatatactcacacagatgtatacacatacataaatacaaataaattcctttttataaaaagatagtcagtgagtaaggaactcagagttgtcttctgtccaacccctaccaacacacacacacacacacacacacacacacacaaatagtcgtgcatcatatatggcatttggcttagggttagcccttatacacgataacggtcccttaagttgtgtcacagcaccctagcatcttagtttaagttcactctgatgccattcagacaagtcacccagtgatttgctcctcggaacatcaccccaaagagcggctcgtacatacactgagaactgaagatgatgcttgatgaagcacagctcacaggtctcgttttagcagtggagtcagatgtggggtacagaggacacacatggagtcccactgacccctctgagaccctccgtctagacctcctccctgaactaggattcaggctctaccaggggggacaactgactaacctccccaggataccatggaaggcctgtgtgtcatctctccagggtaccatggaaggcctatgtgtcatctcccccagggcactatgagaggtgtgtgtgtcatctccttttactttgaagataactgttgatgttatttcttggaaattttgtttggaattaaattctcaggttcacaggcaactctgctaagaatatgcaaatacaagggctaggcattgagacgctgattaagaagttgagctttagtccagttatattcacatcctaactctcccatataccggctgtgtaaagttgagttactactctgggccaccgtaaaagagcgaatcactccacatacagtactagctgtggtagtgactacaataaagaacagcccgactacatctatggtggctggactgtctaaagaacacccactagtggttttgattatttttttttgtctgtgtttatgggacctggctaagctaaatgtctcttccataaaaatggcctgacaagtgaattgcgcattactacttagccccagaggtaggaatggatgacacacagaggcatagctcagccccactgtggtagaagccttctcgtgcctaaccaaagatggaaagtcatggggagacgtaggaaccatatggcctgaccctggctggcttcaagaaaagccctagagagggttcatgcagtgtagagagacttggggtgacagttggcttttattcctctccccacctttgccttcagaatacctaggaaaatgttttctttctcactgctcttcctggtggtcatttgtccctgagtgtccctaagtacgttgtgggtgacactgaccctttgtcctctggagtgggatgtcctgctgaccttcacacaggcctagcatgttctaggcgggagcctgcatcttcctgctccctgagaaggagttctctgtgtcaggcctacttcttctccaccctggtctgacactctccccgggctgctcagggggagctgggtctttcgattctagtgttattgaagatgggaaggaagctgccgttcccctcaccaagggaactggagggagagaaaaaggccctatcattttctttccagctgtgatacaataaagagcttacagacgtgggcaagggagatgtcagcatgattccagacagctagacattggtggcccaaagctttgatgagccagacaggaaaactgacgtttcttcagttgtgtgccgttggggaggctctctgcttaaaatgaaggggaacagctggtctattagagtggctcagctttccttgggctacagttacttaaatttacccataacaggtctaatttggctgcatgtcatactaaaaagacacagctctattgagccacaggctcctggttctactgcatgggctctgaacaatggtctatgaggagcaggctgcagcccagggcctcctggtgtgtctgatatgcccagagctgcagatctctcttgcagggtctgacacctatgcctgaatatacagtcaggctgaggacacagctcagttggtagagtgcttgcctagcgtgccagaagcgccgggtttgttcctctgcatcctagagactatgtgtgctggcacacacatgttatcccatcactcagcaagtggaagcacggtactcaggagtctgaagccagccttggatgtggagttggaagccaggctggactctatgaaacaaaaacaaaatcatttgtagggggaactcagggacatgaaggacttctaaggacaaaatgtgtcccaaagtaataaagacacaggccttcttgagaagaaaaaaaaaaggaaaaagagacccaagcaactcctgacctctgacttgatgatgtcactcaagggcatttatccacaaggcctaaaaaggcaacatacagtgatgtttattaaagggctgttcacaatggctaagtcatgaaagccatgcaagtgacatacacttatattgaactaataaagaaaatgtggtgaatggatgagtggaatttgatttagaaaaaaaaaaacaaacaaacaaaaaaaagtcataagtgaattaagtcagactcagaaaaacaaatactgcatgttttctcttgtcaatcatgtatcttatatataggtacataaagtcacatgcgcgtacatatgtacatgtgacatgaatgtagaagtgaaactgcttaaaggagtttggagactgtcttagttagggtttaactgctgtgaacagacaccatgaccaaggcagctcttataaggacaacatttaattggggctggcttacaggttcagaggttcagtccattatcatcaaggtgggacatggcagcttccaggcaggcatggtacagggggagctgagaggtctacatctttacctgaaggatactaggagaagactgacttccaggcagctaggaggagggtctcaaagcccacacccatagtgatacacctactccaacaaggccacaccttctaatagtgccattccctgggccaaacatattcaaaccactaccaggacaaatgagggagacatgtgcaggcagagggagtggagagagaaaatgtgaccaatgtacattgtcaactgttttgaaataaggtatctgtgtgtgtcccccagccaccaccaccagacaggggtctgtctctgtgtagctctggctgtcctggaactcaccatgtagagcaggctggcttcaaacttacagagttctactgacttctgcttccagcgtacctactgtgccaccacacccaacaccaaagtacttgtatagcaacaaccttatgaaactcagtactgtatacactggatatatgttaaaaaaaaaaaaaaaaaaaaaaaacttagtggtgggtaagctttttaaaaagccaaccaccagttgacttactgatcttagaaaagatgaaaaacttcaaaagtaaaattctaataagcatactgtgttaaaggtggataccacagagtggatgcttgctaactcgcccagattgttgggtctagagatataaaaccagacttggtagagcaaactgggcctttccaagaacaagaaattaaagattcaaatacttccctttgagactgcccagggacccaggagatatttgttagagctgcccaacaaccatatttaaatagcagctctcattacataaagctttgggacgtctactatgtgcaggaattccagggtggaatgtttggacagctttgctttgggccccatctcctcctggcccccgtagttacagtggcctagtcagaaataagatttcttgattcacagctccaaacatgtggcaagagtcagatcctctgaaatcacccagtctctggtcatcttggcgttgctatggagtagcagtacaatgctggcgactgaagaggtcaggtttaagggtgagggtcatgctcctgagagcctcagcgccacaggcaaagcggtgctgggaacacatttcccttcgcattcctcagacggaaatagctatggaagagattaaaggcgccaggaattgtttacttctccgcagcgacagaaagagctggaacagtggtacataattgatacctcattattctttaacatgtctctgctgccaaccctgcctgcagcattttaataagccgagaatcactggaccccatccctgcccgaagggatgggtgcatctgttctcagctctgaggactgtctgcccttgtttattaactggggagacttcagttaaaaaaaaaaaacatgttcttgcctggggatgggctgctccctcctcacattccgaaacacgcacagccacgcagccctttgtgctatttccatactcctgtagctgcggcatgagcaactgatgactgctggccgaagcagttaacccttccctctccttcctctgcagttcctactccatcctaaataccgtatcatccagctcgctcgcgtttggcgacggagcgttagagaggcggcagtatgaagatcaaggacttggggagacaacacccctcactatcatctgccagcccatgcaggtaaggctgatcgtgagggtcgtgtcctcaaatctaatcctgacggttttgggttttttgttttgttttgttttgcttttcgagacagagtttctttgggtagccctgtctgtcctggaattcacgttgtacaccaggttggcctcagactcagatatccttctgtctctgcctcccaagtgctgagattaaaggtgtgggccaccatgatccagctaatcaggatgctttgaggaccattctcagcattgaccttgctccttccaaagggtccctaaccttatgaggggggagtacacaagatcacaaagacacacaacaatccaaaacaaggaaaagacaggtgtgcagtactgtctgtggacagtgccacatgaatttaagcctggaagcaaggccatcccaaagaaagaagaggctgtccctctacttgtgtcagtagagtgaggttcttaacatagtaatgggaattgaactcaggacctctggaaggacaatcagtgctcttaactgttgagccaccttggcagccatgcgattcccttggcatagtgaaaattcagtgtactactgacactctggggataggctagagaagggagtaggagtcattgtcacgcagaatagagaaaaattgaaacttcaacatgttaaggatggaaaccaggggtgggggttgggggtgctttgtctggagttcagggtttgaattaaggaatgccaggagagcaagtggcaaagttcacagtaccaagccacacattagccctggcaaaacaacaagaagccaatggaagggtgttggccagcaatgacctagcagcctgaggcaactggcaagatactgatgcatcagaaagatggatgtagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcacacatgatgattagaatatgcaaagcctggctgcagaggtggctccgcagttgagagcaccagctgctcttccagaggtcctgagttcaattcccagcaccccaacatgatggcttagaactataattccagtcctagtgagttcttccacctctgtggacactgcaggcatgtgacactcatacacgcatgcaggccaagcacccattcacctaagtaataaacgatacatgtgtgacgataagattcctccctcccggaaagagctgttgatgaatctctttgaaggagacagctgcctttctagatgatcatctgtttctacattaatggctggcttgacgtgtgaactttaccttgagttaccctcctattgcagtagggggaagcaaagagcatagtattttcataatccttcatacttcaatgcacctgcaggtacctcatgggaggcggagagtaacttgtggggtctgtggggtgggtttattacccccactttacaagcaggccagattaatctcatggcagtcaggtaggtcgtcagtcgcacactagcaggagttttcctagagctcagctctcttggcaggcacacagggtagtctgtgatgctgtgtctatccttactctctttctttctctgcagcccctgagagtcaacagccagcctggaccccagaagcgatgcctctttgtatgtcggcatggggagaggatggacgttgtatttgggaagtactggctgtcccaatgctttgatgccaaaggtgagtctttccatttatccactttgacactctgtggtttcgttcacccacagctagtctaaacctagtaagagggaaagtccaaaacaagctatcttagttagggtttctattgctgtgatgaaacaccataatcaaaaagcaagtcgggaggaaagggttgattcaccttccatttccacattgtagtccatcattgaagccagggctggaacctggaggcaggagctgatgcagaagccgtggagaggcgctgcttattggcttgcccagcctgctttcttataaaactcaggacctctctcccagggatggccccacccacagtgggatgggccctcccatagcccatatcaatcagtaattaaggaaatgctccacaggcctgcctatagcccaatcgtatagaggcattctcttatttggggtttcctccttttagatgaaataaaattagccaacacacaagcagtccgtgtgctttatactgcaatccctccattctgggtcgcgtgataagatctcaggctctccaactgtgtcacatctcttctcccagtgtctccacagtacagatgctatccacctactaagcttgaaaccacccaggttttcaagtcttctgccagagtgtcacagtaccatttgcctctccttacttgatcacatagatacagcatcctttcataagaagccagagtatataatacaataagatattttgtgcaagacatctatgtatcttacattacagtatatcatttattctcactcattactgtgactgacttataagttaaatgttatcataggggtgtctggatgggtgaaaacatagtctgttcaggatttcacactgtctacactttcaggcatctagtggggctcttgtgatgcatgcgtctcctgtgtctaaggaggactgctggtggttggtggcctacacagcaatgcatacctgtctcggcctctagggggcactgtcaagctacttttatgtacaatgagtcattattgacgtagttagaaagtgcctggaatctcagagtccttcttgattgtttcaactcttaggggagagataagcattcttgtccccattctataaactgaggtaccaaggagcaaagagtagccgtgtcttgcctacgcccatacagcaaaatcagttcagagacatgaactggctctgtggccagaattcctgccttaaatcaccgtggggccatccagttcggttctccctcgagtggcattttgagactaggagtcttgcctttatctagttgttatatttactgagcaatcccctcgtttccgtcatcagcaggcggtagtggagtctatgtcgtcttctgaggaaaaggtgtcaggttgagtattccccactgccctcagatggtttgattagtgtctttgaccaaagaggaggaggggtcagaatcacagaagaaagtttcgagtaaacagaagactatatagcctttatttgatcttctccccctaggccgctacatacgcaccaacctgaacatgcctcacagtttacctcagaggagcggcggtttccgggattacgagaaagatgctccaatcactgtgtttgggtgtatgcaagcaagactagtgggtaagggctctctgtgactgcgtagcatcttctggctccttcaacagagctgcaccacgggggtgcaaacacgctttgtgggacttccctttttgtttgtttggttggagacagggtcttatagaccaggctgccctagaacatcagatgttcctggctcagccatctgaggactgggattgcaggtaggctccttcctgctggttgcagatgtgtcccccgctgaggaatgagggaaggaaggtcaggtttggtttacttactggtgtagtagatgttgctagctcatgacagcagcatctgccagcgtggtataagaagatgtgaggctaaggaggcggtgcaggagcactgctgaatctgtccagtgatgttttgaagctgttcagtcctttgaaagtatttctgtactggttttaacagttgtgcagaaaccatgctttgtactctaaggtcatcatttactttgggcaagttcctggactaggtaacagagactcaagggtgaagttccatggaaacacacgtatgtgttgtgggtgactatcaaactataaggctgactaaatagcaaactctacacagagtgtgagaagaatattaaagaaagacaaagggtagaatgaaacaagagagggatgaagggaggaggaagaaaggatgattaagaggcagggtgaactggggcctccagtgagagtcatctgagtgaagaagagggagaggggcctggttcttggtgtggaggacaataaacaaaatcagaggtcagacatagcattgagagatccctgcaagacatggtcagtgagttctctctctctctctctctcactttctctctctctctctctccctccctccctcccctcttcttcttcttcttcttcttcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcctcctcctcctcctcctcctcctcctcttcttcctccttcttctccctctctctctctctctctctctctctctctccctctcctcccccttcataaatatgtaagaataagtagcatcaagcgtacaggggatatgagctcttcttggttttagagcagaggttgaggcaggtcaagagaaggagctagcaagatgagcaagtccatggaagacattgacaccacatgaagatacttaaagtttatattgtagagaaaggaagtgatccacacaaggaaacaaacagtaaagcattagagcagtggatgttgggtttggacagctgagattggggctagcacactggaattgtagccatgtctgactgttacagtatcagttctctccctggttttagcatcttccttgtagaggtcagagcattatcctttgtagcctcccttaacagggcattttactgtgtgctggcaccagtaagaaggaaaggaaaaggaagaggcccgttgtttggccctctccatggatgcactattgaagggcctgactactaggctctctgcaagctcctactgggaaagagaggattatgggtctcttgacaccattccagtgagggtcaggatgatcagtcaaccatcatgctgattgtctgttgatttactcggcaggtgaagccttgttagaaagtaatactgttattgatcacgtgtattgctcaccatccctccgctgcgttcagactgcacataatatattgaaaggtaaggctcttggctggacagaggttacgcgctccatccttccgcttcctgccccttactgcagggttatggggtttcaaaaacagaaagtttactttgtttttttgtttgtttgtttgtttgtttttgagactgggtttcaaggtgacatgtagcctaggttatccttgaacctacagcaatcctcctgcctcgtcctcctgaatgctaggatttactggcttgagacaccatgacttgcagaaatctagaacttttattgaggtttcttctgcaaggtgacaaccttacacagtataatccagataaataaagggagaatattactatgttttccttaaggattttaagctgtcttagatggattgtggctgaacagaagatttataacttttacagagaggattccttttgcatttaagcagtgagacgatcttgcctgatttctagatattttctgtagtaactgagttgttgagtgttccacaccatcaccatcttagtttcttcagttaagtggaaagagttattcattcattcatttattcatcctttcttttactttttgagacataatctgactgtgtagacttgattggtctggaacacactgcatagaccaaattggcttcacactcacagaaatccacctgcctctacctcccaaatgctgggatgaaaggtgtacaccaccatgacctacaaattggatggctgtaagagctctgaagctgtaaaagcactcaatgttcaccctgaaatctgtggacatttgcattggggcaatctcccttcgtgccccattggaaggaagactggccagacaaacaaatgagccagaaataaaaaaagccagcaaagacttggacacgacacttgagtcctcggttcttcaacgtttagtaaaccttcctctcggtagagaggcctctgtgtgttaactgcacacagagaaacaggactaaatcacaaatataaggggaaaagttatactccgagggaatcacacgaggataaaacagggcttgaacactgtcacatgtaaatgtccaacatgggggtccctgataaacaaagcgagtaacagatgtaatgttcaagtacagtgtaagctactacgcagtagtcggtgcctagagaacagctggagcttttgagttgagactttgttttgtagacatcaaggaatttactgtagagaggagagttggaacgtagaaatgagttggggtggtggtgcacacctgtaatcccagcactccagaggaagctgagacaggaggattgagaacttgtggcaagcctagtgtacacagcgagacttttgtctctgaagtcaaagagagagtcacaggcttggacaaattgagtaatgagagtggaagggagagtttcttttaaatcaggtagcagccagcatacaaggtcgaggtgcagccagagtaataaatgcacatgttgataaaacagaaattttattttacttctttaagcacatgctttacatatagctatgcaatttacatattaaataacactgtaaaacacaagttttacaaaccttatccaaacctctgtgcttccgactttgtagttcattaggtctagtaggaatggaataactgccttgtaatttaaaaaaaaattgagattgtagtataattacatcatttccccttcccttcgctcttcctaaaccgcccacacacctgtccctgccatccttatgacttcttccttcattatttgttacatatgagtgtatatttctaaatacataagtacaacctgctctgttggtacaatgctacctgcgtgttttcaggactgagcatttagtgttggacagccaatcaacatgcttttccctggagaaggctgcactcccacgctgagcattccccagtcacccacagttgtctagggttgagacctcatgggtctcctccatcgtatctgttggtgtcatccttgttcagcgcatgtttaggtggtcatgtttgagaaacgtcatgggtgaggcttctcatgttcccaggagacacaatctggtagcaaactccctgatgctctgttttctccaatctttctggtccctctttcacagtgttccctgacccttaggggtgggagtgtttatagatgtatccattggggctgggctcctcaattctgcgtttgattagctgtggttttctgtagtagtctccctctggtgcagagagagatatctgagtgaggggtgaggacacacgtatctgtggatatttatgtgggtggggagtgtgttggtttagtaaagtggtaagttgtaggttctcctccaagatacataatttcactagccctgagcacttggctaggcttctggtaccaggcatggtctccctcttgtttaagaagtccagttagagagctgttggttgctgccacagtgtggatgccactactacactgttagggttgctctgacatgctcatcatcactatggctcagagacactatagctaggtaggacttacggtttcttccctcctttgaaagcttgcatggtacatcctggtctaccttatcatgttttatatcagtttatcctgtggttcatttttccattgggactcttctcatcttaatcctacttcatccccaaggtttacaacaagacaatcacttgaagattcgagtggagccgggcttatttgaatggacaaagtgggttgctgggagcacattaccagcatggatacctccatcagagttagctgcagccaacctgagtgttgatacaacctacaggtaactcttgtttccttagggccccatgtcttgtactgtcaccagaccatgttcaataagctgatgataaacctagcaaagcctacagggaattcattgtggtagaaaccaagctatgattttagaaagcaaaactgggggacatccagtgtttacttttatttaatattagtataagttatactccttaccccacccacgcttgcgttcaaatttcctaactttattatatctacttcaatgtaatagtaaagccattttgtatgttaggggcatacacagagtggtcataaaacagctcagtggattagggacgtgacagtgtgtcaccttccatttttactttaaattttccaaatcatttgttcttttatccttttgagatgggggtctcattatgtagcccaggctaacctggaactatgatgcccctgtctctgtctcccaagtgctgtgactacaggcatgggccaccaatagatttttaattcttctttctatgctcatttattacttctatgatcccagaaagtaaaagtgaataagatgcgtgtatgtgtggagtgtgtgtgtgtgtgtgtgtgtgtgtgtgtgtgtgtgcgcgtgcacgtgtacacatgtaaacactctactgagctatgtccccagcccagagagccatttttatttatgaaagagtccaagtggcttgcctatggtaaaacatttagtgaccatgcatagaaataataactataacattattattgtaaaaattgacatctattaatatctattactatttttccatgtgttctgccttggattcattctcctcctgatccatttctgattccactagacatactctgtgcttggtcttttgtttgtttgtttgtttgtttgtttgttttttgatttaatgctcctaggcaaacaatctgcatacttggtaaagaattaaccaaaaataatacagtgataatactattcaaaaacccacccacacactgaggaaggccaggtaattacaaccattctggtagggaaattaaattcctctgtcttagagcatgttaaagtaattgcttaccccgataagcccatataaaaaacggacaacccagttattatatttataagctatatgtctagattgcgcagctctttcacgatattgatttattctctagctatgagacctcttgttacttgtggcttctccagtccattggttctactccatcttccttccaactccccttccactgttttccaagacctcctgccccacccttcccctccactggccagtcatcagctctactcatcatttgaccaatcagaatggggagaagactcagtgaggtcacctgagtatgcgacccactcctcattgggagcagcccctcttgaggaagcagaattaacatcaaaatacaaaccgcaccaggacaacccacagcaagagcagaatttggcagagtgatcagtctgcttggaatagtccttcatgtactctttgctatcctctcctttcaaataccttaactatgaatcatccatagaatcactgggcaagaactaagataacccagccactcagcccagtggctgctctgggtcttaacattatctccctggcatatattaaattggactcttcactataaatgtcgcactttgctctgttatctctggctactctttttctttttcttgggggaaatatcagtagaatactgtccccataccaacagctgtcacctttctggcttgttactgctgacactggtaaagtaacttttctctctctccatccagccctgtccaggtcatgttcagatgaccaggttttagtttcctgttctacaacatttcccaagatggcctacaaagttctgcaagtgcttctttgctgagtcttttggcgtatgtgggccacacccatcagttgtgtaggcaggatgaaggctgggaattcctggatcaagacatggttcttgttccaggtttccttttcacttttaaaattcagtgtaacaggcattaaaaattctttaccaggagagcagattgtccacctaggagcattaaaaaaataatagcctagcacagagtatggtctaatggagacattagatcacaaggatgatgccaggacagaacacacagatcctgacacagaaaattgtctgtcagttctgagtgggactagaaagtctctaatcctgtgaaaaagttgagaaagcccatggtaaagcatatgagaggcttagagtagacatcaccgcggtgtcatcacagaaccgaatgagtagatctgtggagcgagcaaatgaaactcatatggtgacatggagaacaaccccaaaagtcagtattatcaaaaccaagtgtgctctgctcaaatagccctgactctggggctcagtggagaaggccatccgctgctcttgcagacctcagcttggttctgagcacccatatggttgctcgcaattgtctgtaactccatttccagatgatgcgatgcctcttctgaccacttcatgctctatacacacgtggtacacttactatacactcagccacatacacatagaattaagtaagtaaataagtaagcaaataaaaaggagtcttggctgcttgcaacaaggaccatacagaacaggagggaagggctggaggctgagtgagggagccgtcccaggctagtgactcatatctcaccatcatccacaggaacaagagcagcctgtgggctgtgggtagaaagaaggctagggagctgggccaagactgtagagagaaacacaaaaacaaaatattctaccaactggcaagcacttcagagcagggtacagggagaagggggacaggaaagacagaggactgaaggatgtcttagatctggcgagtgagtgaggtaagctcaaggcaaaagcctgaactacagttggaccagtataggttggagaagagggtagccatgggagaatgcttggagaaccaacaaggagcacttaaactgtaggtagagacgtggttgggagttgacctgactctaacagcaatgcaggaccttataggtatagctagcagtgagataggtcctgcttataggagaaacttagactttgtcccatagccatcaggacagccttcaggatgctgggagaagccaaaggcaagagcagataaggagctaggtcctagaatcccatttttcatttacacgaatctcaaataagacaatgtggtctcagccataaagtgactccctgaccatacaatgtggctttttgctacagaatgaggagaagggagagctcctgggagacaggataacatggatggcagtggagtcacataagaggtggggtggaaagaggaggccaggaagaagagttcattccagaacaaagatgttcatccctaagtggtggtgacccctgcctctacctttccttcattcagtcaggtagtgagaatcaggaaactttctctggggagaaatgtgcctgctgaatggttagaaaaatgaggtttcctccaaacacaacagaattaagcttcctgatagtaaaatagagaacggaatgggcggtcttctaggatggttggttggttggttgggtgattggttggttggttggttggttttaggttggttggttggttttaggttggttggttggtttgttattcatttgtttatttggttggttgattggttggttgattttgggttggttggttggttgtttggttggttagttggttgattggttggttggttggttagttggttggttggttggttggttggttagttggttgattggttggttggttggttggttggttagttggttgattggttggttgtttggttggtgtgttattcatttgtttatttggttgtttgattggttggttgattttgggttgtttgtttgtttgcttgtttgcttggttgaatgactgacctgtgtatttgagagagtattttgctttgtaacacaggctggccttcaacttccactggcaattctcctgcctcagccctgtgaaagctgaaatttcaggtttgtgttggcatacccaactaagatgagtgatcttgaagaaaagcagaagctgccctgtttaagtaagaggttcagatcactgggcacatccaagactcagattcagacctcagctccaagagttactaaagactcaaacaaattggctgtcaccttgggacctgctctgtcacttagaggcttaaaatttttggaaatgttgtgaaaagattatcctagaagaatgcaggcattgcacttgcatatacccccacacgtggaagcccctcagtaaatatttttagcactaattttaacagtatataatttacaaattataatcaagatgtcatgtgagattagagaacttagcaatgcctggaccaggttccacacattcaacaattaaaggcatgggaaatagaaaaggcataggatgtaagataagacaaacatctcctagatcaaaacatctataaaataaaaggcgagtgtaaacagaacaagatgggccccaaggggctggtcaacatggtgagtgctttgatccctctcttaaaagtccttgtagatggtatcacagctatggtttccatctatagcctccccgatctggttcacacagagagcttctcaagtggagatattaattcatcgttatgtccctcaggcttttcctagtgctggatgcatggtttaaaataagacacaaagagaagggagtggccaatggaggtttcataaactcacaaatagatgggcagcacaactgtttttcaaagctctccttgcagctcactgtgacttaggctgcctaagagagaaccttggacatcccaggtgatctatacaaacggagtcaatcagtctcccccttgcttcctgttagccatgtgattaggcctcttgatgactattaatgtcaagaataagtagtcagtctgctcaggtgtgtccctgtggataaggcattcactcactggatcctttgtttttctgtcgagtcacagtggtaccataatctttcaacctcacatccatataatggaaagtctcttccttgggcctccttcctttccagagaaatggataagcagaaataggggctcctctgagaggccttgacatatttagaatgatgtcattcactttatctctgggtggaagtgtcaaaatgtttccttgttctgtttgcctttgcactgtagacctcacattccagtcagcaaattggcgatttcggaatcctatgacacctacatcaataggagtttccaggtgacgaaagagataataagtgaatgtaaaagtaaaggtaggtggcattgtttgggactgtccatttaaacatatttaggtatgggaacagctctccttcatgcttgatgaactggttgagatgtctgaatttgctttgtcaactgtaatagaagacaaatgtccaggctctcttggagttcagtttgtgataatctttgaggatctaacatggaagttatcatacaggaacccagtagatgatgccattaccacattaagtaacttggaatcggtattgtatctagtcatcttgtaccttatggaggggatacccagctgtaattcccagaagttccatagaataattccatcctggtttacctacgatgatccgagatgggaacacctacatacaaactcacccataggaatgtatgcgtacaagggccctactgtcaccagccaagagcagggacgggtgaggctcaagtctatttgcatcttctagagtctgatctcaaatagttgatggcatataggaccaactgtccaccatgactcttaggttaatatatttatactctggaagcaaagaatgcagctggatccacaaagatgctaatggtgggtagccatgggcaaccgaggaaggaggattccctcattacaattattactgatatgctactttgaagatccatgaagcgtgctctcagctatagggtctccagtgctcacaattctgcagtggtgacatttaaaactgttccagaggggctggctcagggggtctgccaccatggtcggcttgtgtcttgattatggtaatggttacacagagatatggtgaggacatcaccataaactgtatgctcacacacaaagccgccgtgctgatgagcctggtgagatcagaattatgactggtacccgtgtccatgttcatggttttgatggtaaaccacatcatgaaacatcaaatcatggaggaggctgggtgaagggacctgagacctccttacaccagtagggtgattatctctactttatcgttttaaaaataatttgtagttctttttaaattatcatacagtgtattagatagtattaggacattttcaaacgacatgtgttttagtagattctcctgccctacattgacctattttgttgcagtgtccaggaccaaacccagagcattctgcatgctggaaatgcccatccactggactccatccctcgacttccttagatctgttaattaatacatagcaattgtacatattcatacagtgtgatttcaacatatgcatatgcgatgtagagtgagacagccactgcagtgaacctttctcatttcccaggaaataacattctgattgtggcccacgcatcctccctcgaagcgtgtacctgtcagctccaaggtctatccccgcagaactcaaaggacttcgtacaaatggtccggaaggtatttctgtcttgcatttattgggccagtggtgctttgtttttataactgttgggcaattggctaaaagctcatttccttgaagcagaattttctgctgagccgggaagactcagttactgatcaactcagccaagatgtgttcagtggagcttcgtagggtatttgattagaactgtataaaaagaaggtttttttatggaggaagctgagaactgtaagggatgagggaacaacacaggcaagcaggattacagctgagatcttagcctgaagagagggcccagtaggcagaccagggaagcagcaagtgagaacaaccaggctgaaagataaagtcaggaccaaggcaagaccgaagccctaggaggctggcctatctggagtcttctttctgcctgtattttccatcagccacatctcacacacacctcttcaggtgaggcagctgtcttctttcccttcaaacagaaattctagtacaaattcaataatcacagtgttcttatttttaaaagaggttcacttaggcaagtggccatcccattaggctgtaacctggggggtggggggtgggggggcgggggtggagaagagcggttggttgtcttgtttatgactgtggctctggacagagaacacagaagaaataagctctgacttgccatgacagcccatggtttcttctctgaatgtcacagatatgtgttgtgcccccaccaaaagataaaacaagattttttttttttgactgaataatcagctaggtgtggtggcacatgccttgagaaatagaagctgaatgatcaagatttcagggccatccttagctacataatgagttcaaggccagactggattacgtgagaccctacctcaaaaaccttggatattccttcccattgcgcacaaatttaatgtgaggagtcattggtctgctttttaaactcgatatatgcaattggaggttaactggtggtacagctgccttcctctagtctgaccctaaccctgaggtcagctgtgctctgaagatacagtattatacagtaagatattagcagggcaggaagtgggtatgttcacataacttctgttatagtatattgttaaaaagaaaaggttctattttatttattattggtgttggtcttactgtgtctagtttataaattaaacattgtcattggtgtgtaaatatagggaaaaaacatatacagggtttgatattatccaaattttaggcatccatgaggaatctaggctggctctccgtggttaaggcagtaccatgcatacttcaatcctcttctcccatgctattagccagcaatctctaatcatggggtaggggtgctcactgttggccaaatcctgctcatcaatttgaatgcttagcctgacaggttctatctgtttggggttgtttgttacgttttggaaggttttatatttctgcctgcatgtcctggaaacacctgagtacctgtgtcagtacagaagttaaggcattaactcgaggtcttctgttttccctcctctgatgcgtttactttcagatcccatacctaggcttctgttcctgcgaagaattgggagaaactggaatatggcaactgacagacccgcccatccttccccttacccatggccccactgggggcttcaactggagagagaccctcctgcaagaataagctgcctgagagctgggaagaactggccttttgcagatgagtcctcaggatgccctgtagcagtgggaaagcccacgctgcattcaaagcagacagctcagaatcatttagcatatttcttttcatgcttaggggacggtgagattgtgtcaatgagagaaagtcgtgattcagaggggaaattaaaaaaaaaaaaacaatccatctctctggacttgcctagctaccaaggctttggagaagtgtcttcctaggctgagcacctgatgcagcagaaactaccatcctccttcaggctatgcatggctaaagagcctcattcttctcccagagagctgctccctcccggagaggcatgcaagaggaaggactgtgtctggaatccaactggggagaggatagtctttttgtactccatttgcaagttagggaaagccacactgaggagtgctttgatggttgttagggaccgtaagaatagtcctgtgtcagacagcagattctaccctcagcagactccattcactgccgctgtgaggcacccacttgaggtctcccgacattcaccctggtaccacaccacttgatctccagagcagtctggcccttcatgcttctatctgtgaaatggggagaacagccctttgcacgttgagatactcaggagggatcgagagaacgagtgatgtgtgttgaatgggaggtggagctacttgcagaattttaaccaagttgaaattacccctgtgatggccagatgaactgtgaagtccccaagcctgcctgaatcaggacgtgtctctccacccagactctagactgtgttaagcagttaaggagattgacatttgaaaggatgttatgttggattcactatttggatcagcaaaaaacaaaaacagaaaacaaaaacacaaaaagaaaaaaaaaaaaaactccagtgcaatacagatatttttagaaactataccgagggtcgtgttgttggtcacatacaggccacgtccactgtagcagaatgtccataggttagcccgttttaggttgtccaggaagcccagggactaacgtgaatggtgacagtcacaactgcactgcttcttttgctgccctctttgcttttctatggtaatttagaacagacgggagggaggaccacttgaaggaagctggagagtcagagcctatctgtgggctctcactgcacctacttcctgtacttagagagagtgtgtgtatttaaaagaagaataaatgacaatcaaaccaaaacatcccatatccatgtcgatttaattgtgtatcccgatagccatcagggccacagacagtagcccagttcgagatagttcgttgtgtagcgtgtgtgtgcaaattgaaaccctggccactgagaaggaacacagatgtaaaacaaatgtgtcgttgaagcatcacattgtatgtgcctgtatgtgcatgtatgtcttagtcttaggtgttcaggtaaatgcatcactttgattgggctgtattccattgtccttaatccaatatagacagcgtcctgggcaactgtctacagagccagggagggcacaatctgaagtaactttctgaagaacttaagtggataacagaaaagtttaattctccaaattgcttaccgaaatggctgcgtgatctgaatccagttaacatcttattggacactggtctataaaaagaattaaaggttgggtccagttgagcagtcttgggagtcacactgaatctgtgtgtagagagatatctggatagtcagacttcatatgcatacagaatgtctctgctggcagtagaccctgagttgaggctagctctgctggcagtagaccctgagttgaggctagctcttttcaatctacagctcatgctagctcagatggtacctggaagaagggatgggttagggacagagcaggaaaaaaaataataattttttcatcacgtgactcccccaacaccctttttttttttttttttttttttttttttctttctttttggaaagcattggaaagccatctgaaatatttcaggggagatgaaattagtggaagggtttaatacgggattacaagtccaaacagtgtcctacttcaccaagtgtgaaaatgctttagtattactcccaggtaggactttgtccctgtgatttctgggtgtctgactggaacaattggtgcgtgttaatacacacactgaggctgcccttttcccaggctcttctcactgctgcttggctgtgagggaccctttggttcaccctggggtcccagtaacattcagatgacagtgtctctttccctttgcattgagattcatgcagcctgaatggctcattacgtggccatcttatggctgaaagaggggttttttttttttaaccgtgtgatgaaaggcttgggaggctttttattttaattatactttaaccaaagagttgttttaaagtaaccttatatttgaaagatgattttgcaaataaagaaataaaaataaaaatagaagaagtatgccttctggagccctgtgggcttggtaaatcgctgatgatcgcttcctcgccagttctgtttggagtccatgtaggtgggatcctgctgtgtgtagcactggcctggatgtctcctttccactctacctgtttccctgtgaaaatgcactcttacttcagttatctgatgtcatggggaacacagtggcaacaggaagagaaggtcctagctcactgcctttgtagaaaacttcgtttctgtgctccaagaacagaattcctctgttacctaggcgctgggtttcatttcaaagcagtggtgaattgctcttttgaatctactctcagtatatgcgtgtgttagaatacagatgagcctcccactaagtttcacaggcatcggcacagtcaactgtaccaaatctgcacaaagttggataatgagactcctggagatttgcatttaaattgtctaatccggcacatgcacgtgaggaggagaaaaaggggggtctagtctgatgagcctgtgctgtcggcgggcaagggacaacctgacttaatgtctatttaggagctgttcatgttacaaaggtgatgggggtggggctgtgtggtgcttttcatcgttaaacacgtctagaattggattggcttttgtaactcttcatcactggttgctgggagggtgactgtaggcactgcctctcgatgcagaagaaatagctgggctgttacatacatatagtattaggtttgctgtgtgtaggttaaagatttagagtcactagtagtcagacaatgtacagtcagtcctcacagatagttgcctgctgctccctagccactgttccttgcacagaaattttgcagctgttcaactgttcatggaaacctgtacgggatacatgttttaaacggaaacaatgtatactggttctttggttgccactaagataaaaacaacatcccagagcctttgactcctgcgcacaccacactgaaccggctgtgttaggaaggcatgttagtctctttctcacgcgtgagacttttgtgtctcttttttgctatatgatttgggtgtatttatttgggggaaaaaaagtttgtaattataagactagaaaaccacacctagttggtctgccaagttccttgtacactccccatgctgttcgtgcttccatggccgggaagctgatcttccgaatagagctatggcagctttgtgatcagttcatatccactgacctgatatggttcagagatgacttaataaaaagaaactgtgccctcagttgccccagcacaactacaaatttaagtcctgagtgtgttctcttcctgttgtgtcttcgcatggtactgtaaagtgatcaatgtgactgcgtgggtgtccattaagggtatgactcttccaacagagagtcagagggatgctagctgctgatggaaaggcgaggaaatgcttgcagccctgtggatcttgggtatttctggtgaggcatcccgattgagaagtgagagcccagtagtcctgggcagagtgcactcttcaatgccttcggttcaacctaggcaaaccgtgggccaccctatacctttcagtcaatggatcctaggttcagagctaaggctcctgggacaaatacaaattaacaagagaaaagtagacaagtttaaaagttgtacagcatgggaaacttcacaaagaaatcgccttacaatcctcagtacacaatgagaccgaaacacatatatgtatataattgcttattggtatttgagacagagactcacatagctagccttgaactagttaaaccactgaaactggctgtaaatccctgatcccctgtctccgtgccccaaagctgggattgtaggcacacaccaccacacagggctaaagcctaaatgttttaatgctaaatttgagggcaagtgaataatgctaaatttgagggcaagtgggtggttgtaaagaaatatggtagagcaacgaatatgatttttgtgtaaggatctgcctggcactcgtatcacctgctcggtttctccacagtgtctctttatcatcagagacacgaaggcctccttttcccagttgttggaatagcatctcctatgagagggttctcctctgcttaggagagaacagggtaggtattagaagtgaccttcccactgtcacttgcagactcctttgttttataatccccagttataccaaagtgacatatttgaggggggcagttctgaaccccattggtatcatcattccccaccaatgaccatttcaagaaggtttggtgtgtcaggcatcatctatcaagcaagaatatgaaaggcatgggggggtggagaaggaagagggggcacaaatggagcccaagctacattctacactcacaggctccatttctgaactctgtgttaagctaataagattttaaaataaacgctgatgaaagcaaatttgtgccctggacatgaatatagatttccatcctcacagccatccatggccctggcaggatccgcttcctgaggaaatgtgacagccagtgcttggagtctgcacaaaagaccaggttatgtttagccttctggctggttctcagctgttctctgcttcaaagatccctagacttattttgcccttttgtgttgttgcaaaaggtggctacacatccagaaaggaaaaacaacaacaacaacaacaaaaaatcagccagcgtgctttgcatctgcttaagctgacctcagcaaaatgcgctgcttctcctgtttgtgtgggttggtttcgttgttttattcttgtgtcaggaccctccctgcaccgaaaacatcttcctctcgaagaaaaagaatattgcattttccagaaatacacacgtggaccccagatgacttgcttctggctaggaaaatatgtcctggcttggtcagcttttggttgtccttgtgttctttgggccgtccaggtcaatgagtcggcaggggaaaggccaggcggtagtaaggatgatgcttccagggaccaaagctgggtatggcactggctcaggctggttgctgcacgccttcaactcacctcacctaagaatgagcacaggaatggtcctttttcctcccttatgtcttattatttttaaatttcttccttcttttcttttgccagcacattttaaacaaccaaattggaagccagggaaggtggtggctcacgcctttaatcctaacacttggaaggcagaggcgggcagatctctaaatgttcaaggccagcctggtctacagagtgagttccaggacagccaaggtcacacagagaaaatctgtcccctctaccaccaccaccaaaaaattaaaaaggaaaaaatttttaaaaataatcaaatgggaaaagggatataaaatacactaataatatcaaaatgtaccatacgaatacatagataactgcttttcttttttttttaatttttttaagacgaaatttattttagcgggctgtcttggaactcactctgtagaccaagctggccttggaacttacagagatctatctgcctgcctctgcctcccatgtgctgggattaaaggcatgtaccaccactgccctactaatcacagctttttaaaggccaagataaaactcctcatggatggttccacctgcctggaaatgtgaagggtgaggaatgaaagcctcattcttaaagataccttctctctttttttccctgtgagtggggtttcgtaaaaagaggatgagtagagttgctgtgttaactagcttctgtggggatcttgttgtaatcgtgattgaggtcgggtcatttgtacaaggtaggctctcaccaggcagcctagtctgccctcaaacatactaatatcccctcgtttcttcttccagactgatggtacagtcatgtaccacaagtggtggctgacctcacgtgaattttatttagaaagttgcttgaacaacccataattaaaattgtcttcatttgatcttggtgataagtttgcaaggtaaacagaccaggtactatggtgttattttacgaaagaaactaaggaggccaatgagatgtctcagtagggaaagtgcttgaccaagtgcaggtgatgaggcaggctccatccctctcatgtctactgttattcatgctctctgctgctcctgagaaacatagtctggatccagaagggatttcaaaggctgccagtcaatcttagaaacccccacagcaggttttacaacagttcttgaagactcctactccaagtgtgaattactagcagtgactgctgggaaacaggcaatcccaccactgtgtgtggttaggaaaggccagagttcttcacaagagcatgaaaggtcaacaaaagaagtgcaggccctcttagaactacttaaaaaaaatcccatagtgttggttcatggggaaatccccttttgccctgagcctacaatgtccatctgtggcctatttaatagttctctctgaccttttcacctcccacaacgggaatgacaggcagtggagagagaggttgctttttgtttctctatggtctggccctcttcatcttcccatccaatgttagtccctgggagtaatgtaatgaaacacaaagacctcatggaatggaaaccatggtgacaagttggtggacactctctccttgaccttctgtggtccttgtagagaactgtggccttttccagaatatgtcccatccaaacatgactctttggataaggatgcttttgagcactgtaggcacctaagaagaagcagatagaaacaatcaacaagcaaataagtagtctctgcccaccccattactaaaaagcaggcatctgtgtattaagaggccccccttcccaggcctctgaggatgcagttactggacattcaggcccttcccagcctccagagggcccctgagggactccctaagatgttccttccccacacatcccttacagttgttgggtgagactagccatcctttttagtatattgcgacctcagtaaaactccgtggctcaatgctgaaaggcagtcttagaattgtaaactgaagcttgcttgctcgctggtgcctcccttgcacatgtccatatgaaatacacacaaagacaaactacttctcttcccactctctcctttgttatttggttccagctaagaacttagaaaagtatgggaggaaactgttttttgcttttgaggcctcccacctacaaggcccattcgtgtgcgcacgcatgcatgaacatgcacacacacacccacacacccacacttcactgcagaatagttgaaggccccccttggccatgatcaccctgcctcatcatttctctccactcactgaatggtcatagtctgtaattttcccccttggggacacttgtgggctgcaggctgaagcacagtttatgagtgattaggaaggactttgcagaccacaaggacatgtcatacagcagctcactttgcagtatttccttcagggacagtacacttttttccattaataaattcatgtattcactttacagccctatcccagcactccctcctcccagtcacctctcacacagcccctctccccattgtcccctttccctctcttctgagaagagggagacacctgctgggtaccaacccaccctggcacaccaagtcactgcaggactgggcacatcctctccactgagaacagacaaggtgggaaacctagggaaacaggatccacagacagacaacagagccagagacagcaccccctccagcccgctctagttgttgaggaaccctcaagaagaccaagctgcacatctgcaacatggggggagggcgctaggtccagcccatgtatgtatgctctttggttggtagttcactctctgggagccctcaagggcctaagttagttgactctgttggtcttcctatggagttcctatccccacgtgtccctaggtccttccccaactcttccacaagacttcccatgttccatctaatgtttgactgtgggtctctgaatctgttttgtcagctgctgggtggagcctctcagggaacagttatgctaggcccctgtctgtaagcataacagagagagtagcattaatagtgtcagagattggttcttgcccatgggatgggtctcaggctggactggccctcagtctccgctctgtctttcagggaaagttcttaatctctgagaccaatggactcatgcaacattaaacaaagttttattgttgtttaaagattcttttaattttaaattatctgtatacatgtgtgtgctctgtctctctctatctctgcctctgtgtgtgtgtgtgtgtgtgtgtgtgtgtgtacatgtgtatgtacatataagtgaatgtgtctgtggactccagaagaggacatcagatctccctacagctagagtaaccagctcatggcttcagacacacagccaatcaaagctagactcgtgtgtggtgtggtaactagagcgctgttcatttcaatcttggagatcagggaaacagctagggcagaattggagatgaccgtgacctccatgtcccattcctactagtctatgtagagcagctaagcaccatgacccaaaggctccccaaccaacacaaaccagctgcagacctagtttaaaatgcaacagccagccagagacattccatatttaaatagaacagtaagatctttaatgctctagaagaattatgtcaagcatcatgttagactttagaatgtaaagagtagtgttggggctggagagatgactcagagactaggagaattgactacttttccagaggacctgggttctattcccagcatctaattataggtaacaactctctgaaactccagttccagggggtctgatgcctccttctggtctctgtgggcaccaagaacacacaaagtacatagacatacatgcaggcacaacactcatgtatacaaaaattattttttaagaaaaaagagtgtttctcaagcagagagtctactcagctgtccagtcactcatgacaacctcctccaaatgaaatagtctatctcagtgaatgagagaaatgaacctaaattgtctattcgcatattttaaactctcatcgtaactaacacatttttcttaaaaacaaacaagcagagaagggacttttgtgtcatgtctgatcatcttagtgaggcatgtaagagatgttggatgcatagagaggagagggagtgtgcacaggtggggagattaataagtagaccaaaagacagataagtaggtaaatgggaagattccgaagtgaatgaatgaatcaatacatctaataaccactagatattgttgtccaagtcagaaatacaaaatatccaagaaggttggacaaaaattacctagctattgtttgcttagtaaagtagaaaagctaaaaacaatgtccagacagagacatttactctctcctgccctctctcttcccccagagtctcatgtcatcacttgccatggctacccacttgtggctgagcagtgtttgtcaccaacacctccttcacacctctccacaatggataggacacctgtggttccccaagatgttccac

SEQ ID NO: 1532 - DNA, 1536 bp, Mus musculus
agaagtgcatgtggagcctcataagaagcagctgcatgtgacgctggcctaccacttccaagccagccacctacccaccctagagaagcttgcccagaacattgacgtcaagctaggatgcgactgggtggccaccatattctctcgggatatccggtttgctaaccatgagacgttacaggtgatctatccctattcacctcagaatgatgacgagctggagctggtcccaggggacttcatcttcatgtctcccatggaacagaccagcaccagtgagggctggatttatggcacctcgctgaccactggctgctctgggctgcttcctgagaactacatcaccaaggctgatgagtgtagcacctggatcttccatggttcctactccatcctaaataccgtatcatccagctcgctcgcgtttggcgacggagcgttagagaggcggcagtatgaagatcaaggacttggggagacaacacccctcactatcatctgccagcccatgcagcccctgagagtcaacagccagcctggaccccagaagcgatgcctctttgtatgtcggcatggggagaggatggacgttgtatttgggaagtactggctgtcccaatgctttgatgccaaaggccgctacatacgcaccaacctgaacatgcctcacagtttacctcagaggagcggcggtttccgggattacgagaaagatgctccaatcactgtgtttgggtgtatgcaagcaagactagtgggtgaagccttgttagaaagtaatactgttattgatcacgtgtattgctcaccatccctccgctgcgttcagactgcacataatatattgaaaggtttacaacaagacaatcacttgaagattcgagtggagccgggcttatttgaatggacaaagtgggttgctgggagcacattaccagcatggatacctccatcagagttagctgcagccaacctgagtgttgatacaacctacagacctcacattccagtcagcaaattggcgatttcggaatcctatgacacctacatcaataggagtttccaggtgacgaaagagataataagtgaatgtaaaagtaaaggaaataacattctgattgtggcccacgcatcctccctcgaagcgtgtacctgtcagctccaaggtctatccccgcagaactcaaaggacttcgtacaaatggtccggaagatcccatacctaggcttctgttcctgcgaagaattgggagaaactggaatatggcaactgacagacccgcccatccttccccttacccatggccccactgggggcttcaactggagagagaccctcctgcaagaataagctgcctgagagctgggaagaactggccttttgcagatgagtcctcaggatgccctgtagcagtgggaaagcccacgctgcattcaaagcagacagctcagaatcatttagcatatttcttttcatgcttaggggacggtgagattgtgtcaatgagagaaagtcgtgattcagaggggaaatta

SEQ ID NO: 1533 - protein, 449 aa, Mus musculus
EVHVEPHKKQLHVTLAYHFQASHLPTLEKLAQNIDVKLGCDWVATIFSRDIRFANHETLQVIYPYSPQNDDELELVPGDFIFMSPMEQTSTSEGWIYGTSLTTGCSGLLPENYITKADECSTWIFHGSYSILNTVSSSSLAFGDGALERRQYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGEALLESNTVIDHVYCSPSLRCVQTAHNILKGLQQDNHLKIRVEPGLFEWTKWVAGSTLPAWIPPSELAAANLSVDTTYRPHIPVSKLAISESYDTYINRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 1534 - DNA, 53742 bp, Homo sapiens
  misc_feature (1)...(53742): n = A,T,C or G
tgccaattaggagaagcagcacaagtgatataaaataggatatagtggccgggcgcggtggctcatgcctgtaatcccagcactttgggaggctgaggtgggcggatcacgaggtcaggagatcgagaccatcctggctaacaggtgaaaccccgtctctactaactacacaaaaaattagccaggcgaggtagcgggcgcctgtagtcccagctactccagaggctgaggcaggagaatggcgtgaacccgggaggcggagcttgcagtgagccgagatcgcgccactgcactccagcctgggcgacggagccagcgagactccgtctcaaaaaataataataataaataaataccaaaaaataaaaaataaaattagccggacgtggtggcaggtgcctgtagtcccagctactcaggaggctgaggcaggagaatggtgtcaacccgggaggcggggctggcagtgagccaagatcgtgccactgaactccagcctgggtgacagagcaagactccgtctcaaaaataaatacataaaaataaataaatacgtaaataaaataaaataggatatagtaacaaacatctttgcttggctctggcatgcatttgcatgggcatattttgcctacctctggactcagttgtgcttctactctcccaccacccacccatgtctccagccccttcccccgagtagtcctgctgacaggagtctgggggagactcagctgtgggtgtagaagagcccagacttctattaatagtaatctctaggccgggcgcagtggctcacgcctgtaatcccagcactttgggaagccgaggtgggcggatcacgaggtcacgagatcgagaccagcctgaccaacatggtgaaaccgcgtctctactaaaaatacaaaaattagctgggcatagtggctcatgcctgtaatcccagctactcgggaggctgaggcaggagaattgcttgaacccgggaagcggaggtcacagtgagtgagaatgcatccagcctggtgacagagcaagactccgtctcaaaaaaaaaaaaaagtaatctctgatagtaaaggtttctttttgttttgttttgtttttgagatggagtctctctctctgtcacccagactggagtgcaatggcaagtgttcggctcactgcaacctctgtctctctggttcaagcaagtcccctccctcagcctcccaagtagctgggactacaggcatgtgccaccatgcgtggccaatttttgtatttttttagtagagacgaggtttcaccatgttggccaggatggtctcgatctcttgacctcgtgatccacccgcctcggcctcccaaagtgctgggattacaggcgtgagccaccacgcccggccccttatgctctttttgtatttcaagggaatgctatcggttaactaagggacaaaactttaccacagagaggcaagctcgcttttcccaagccacacagcacagaggactaagaaggagattttcaaagctctgactgtgcagtcaggtctcattgggcagcattcacagaggaagagaagcagccagatgggacaggtactgtagagacaggcagggtgggcaagaatgttgctctggagtcagaagcagctgagttacaaacctggggaccttcacatagtgcactcctcaagagcaaggccaatgtcttaatgatgtctctgcgtttatttggaccttaaacatggacctcaggtgctgaataaatgactcttgacttgtagcggttgacttgcatgactgtcgtgtggcctgaaacctcagtttcctcatctgtaataggataaaaatgactgctagcctgggagccctcctgagtagtttgctatctgggacgattttcatgcatccttcttgggagagatttttccctccacaaatctcaagctgccttcagtcctgttgccacattgcttaactgagaaagtacagggaacagagaagtagatatctcagacctgattggctccatttggtgactagatacagacagtgtccttcccaccaccacggccaatgactctcctgtcaagagggcgctctgtggagaagcagaaatgctgtgtccgtgagggctgtctggatggcatgaggtttcaaataccatattgcagtcaggagttttgggtactgaatcatgtatttactcatatatatatatgagtatattaaaaaagaaaaagatagagatatatatgtatgtgtgtgtgtgtgtgtgtgtgtgtgtgtgtgtgtgtgtatatatatatatatatttgagactgagcctcactctatcgcccacgctggagtgcagtggcacaatctcggcttgctgcaacttctgcctccctggttcaagtgattctcatgcctcagcctcccaagtagctgggattataggcagccaccaccaggcccagctaatttttgtatttttggtagagacagggtttcaccatgttgaccaggctggtctcaaactcctgatctcagtgatccacctaccttggcctcccaaagtgctgggattacaggtgtgagccaccgtgcccagcctatttactcatatatttacaaaacaaaattaaacatctgaccctctcaagattgacaactactcagtacactgatttatggacttttaatcacaacgtctaaaaccaacccctgttacgggacaaccagagatgacttgactgctggccgttcagggcagagccaccaggtgcatggaggtttctaacaataccagcttcataagtttgtcatgaggtagcttagtccatttttattactataaaggaatacctgaggctgggtaatctataaagaaaagaggattatttggctctcagttctgcagactatatgggaggcatgactccagcatctgcttctgtcaagaacctcaggaagcttccactcatgacagaaggcaaaggaaggagacatatggagagaagaagggagagagagaggggagaagctgccaggctcttttcaacaaccagctcccgtgaaaacaaagagtgagaacttactcccagaagactggctccaagccattcatgagcaatccacttccatgatccaaacgcctcccaccaggccccacctccaacattggggatcaaatttcaacatgagacttggtggggtcaagcaatgccatgccataaaggtttaaagtctgaagtgcctggtacataaagaccctcaattatgatagactcccttatcctcatttttcttctactagagaaacaaatagatggagagtcacctgtgtgccctctgttctcaagatggccgccagccccaggcactctgttgagcagcctcagagcatcctgtgaggatgttcatgactgattcagcagttcacagagcacaacaaaaggctgtggtatttctacctaaaactactttatgaaaaagtgttgttttccaaatataccccaaaagaatacctccatcttccgttgtggcaacaatgaccactgtgtggctggactcttcaaccagggaaaagaggagttgggttctacctcagtttacccatcccccagttcattgccgacttttaaactgattttgagggagaagaatgaggcatctgattaattaggtcatcttttaattgaattcaaactgttaggtgtggaaaatttaacaagtggtatccaggaggttgagaacattttttaaaatattgtagttcgtattaaatgtttccaaatgtaagatcatcttagctacatgaaggaaagatataatttaatattggttgcatagggaatttcatccacttgaaggattacatgcttgaccctgtgccttcccatttcctaagtgaacaagtccttggtcacagagaaccaatgcatggagcaggtacagtgcctaccgccacgcatgtgagtccaccagcaatgcaaagtcaaggacaatacagctccaagtaactggaaagctcaaccaattagttttctacttaattgaatcaaagtcttactattttgagggaatatgtttttcattccgttatcctacatcttgtctcttgctttttactgcaggtgtcagatatttgagttttatcaaatggcactaaaataggggaactctcttctgaaggcatatgctgagcacccctagagaacctgctggtctgggataacctatccctctgagtcggggatgtcttaagtgttttttttttttttgaccatagcattgagtgatttgggagcagaaggtattccttagacaggaaataggagctcaatagatggcccaaaagaagtgtctggattacaaacgcaaagagacaagaaagtgcagtcaagccaacaaagaaaacggcagctaacaagactggttgtgtctctttaatgatacctggtcccactattcgcctggaacaatactaagctcactgtcactgtcacccccagccccaacttgtttctactcctgcattttcattcagagagtgtctccaccacccacataaatattcaagctgcagtgccagattagtctcagctttattcagtcaaccatcgaaacatcattgccaatatcctcattgtcactgcctcagttcaacctctcaatgtgttcttcccacctattgtcaaggccttctagcctcccagcatccagcttatctctctgaaatgtatccttcaatgcaagcaaatctgaacatgcctctctagcttaatttgagatcaggtccaagctctaaagtgacgcataaggcctttgcgagtgatctcccacttacgttttcaggtatctgcaaaggcctttatctttaccctcatccagctttacagttttggccctagcattaccaagcttggattttcctgcacatgcagtgctgtctcttgctttcatctgtttgctggtgccattctctctacttcagatgtccttctgctttcctttctttctctagtcagctcttactttgctttttttttttttttctgagatggagttttgctcttgtcacccagggtggagtgcaatggcacgacctcggctcactgcatcctccgcctcccaggttcaagtgattctcctgcctcagcctcccaagtagctgggattacaggcacccaccaccacgccaccacgcccggctaatttttgtatttttagtagacacggggtttcaccatgttggtcaggctggtctcgaactcctctcctcaggtgatccacccgccttggcctcccaaagtgctgggattacaggcgtgagccaccgtgtccagcctcttacttagcttttaaggtccagatcaagcatcatttcttttaggaaagagtcctaaactttctcagcccacaaccccttagtgtccaataatttttacatagagcctgtgggccaacaaaaataccaacagttctgtttatttagtagttagatctaaacaccttaataagtatttatgtcctggcaacttaagagctgtgttaaaacacacacacacacacacacacacacacacacacacactaaaataataatcacctttttattcttaaataaccacagctacttactaatgggatgtgtgtgtctgtggggcactgcacaactgccccagccttaggatcagttggggcactgccactctcattgcctgttccacattgattttcgctggatacttggtttttattacaacagttgctaaaactgcagcttcaccaagataggacctcaagaatgcagcccagtctgatattgtgaactctaactacctcaagctagaagcttatgtggtgttcaacagatgatgagtattgctgtgtttctcttataacatttaaaatatccagtggcacctctttgagtctgctgtggcgttctgacctagagtagcttggtgtacaatttgagagcctcaggcttgggaactccccactacggaggtgggcccaccgtgagctctcttgacaccctgcacgtctgcgtcatggcccttggcatattgcattgtaagaagctgcttttgtatctgactctctgaggctgtgagctctctaagggtagggaccataccttcctcctctttgtacatcccgtgataattcaggggttttgtttttggttttcatttggtttcctgataagcgttccttaggagaagaagaaaaaagagagtagaaggaaaagaaagaagggagaggagggagggaaagaaggaaggaagaaagagagagagggaaggaggaagaggagggagggaaagcagaaagaaggaaagctgctttgtctcaggcagactaacaggaaagcgacttttccttgcaaacctccttcaaggtcatgagagatatctctgtgaccctggggccagaccaaccttgaattcaaaaatcctccaagctgagggcagaaagtaggaagaatcccgccggagcactgcaaggccattggcgggcactgctgttccctcccctgtgggaaggaccactgctcacctgggtttttttaattagccattgtgtttcttttctttgtgctgttcttctccatccttagtaggcaggagagtttttacactatttctttttcatattctgctataaatgagccctacacataatcaggaaggttagggctaggatcagaagtcaaatttaggttcacacatgacaaaacttcaacaattcacatttcaccagttctaaacaagaaggttccatttaaatcactgattgctgtaatttgttgctatcatccaatgggtgcattttagtttaaagggatatgcctcctttatcttctcgaggtctcagacagtgtctgagtaaactctctgccaagtcctgagtcacccggaggatagcagatgcgcagactcagtctggggtttagggtccactccgcatactcccacttgcccttggcattggccccatgggtggaccatggaggtgggtgctgtatggcaacagtcattcctcagcagagtggagagggagacacatgttctgccgcgcccatgttcagtctgttctgtgggcagagttgtaggaacacacttagcccaaatcgatgccagcctggcagtgggtgaagggccagcaaggtttgtctatggctcatgaccttagggaaaatgagattttactcctcgtgcagcctcctgcctggagaattgcacacccctgtttcagataggtaacagctttcttgaagctttcaagaataaaaataaaaactttaaagtacatggctgtcagaaagtccctcctggtagctaacttgagccctttgtgcttattttatcttggccaagcctccccggagcatgtgtaccagatacgataaccttccaccaaaccagggacctctcagatctcggcttttcagaacaaagaatttggatttccttagcctttcatcatcatctcatcacccaaacctttcattatctttttcaattttttctttgaactctttccaaaacttgtcttttgagttacagagaccatcacttaattagatctttcatttccaggggatactcctagtgcctaggaagaaataaattaaatttcagtcggatatatttcattgggggaagggtgtagaaaaaaagaaattgaattccttatataaatagcacattgtctggtgccacaaatgcgttttccttttcccagttgtttttggaacaatgggtccttttttggtgactttaattcctcagagattctaacctctaaaaggtcatgatttgtgttgttttgtgcatacacggcttctgtactgaaaaaaaaaaagcgagatgtgtggcctctgattgtctagtaagtcgtgaggaaacagacaaggctgcaacccagcagcagttgagcaccttgtcaaagtgtgggaatgagcgtgtgtgggtctctgtgcttccagccttttctgcaccagctgttccaagcggagcagaggggtctgtcttgcttctccgtaacttcatcaacctgtaagtaggcttgccttttacagtgctgttctcattagctgtgcagacttccttatcctgatcatttggtatctgtgcgcagactttcataggggaaggggatagtctttaacttgtctttctgtggagcagaacaacagaggctggcctttgctcagccatcaccccagccaggctgctttaagcgcatttcatcacttctttccacctgagtttttctttgtgtcaaatgaagaagttgggttcacagatgacctctgaggtcccttccaatccaaccctgcaattctcacagcatcggtcattctaattgctccatagaagggtaggacaaggaaggagggggtgagtttagcagccagttggggaaaggatgcttgcagagtgtcagtgtaacttggattcccactcatctcttctctctcccaaggatcctgaatcaacgtagtgtgaagggacaagagtgagcacctattgatcacctatgataggtcagacactgtccaaggctccttctctacactggctcatttaatctttacatctcactatagaatagatgtaccaggtgttttccacatcaacgaccaccacgcgccccatccaccccacccagatgtgtctacaccctcagatttcacttgaaatgttccatccttagtgcagccttccccagcccctcagaccaggttagatctccctgtcctatgttcttatgtcccctatgctttccctccatggcacttaacatcaatgtaattaaatcattatctgtataattaatatttacatgcctactagacagaaaactcctttagggcagggatcacataagtcttgttcattactgtattcctagagcctagcacagtgctgacaaaatagttgagattcaatagatgtttgctgaataaatgtaagcatgaatgcatgaatgaatgaaaggatggatgaatagcaaggctagatacaaatccagaactatctggctcttggagacctgtgtatactttaagaagagctccacttgtaagtttgtacacagggcttcactgctataaccagcttatggatacttagctacagttagtcatgctttgagttgtttctccagaagcgagaatgatagctgcactgctctggccattccctttaatccactgatactcatcctcaaagatgtctgtaaaatacttggagattatggatccagcctggtggtggttggaagtgggtagagggaggcaatgaattgatccaaaccatttgtccttgtgagcttttagccctatgtcttaataataattagtaccagcctgggcaacataatgatatcctgtctctacaaaaataaaaaattagccaaatatggtggcgtgcacctgtagtcccagctacttgggaggcttaggcgggaggattgcttgagtgcaggaggttgaggctgcagtgagccacaatcatcatatcactgcactccagcctgggtgacagagtaagactctctcaaaaaaatagaaaaaagaaaaaagaaaaccatcagcaccacttctaatactttctgccaaaggggctgaaaacaagaatctgctctgtcagggatctgggtcactaagaatgagtgggtgaagaggaaggaggaaaaaccaagacatgacaacctttagagaagcaaaaataaaactctaatgtggaaactgctgaaaatagactgcctgggctgtcagactgcatgcaaatctgatgctaatcacatggaaattaattacaagtcctaacttccatatgtcttgatatgacccttgggggaaaacctgctgcaggtgtctactccccaccacagaggattgagtggaacacaggctttgatgtcgcctccttcacactcagctcttgccactgcagggagaggaggctaaaaatattaacaatagaaatttgatttcttctttcagacaaaaagccttggcatccacgggaggaagaagtgttcaggcagcatgtgactggttggtatgagataaataaattgagaaaatagcatataattaactcaaagtgcatgtggatgagtggggaggtgcagactttctctaatggacccttccagaagagacaggagccaaaagactgtggcaagtgcgtttatcaagtcaattgcctcctctgccctggccccagggtatgtttctccttggagctgtttaaagaaaattctaagtaattcccagatagagcctctctcataagatctgtccctgctccagtcacttaaagattcattttaggggtatggatattgagaaaatccatttagaaaagtaccctacttatcttccagggtatccctacccagggtgggtcctacaaggttacctctctgggagcttcccttgtctttggagggacatgggtttaattacaggctgacctgagggacaggctgggttggtcctagtggattgggaaaggatttggagttgatccaagaatgcttcctggagagcggttttaggacttttttagggagttgtaggatgaggaggcaaaatgacaagaaggaagacagaagttgctgcatctgagaattggttatgaagtgtgagtttccagaagtagatttttaaatcatgaatgaaaacccttccccgcgctgtgccggggatttggagcacatggagggtggatctgtctctcagttcttttttcccctcccattattctcaagcgacaccttgttggcttacttctgtcttacaggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatggtgagcggcagcgcccccacccctgggaagcctggctcctaggatcccagccggccctttgggacctggagcaaagggaggcctcgcaggaagacagcaggaatagtcacaggctcctacagctggagggaccttcaagggatcagtgaggtccacaatgggcccctcaccccaacgcttcctagttttatctgctgaggcccaggagcaccccaggatgggggcagcaccagattgtaaccctctgtgagggacacactggtctggctgctggaatagaatcactgatctagcttcacacctgtttgctgtctaccctctccactcttacgacaagcaaagaggaggaactaagagcagggaacaacaaaggcagtttatagacagggaaagccatttcctgtccacaagttttttttttcccgctatatatttctagagaatgcaaagatatttacttgccattgttacctagtgtataatcctagctgtcagaaagcttatctactgaccaatttttgttgttgttgttgttttgagacagagtctcactctgtcacacaggctggagtgcagcagcatgatctcggctcactgcaacctccacctctcgaattcaagcgattctcctgcctcagcctcccaagtggctgtgattacaggcatatgccaccatgcccggctaatttttgtatttttagtagagacggggtttcaccatgttggccaggctggtcttgaactcttcacctcaagtgatccgcccacctcagcctcccaaagtgctgggattacaggcatgagccaccatgcccggcctctactgaccaaatataatccccctcactatcacacatgtaaatacattttgtctactttagctctctgtggtaatagagaagagttgatttatctccatatattcaagaccaaacaaagtggtagcattttaaaacatttttataaaaaatattttgctttcttccccagatatattctctctctttttctctctctcaggtaataataatgttcctaacaccttctcttttaccattcactctgaaaattaaagtgactgtcatttcctcttagtcatcccaggatctttctcaaaacccttcagagtttgagagacgttcattcttttttccaatgctctcaggaaggtaggaggatgatgtcacagctctctgggactcattcttcccaactatcatgagggtggatgtagagtcaacttctgatcatctaagaggaaaagaaaagtacagatgatacaaaatagtagaaaacacgcagcttctcctgggatgctgcactctctcctgtcacattccttcatttttttttttttttcacaagcaaggagaactttgattttttttttctttttcttttttttttttatggatatatagtctctctctgtcactcaggctggagtgcagtggcgtgatcttggctcactgcaacctctgcttcccgggttcaagtgattctcctgcctcagcctcccaagtagctgggattataggcgtccgccaccatgtctggctaatttttgtatttttagtagagatggggtttcactatgttggtcaggctggtctcaaactccagtcctcaagtgatctgcccgcctcagcctcccaaagtgctgggattacaggcatgagccactgcgcccagcctgatttttttctaattgataaaaattatatacatttatggcgtataacatgatggttgaatatatgtatgcattgtggagtgcctaaatcaagctaattgtacatgcattacctcgcatgcttatcaggcatttgtggtgagaacacttaaactctactctcttagtaattttcaagcatataatatgttatgatgaactatagtcactgtgctgtacaataggtctcttgaacttatttctcctaagtgaagttttacgtcctttgaccaatatctccccaatctcgctcccctttcttgctttcggctcaaccagtcctgcagcattttggctgggttcacgggggccacttcacagcaaggaaaggagggaagaggtcatgtgttccccacattaatccaccagttgggtaatctgtgtctgaataattggaagtctgcagttcctctctccccacagacaggggtagtggttaagtaattgcattatcagcctcctccagtctctggggagaggatgccaatgttaagtagcagcagacttccatctccccttgtctctgagtgaagactgcctgttttccctgccagtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccggtgagcaaacagctgccaggccagccctgggccctgtcaatcaaagagttggaaaggaaaaaggataggaaatagtggtagaggagcaggatggggtcaggaggtggaggaccctgcaggaatggacgtgtgacaaaaaaacagccttttcctgcagcaccccacgtcttgctcccttgtaaaaacgttcaacccctcttctgctgacctggagagaccgtctaaggcttattccctaacacccaagttgaagtttcacaaatgacttccatactgaactagaaatgtatttctttgtagcaccaccatctcctcctaattcagaattaaagaaacatcctttctccctcccaagctcccgcccatgtaggtgtttatctgggtctcattgttcactccatgacaatccagatcttttctcagtgggtagcagaggatagagagaagagtggaagcacttcgtattatatcacaataaaatccactgaaccaatacccttcaacttgctgaaaaccattagacaggaccccaagccccaagagtctgtctaaaaatgtaaccccttccaaatgtctcctgctcttctcatgggagctcttagttcaggacacctgagatttcctgtcaaaggaattagcttaagggggtgctcaaggcaggagacacgatggaggtgaaaagagggagaagtttgcaaagctctcctgtctgactacaggtgtggacaagctcacttagctcaatgacagcagggaaacagacagacaatctggtggggggagagcctcttggctcgctccagcatgaaatcacaattggcaggtacttactggtcacctactatgaggatttctcctacatgaggagtgctacagggaagagaacaagaagtggtttctcccggccaggccctgtgtaacatcagctctgaaaagagaaaggggtggttctaccttcacggaaggaaggaaacttgccctgggacgatgttgatcaggacaatggaggaaaggcctgcaggcgggcgggtggcaggagcacaggcaggcaggcatgagatggtgtgagcagaggacagtggggaggctgccctgaccagagtggatggtgcaggatgcacagtggaagccgagtgctgagtgcaaagctggaggagacgtacaattcccctacccctaattttagggagtgccagagagggggaagacctgagcaaggccgcagtttgctccttagccttttggcctttggcctatccctcacctgccattgttccctgctgctattttcatcaccatctcaggccctttgttccatattcctctttaccagaaaagcaccacacaggacttgggacctatgagtgggatcggggctcagtatcactgcaggatcacagtgctctcggaaggaacacaaggaccttaagacccctctgtacctggggagggggcctctttagactttgcaacccccacccccacctcttcctctccctcagcgacgggactagtctccgggtcctgacttcagtgaagcctgacatttcataggagcttaatatttcagagaaagagcataactgagaggcaaattatttcctgctcttatccctcaatctcaaggaaatggctttctctcatcccacagtagttattgtcagaaccactaaatccccacaaggaccaaaactaatgtcaaagccgcaaaacccaaatccttcacaaatgagaaaagcaagcctcagccagggccgcacagattcttggagtgcatactgagtgagcagcagtcgaagccccagctttccctgtgggacgcgggtggagccaattcctctccaagatcctgctgtcatgaagaacttggccggcttcgtttctctgctgttgtgtggccccctggtggggatgtggagaactggatgaccctgcgcagcttagctggtcccgctccttattacccagcatgggaagccggccaccatgtctttgccctggaacttggtattctccagttgttggcaggaccagatatcatcaagtagatttagtgtcttcctccatttgaagtggtcaagggagattcattcatgtgcatttattcatttaacaagtactgaaaacctgcatgatatgctgagtaaggatacagtgtaagcgagagacaaaaaccttgtttcatggggcttacaccaaagaaaggcaatgcagtataaaagaaaaagtacttaaaaccgaaatgctcaatttctagttctatcttgggccactaattctctgtgtgacttgaccaagttccttaaattctcaaattccctaatttcttctagttgcaacttcttcattattctagtttgtacagtagatgattctccctcattgtaaatacaaaagaggccaggcatggtggttcacacctgtagtcccagctactcaggaagctgaggtgggagcatcacttgagcccaggaggtggaggctgtggtgagctatgatcatgccacttaactctagcctgggcaacagagaaagaccctgtctcaaaaaaaaaaaaaagtaccagagagagaaaaaaaagccattccctcctataggtagggttgttttgttttgtctcttgggatatcttagaataacagtctgtatactttaaaccagtatgtctcaactaagggtgattttgtctcccagggtacatttggcaatgtctgaggtcattttcaattgttacagcttggagagtgctgctgacgtcttgtgggtagaggccagggatgctgcgaaacaccccatcatgcacaggacagccaccccccccaaaaaataattattcaacccaaaatgctgttgagagaaaccctgcattaaactttgaaaatatccatcttttcccctcatttctccatcaatctcacccagaagctaagagacgtgattccaaaatgaagggaatagagctttgggagtcacgcagctataaaacatgctttgtatttctacacaaattatttcatcactgtaggtcatagtgccctcttctgaaaggtggggctggtgaccaccaactggaatgttgtgagaaggacttaactaaaaggactgccctcagctgacccgcagctcctagaggaaagccgtatggtggctatctcttgaacagtggctcgattcggaatctcttgccatccccttacccccttattctactgctgtgaaggagagaaacgtcttttgtcttctttgttatgtgggaagcagaatttctcagggtacctttctatgcctttccttaagtcttcaccattgctatcatcaccaccttttaattactgacctttttcttcctttttccagaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgaggtaatgtctcactgtggttccagaagctaccaggtgcagggatgcaatcagaatcagcagctcgctgctgcagggagatgggtacctacaggggaaaaatggagcaagcacctaacagagagtccattggctcaggattgtgtccagcctctgcttgcctcactgggaggcttccagcttgcctccctcctctctgggtcacaagtggttcatctgggtaacatccccctagttctgtctcccctgccaatccaactccagcaaaaaagaaatgaaatgggagagaataaataaaaaatatattggaaaatttttaatattatataaatttatggtgttaatggaagacatcattttgaccttaggtgagttgaagaacatataaataccaaagaaaacaaaacaaaaaacaaaaacacttgcaaagacataatcaacagatatttgctgtgtatctgtatcatgcaaagtaccatggagcatactggaatttttaaatgttgtcctgtcctcaaggagctttgagaacagacacacatgaaaagaaaactcaagccacctcttgtgagagtttctgcacatcccagtgggaggcctgagtgagaaaactgaattccatcacaagaagaaagattggtacacccctagcacccttcctttgagggaatcaacattgccttctagacaagtatgtgacatcttggaagcataatattgccttttttttttttttttaaatggagtttcattccttgttgcccaggctggagtgcaatggcacgatcttggctcactgcaacccctgcccctggggttcaagcgattctcctgcctcagcctccctagtagctgggattacaggcacccgccaccacactgggctaattttttgtatttttagtagtgccggggtttcactgtgttggccagactggtcttgatctcaggtgatctgcacgcctcggtgtctcaaagtgctgggattacaagcgtgagccgcagcacctggccaatagtgtctttttctatcctgaaggagaagctgagacacaaaaaacattagtgtcttagtaatttagggctagagatgaagcaagagcccatgtattttgaccaataaagaagggcaacctgtctgaaacaaaactacatcatagccaggcatggtggctgtcacctatgatcccagcactttgggaggctgaggcaggagtattgcttgagaccaggagttccaaaccagcctgggcagcatagtgagactgtatctctacccacccacaaaagacctcatcgtttgttaaaaatgtgccttccaacttaactacatttattaagcaatacttatatttgtttcccaatttttcaaacagccaaagaactggtatttttgttagtttacatagccttttaacatctcttttagacttctttaaaaaacaaaacatgaaaaacagttagaaccccagggctgggagcaggcaagctcattgttttggaagtggtagaagagccaacccatgagtcagaggttcagggttaagcatgcgcctgtgagtgtcaggggctgcagttttgtctgactctgctgatgggaacgtgatgtcctccttttgagtcatttgatgcaggtttctgtaagatgccttgagcagactgggcctgatcttatttaagaattctgacatctcctagagtcacgtagaacgaaccctgaagataacaagggaggtgtggctggttggactccttctgagggcaaagaaaaaaaaagtcaagggttgcgtgcagatggcctctgagaagtcacctttctaagagaaggaaggtggcagtggaattttacaaggaatatcctctaatcaacactgccctccagttaactcaaagggtaattgcttttctgcctgacccacattctgctcaattggcatggaaggaaaaaggcagcaagcgcccacgggaattattttctaaaaataacttggcctcttttatctcttatttgtaaaagctcatttattaccgttcgttctgataaagctctcctcggcccctttggactggacctctcccgtgaggtctttcggtcctacctgagccgtctgcacacgtaaccctcttcttgcctgccttcttcaacatgcccccaggaggcagttttgattgattgttccagtgagggaacagatgtccagagaaggagagtggtttaggcaaggacactctggcaaggcaccgtgatgcttaggaaaactccaaggcctcattcctctgctatttagattctcactcgatttggacacgcgaatcccatttgtatttcacatgggctcttccgtgttagtgattacattgggccatgccagtttaatataccaaccgatagaaatccagaggaaggacagggtgatccaaaaagcatcaattttggagtctagcacacttggcttcaaatcctggctccatcactttagcaagggttaaattcactttgacaacttatataaatctccagtccttagttttctcatctgtaaaatggtgacaatgttttgctagatggttatgaagactaaataaagaagatgtatggaaaggctctaatgtaatacccagcacaaggtgggtgcaacagcaacgaaaaattgctgcagctattattgtgagtgagaataaaaagggctccaaaggcagttcggctcttgtattcactcagggctgtggctgcatttcattcagcaaactgagttccatcccattgtagtaaggaggaaaaacatacctgaggtggattcaagaggttttttgtttttgtttttgttttttgttttttgtttttgttgagacggagtcttactctgtcgcccaggctggagtgcagtggtgcaatctcggctcactgcaacttccgcctcctgggttcacgccgttctcctgcctcagcctcccaagtagctgggactacaggcacctgccaccacgcctggctaattttttgtatttttagtagagacagggtttcaccatgttagccaggatggtctcgatctcctaacctcatgatccgcgcttatctcggccgtcccaagagtgctggaattacgaggtgtgagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgacagagcgagactccgtctcacacaaaaaaaagagttcttacaagtagatggcaaacataaaacaaaagaataagtagaatgtaatataaattaggcatgtgttctcacatctttcaaacttaggctaaggttttgtatctgcttttggtgagtgagaaagggcattggggacatgggtcccagttgtaattttagatttgctacaatgccttaattcttttattgttcattcaataaatcgaagctacttattgtccagcttccctatgcctaggacatatttgtctgtaaccttagctgtgcctcagttttcctggggataacctagagatagaatgaatacccacccccgctccccccccaccgccccacatgatagaacaaatgaggacttctctgaaatcgcatgagtttctcaagggaaaggcactactgggccaaaggcattattagccaagaccatgctgtgcttgaacatttaaggaacacaagtttaggcttgtttccctgtgactcggtgactttctccacttgtcccagaaaaaaaagaatgttccttttcatgggacgtcacacatttagctttgcagtttatgagatttcgcgtgaattgtttttccctttaagctgatttaacaatcccacagaaaaccttcctggcttgtttggggaggtggtttgagtgtgtatgaggcaaagggacaggaagaataaggaggcaatcagagcagggaagacctagaactgaaagatgctgaagtcagaattagggaaacaaacaggtgccctacataaaaggaaaatcggaaatgcagcggtgcaaatgagctctctgcacaatcactctcatcctctgaaaagaatcacacctttactggctcctttctttagcgatttccagaaggaaattctctctttataacatgttctggtgtatcaccttgacatcaaccagccaattagttcacaggcctacccagcacagagtccagggatcagggtcggctggaaggaaggatgtgacgtgggagatcaggtgctctggttctgtagaaataattatgccccttcggtgcacaaggctctgtcctaaggtgttttcttagattgtctcatttaacttttatgggcttaagtattattttatagatgaggaaactgaagcctgaagccaaagttagaaatatgcaaatggagaccagaatatttagcctccaactaacggctttgagaccctagaaaacagtaaaagctgttaaagctttctccgtctttgtgtcccttgtgaaacaaataagataggaaatattttccttactattgaggtctcccactattagtaacaaaaaatactaaaataaatgttctctacagtaccttcatgcctatacctgtgatgttaatacataccaggaaacgaaggcaaaaagaaataaagaataaatagccaactggcatggcctgtttttggcctgggggctgtttcggagcccaaagtaagaacgttttctccatctgatgaaagctggctacatgctgacatagacactgatgtctagacatttttctttcaggatctttgttaaaactataggtttaaagaaaactcctttaaggcaagaaccatgtctggtttaaagagctaagttggccgggcatggtgactcacacctgtaatctcagcactttgggaggccaagagaggggaatcacctgaggtcaggagttcgagaccagcctggccaacatggtgaaaccctgtctctactaaaaatacaaaaattagccaggtgtggtggcggccgcctgaaatcctagctaccagggaggctgaggcaagagaatcacttgaacccaggaggcagaggctacagtgtgctgagatcatgccattgcactccagcctgggcaacaagagtgaaactctatctcaaaataataataataataattcataaataaagagctatgttacacagaaagggggtacttcattccctgagccttcctggaggagagacactccacctggcccctctgtaacccccgtatggaagactggctttccatgagctgggtttcaggtgtctatcatggtgactatcagatgaagcaagggaagctaggtccatgtccatttatacagcagttggccagagagcctacaggatttcaggtcaatttccaaaaacgatacttgaatcctgatgggaaatctagacatgcctgaagaaaagtatgaaaccatttctagcaccaggcatacaccgtcaataccctgaagagagaagtgctctctgataggaattcacatctactcagggcctgcagaccccaagggctcctgggcacatcgccctctggaggtgtgcagtattaatgcagaacatacagtcctgccctcaaggcgctcaggagaatggtgaggcatggggctcactcaccctctcttccttttccagacattacaggtcatctacccctataccccacaaaatgacgatgagctggagctggtccccggggacttcatcttcatgtctccaatggagcagaccagcaccagcgaggggtggatctatggcacgtccttaaccaccggctgctctggactcctgcctgagaattacattaccaaggctgatgaatgcagcacctggatatttcatgggtaagcagacacaaagacctttatgccatttgaagaatgttgctaaggcagactggatcctggatacacagggcagcagtaaatggagtccatgggaagaaggccctgtggattccagaattccaggaaaggagctgatttgaggcatggggaaaatgcgaaatggattgctctgcttccctctgcctgccccatttgccatggttgtctgcttcagttcctgatcagagactaaactgaggtggcttggggtccatctcttctggccgaagagtggcatcatcccagtgctgcgtcttcactgctttagggcttctgtccaccttatcctgggtcatgagtcagggtggtctgatttcccgaagcagctgggcggattactaccctgccatccagaccaatagagaagggggtttcaagaggcaggagccctaactgtatccttgatttgctaagtgaccctgagcaagtccccagacacagcctatgcatgcctagacaacaaagaccgtgtctaagggaacaggcaactgccagactgaaaaggggtccatttcccccctcccctctgccagtcttctttagggtaataactttccacccgtccctcattactattttgcccccattccatactggtaccacattcagtggccaactttgtcccaatagataaaatagaaacaaaagccatcttctctttcttagttggagcagctcaaagccagcgcttccctggcacactggggcatctagccagggtctgcatgctggtttgtttttctcccacttgtttttgtcatgtggcaacatggctgagaggcagaagccctgagcgccagctgcttggtggctaatattgttattattgccataaaggagaagcagagagagatgatttcatcaagtcttttgcctggaaggagaaaataaaggtcccctaccctagtgagccacaaacagacaaaccacaaatccaaagatgggaaagaatattttcttcctcaataaccccacccagcaatccctccccctctccctcactctgctcccacctcagcccagcccatgagcctccagaattggatggcacaaaattagaggtcaaagctgtcttatgttccccaaacattttgctttttcagaaatgctttggaagatcaaaatacataagctgggtttccaaagtctccattttaatccctacaacaacaagtaaagcaaaatatgcgtgaataaactgagaactaaaacattatttgcctgacaaagcacagttctcagatctgttattttttattttacagtacttggagttgctgttttatcagatctctttcttaaaagtgggtgtatggccaggtgcggtggctcacacctgtaatcccagcactttgggaggccagggtgggtggatcacttgaggtcaggagttcaagacctgccaaaccaacatggtgaaaccgcgtctctaccaaaaataaaaaaaaaaatcagctgggcgtggtggcatacacctgtagtcccagctactcaggaggctgaggcaggagaatcacttgaacctaggaggtggaggttgcagtgagctgagatcacgcaactgcactccagcctgggcaacagagcaagactttgtctgaaaaaaaaaaaaaagtggaggtatatgagaagcagtgctgatctcttagagttcactccatccaaacccactcttccctaaattacaactcaggccgatgtataggtgaacctgagtgacttcggtcagtgcgtcccagggaggtctttgtgtcatcttttattcgagagattactaatgatgtcatgtctctgagaacaatgtctgaaattaaactaacagcttccacagccaaccctgctcaaagtaggtaaataagttaggcattagtttattgtgattaagaatttgagactggattccaatagtcttggatttaaacgataactctcccacttaccagctgtgtggccttggcaaagttgcattacctctctgagcctctgtttgctcatctagaaaatggaactaataattgcacttacctcataaggttgttgggaagactgcaatacagagcttagctttacatggttcagagtctggtgtatagcggtgactataaaatcgccatttgcataatgatgattattctcttttttctatcttgtgtttgccagtcctcacttagtgctcatcaaaggaaatgtgtcttccataaaagcaatcctgtagatgaactgcactttcctatttaaccccagaggtcaaatgactcaaggaggcagagcccagcttccttgtaagacagacacagaccttctctctctcctaacccaagagagacatcaggaggtagagccccagggggatgtcaagcatggcctggctggcatggtgggagttgcccaggggatccaggcaacaagtcatgactgggggccaatgattttgacaacactccctgccaagtgcttctcagttctctgagtccctcctaaggaaatatgttctctccacactaactggagtgtcttacttggttctgagttatgaaccaagacaagttgatgaagctgggtgagctgcctggccgcttgggcttagcacaggcctggtgtgttgcagggagaagccagctctcccgatgcttgagatgttctggatgtcaggcccggcttcctccctccactgttctgagcaagaagcatctgactgttttcttactggaactggcagctccacgctgtctcagagtgagtcaggtcctttgattataatgacagttaagaagggaaagaggctggcattcgtcttgccatgggagacgaaggagggagagaagggatcctatcagtatcttcacagctgcgataaagaaacaaacagatatgtacaagaacgattctaggtagccagacattttgcaccctgaagctttgatgagtcagacaataaaactggattttctttttttttttcttttttttttttttaattttttctgagatggagtctcactctgttgcccaggctggagcacagtggtgcaatgttagctcactgtaacctctgccttctgggttccagtgattctcctgcctcagccccccgagtagccaggactacaggtgtgtgccaccacgcccagctaatttttgtattttgaatagagacggggtttcaccacgttggccaggctggtcttgaactcctaaccccaggtgatctgcctgcctcggcctctcaaagtgctagaattacagacgtgagccgctgtgcccagccaaactggattttcttgaactgtgtgatgtttgggagggtcttagtttaaaataaagtagaatagctggtctattatactgtgtgaacggcacaagatttccttgggctacagttacttaaattttactgtaacaggtttcacttggcaacatacgcagatggactgatgctgctttgttgaactgtaggttcctgggtcccacccctgacctactgagtcacaatgtgtgaggagcagaaccccagcacgagtgtattttttttaagtctcctggtgattctgatatgcacaagggttcaaaatcagtttttcagggcatgagacttctgagacttcgtttataagtagatagaatgagtctatcacttctagtgaaaaaggagccacttctgaaagtgaaggaacaaaaatttactaacaaccagtttgctgtattatattggtgaatataaaaaggtattttcaaaaataaaattatgggccaggtgcagtggctcactcctgtaatcccagcatgactttgggaggccaagcaggcagatcacctgaggtcaggagtttgagaccagcctggccaacatggtgaaaccccatctctactaaaaatacaaaaattagccgggcgtggtgacgcacgcctgtaatcccagctactccagaggctgaggcaggaaaatcgcttgaacctgcagggtggaggttgcagtgagcccagatcatgtcattgcccttcagcctgggcgacaagagcaatactccgtctctaaaataaaataaaattctgataatacaatgttaaaagtgaataatccagaacaggtggtagcctaaacgggttgcctcatcaacagatgcaagccaggagtatatggagcaaactgggatggatggctacccaaattgtaaagaagcaagaaatctataaaatttaaatgtttcccctggactctgctcagtgattccaaagatgttcactggatttgcctaacaaccatatttacattgcaatgtttattagataaagctttgtggaagtcttaactattgacaataatttaagcttggcaggttttgactgtcttcctttcagcaagacctcttttaggcttctgtagctatagtgttacactcagaaatgacagttcttggctcacagctctaaacgtctggtgagaatggtcttctctgaaataattctatttgtaatcatcttgttggaggcgtgattgagggggagatagggtttggagaccgaagagggtagaataggggactttggcacaaagtttccttgactgttaggagccactggctgaggtggagatggtgaaaataccccccatcactcttcacttcagatggaaattaccacgggaaatattaaaggcaacagggatcgtagatttcttttgaaccagaaaaatagctgcaaacagatcattgatacgttgttattcttgaacttgtctttggtgccaaccatgcatggcacaaaatcactaggatccatccctgcccaaaggaatgaatatatctgtcctcagtgcagaaatccatctacctctaatttatttatttacttatttttattcttatttctttttgagacggggtttcgccgtatcgcccgggctggagtgcagtggtgcgatcttggctcactacaacctccacctcccaggttcaagagattctcatacctcagcctccctagcagctgggactacaggcacgcacaaccacgcccagctgattttttgtatttttagtagagatgggatttcgccacattggccaggctggtctcaaactcctgacctcaggtgatccgcctgcctcggcgtcccaaagtgcaggtgtgatcaccacacccggcctacctctaatttattaactgcaagacttcagtataaaacaaggtatttttcccttaggaatgaggccactcctgctcagcatcccccatcattgtgctacccacagagggctttgagttaactcccacactcctgttgagcccaggaggaagtgctgatgactgctggccagagcagttaacaccttccttatcttcctctgcagttcttattcaatcttaaatacatcgtcatccaactctctcacgtttggggatggagtattggagaggcggccttatgaggaccaggggctcggggagacgactcctcttactatcatctgccagcccatgcaggtaaggctgattgctagggtcacacccccaactctaaccaggattcactgagaacctatttattaagcatgaggccttgcccttgctgtctccaaagcttccacgatctcttgggaagaaagtacaccaaattataaaagatatacaaaaattcaaggctaggaagagtcagatgagcagtactgacagttacttccagcatttgaacctaggttcataaggaacgttgttccacagagataggaggagagtttatctctaaagtaggaataatgcccatagttgtatctgttttgtaggttgttacaaagattaaagaaaataataaaattaggctcttagcaccataactggcatataatgagtgctcagtatgtgttaactttttcaaggaaggttggagatggaaggaggcagggagtcgttgttgaacagtacaaatagaggcaagctgaaagttcaagcatgttgaggatcaagagagtaaccattgtggctggagcccaggatttaaattaaggaacaacaggaaaagagatgggaaggatcatgccaccgttccacatattaaccacgtcagggcaactagaagcaaatgtgaagtgctggcccgcgctaaggaaactggaaaagctgactgcatcagaaagacggaatgtagaaacagctgtaaggttccatccagcagttatagaagccaaagtcatttggacaagcctttgactagatttgcctatgtcatcacccagaggtagcagttgtctcattttggggatcatatatatagtcagacagcagaggctacatagtgattagaataggaaaacagggtctcattactggagcagaccatgaggaccatgtggtctgtccacacactttagagaagaggtagacacatttgtgatcacagaagtcctcactccctgaagaagttgatgaattgcccctttttggggggaaggtgtcccactagatggctctctctacatgaatggctagttttacctctgagctgtaacttaaagtggacgtcatattttagtggccactttaatggccaaatgctactcctacaaagagcagccgtagcaacaataatgcccttttcataacccttcctattttataaagcacatgcagtttatcttattccagcctccaaataacttatgaggtctgtaggacgagtcttactgtcctcaccaagtcataccttggcagaactttggtagtagagctcagctcacctggcacctggctccaagacatgtccactttgccatgtgtgtcttcactaatagcctttctttctctgcagccgctgagggtcaacagccagcccggcccccagaagcgatgcctttttgtgtgtcggcatggtgagaggatggatgttgtgtttgggaagtactggctgtcccagtgcttcgatgccaaaggtgagttggtggtgggcctgctcagcactgccatacccatagtggcctctaggcggcacagtcaagctacagttatctagatggagtcattcatagttttgcgtactatagaagatgtctgtcatgtgtaagcccctcctgattgtcttgagctttagagaagaagtaagtgttcttgtccccattctataaactgggataccacggaccaaagaagacagatgtcttgccccaggtcatatggcaaagtcagcagcagaaacgtgccctgatcctatggccagagttcctgccattaaatctccctggctcgctcggttccattttcatttgagtagcatttgaagatacagaggcttgcttaaccagggaatctcacctgctttaaagtgcctggttattaccttcactgagaaactacctcatgtcacttttgtcagtagaatggaaaagtggattccaagtcactttatgaaacaaaatgtcagccttgatattttctatcagctccagagagctcagtgtgatctctttggccaagaaggaatgggggtggagagtgtcaggatcagtaagggagtcccaagtaaacaagaaatgtatgtatcctctgtctaacctctttgtttttcaggccgctacatacgcaccaacctgaacatgcctcatagtttacctcagcggagtggtggtttccgagattacgagaaagatgctcccatcactgtgtttggatgcatgcaagcaagactagtgggtaagtatcctggagtgactgcactccaggcatttcttgcctcctccttcaaaacactggtaccatggatatgcaagacacttcctgtgggtttctataactttcctacaagtttcctcaattcaaaaggaacttactacacaaccattaagtttaggacactgtgctcagccctgggttggttgaccaaagtgaatgaggtgtggtccttattgaggagcacgtgatccagtaatggcgtgggttactgtgctcactcttggatgtagcagacaggtcagcttctagttcaagacagcagcatctgccaaacatggctgtggaagaggacaagagtgaagaagatggaccctggacttgctgaatttgtaaaggccaactgatcctttgaagatgcctagctctttgcaagcccattccattactggcacggggagatagtattttctgttcagtcacttagcagatatttagtgctcacttactttgtgcaaggtattggactaggggaacccaagtgtgagtcagggaaacaaacttatgtgtggataaatatcatacaatatgatatacatagagctatgcactaatgtgtatgtattgattgcatgcatccagacatagtgatatgcatagagctatgcatggtcacagaatattatgggaacacaaaaagacatctaagagtgaagaggtgagctgagagctgaagtagaagttagctgggcaaagaaggaataggagtgaggaaatggcattctcagtgggagggaccacataaagagtcttaggcttgagaaacagcctcaggaatgcaggggaaacaaagtgtcttgtgtctagagtataaattgtgaggcaaggcagagatgaggctagcaagatggataaaggcaagttcatggaagaccttggccaccatattaaggtgtttggatttaatccagtagacaaaataactggattccaggccaggcgtgatggctctcacctataatctagcactttgagaggctgaggcaagaggattgcttgagacctggagttcgaggctgcactgaggtatgatcacacccctgcactccagcctgagtgacagagcaaaaccctatctctaaaaattaaattaagaataataataaattttttaaagaagtggattttatgaggatagcattaaagtatgaggtgttgggatttatctctggtatctaaaaatatgacatgttgagattttggttagcacagaataaaattaaaacaagacctaatattcataaaataaatcctctttcacaaacttgaagccaaagtattgtcctgtttctaaatatctcctagctaaagcctttaccacttgttagcaccagagggaagggaaagaaaagacaagaaggggccaggtgtggtggctcacgcctgtaatcccagcactttgggaggctgaggtaggcggatcacgaggtcaagagatcgagaccattctggccaacatgttgaaaccccatctctactaaaagtacaaaaattagctgggtgtggtggtgcgcgcctgtactcccagctactcgggaggctgaggcaggagaatggcttgaacccgggaggcagaggttgcagtgagccgagatcacaccactgcactccagcctggcgacagagcgagactccatctcaaaaaaaaaaaaaaaaagacaagacaagaagggctctgtcgcttgctctcataggaacgccgatgaggggttttgttagaaactaacaaaggctgaaactactggctctatgtgagccccagttaggaaagaggggtttacaggagcttactgcttggccccctctcacactgcgggtcaaggtgagactgagtaaatccatcagactgatttttttgtggttttctttgcaggtgaagccttattagagagcaataccattatcgatcatgtctattgctccccgtcccttcgctgcgttcagactgcacacaatatcttgaaaggtaagacttgcaggttgacaaaaacaagtagtccatccctctctttctaggcagccccacacataaattatcttagagccatgggacatttgccagttgaaagctttgaatctggaatgaagcaaggattctttcagaaggcgatctttgcacaagtcacaaaaacatactctgggccgggcacggtggctcatgcctgtaatcccagcactttgggaggctgaggcaggcagatcacctgaggtcaggagttcgagaccagcctcaacatggagaaaccccgtctctagtaaaaatacaaaattagccaggtgtagtgctgcatgcctgtaatctcagctgctcgggaggctgaggcaggagaattgcttgaacccgggaggcggaggttgtggtgagccaagattgcgccattgcactccagcctgggcaacaaaagtgaaactccatctcaaaaaaaaaaaaaaaaaatactctggcagcctaagcaaaataaaaggaagtatactaatgttttccttgagaatttaaagtgctcttggatgaatcctaggcttgcaaaatgtttagaacttacagagtgtgatcctttctttacacttaatagtcaaataactttcctgttttggtctgttgtttgcctcctgttgacagcagcaagggtgctcttaggagcctcaaatcttaatcatcatttttttctttacttaattagaaagactttaaaagcaccattgctaccaagatactcaactttcaccctaaaatctgtggaagcgtgagttacaggtatctccattctcatttcatgggaaggaaaactaaaagcaacaggattagactgtttacttctaccaagaaatgaatgagccagaaataaacaagccaacaaagaatttgacactgcatctgagtcttctatcctttaaccttaagtaaacctcttcactaccagaagggatttatgtattaaatttgcacagaacaactggactacatgcaatatgaagataactaagcagggactatttctaggaagccagttacactacagtaaaacagaggacttctacaccgctactagtaaatgttcagcattagattttctgatagagaaaatgaataatttacatgatattcaaatacgatgttggatactcagagactatctgaagtttcttggtaaggccatcatggaatttgctttagaaagaggaattatgggggccaggcgcagtggctcacgcctgtaatcccagcactttgggaggccgaggcgggcggttcacgaggtcaggagatcgagaccatcctggctcacacggtgaaaccccatctctactaaaaatacaaaaaaaaaaaaaaaaaacaagagctgggcttggtggcaggcgcctgtaatcctagctacttgggaggctgaggcaggagaattgcttgaacccaggaggcggaggttgcagtgagccgagactgtaccactgcacttcagcctaggtgacagagcaagactctgtatcaaaaaaaataataataataaagaaagaaagaggaattatggtagtcacagaattgaataaattttctttttttgagatagaatctcgctctgtcaccaaggctggagtgcagctgcacaatcttggctcactacaactttcgcctcctgggttcaagtgattctcctgcctcagcctcctgagtgctgggaccacaagtgcacgcctccacaccctgttaatgtttgtatttttggtagagatggggttttaccatgttggccaggctgttctcaactcttggactcaagtaatctgccctcctccgcctcccaaagtgttgggattacaggtgtgagctaccgcacccagcctcgaataaattatatggataatgagctgtggcttttttcctgaagtcagatatgacttaaagccagcatacatcctgggggtacggcaggagtattaaactcatgtattagtaatgcacaaaaattaaaaaccttgtccaaatccacatgcttccatttctgtttagctatatatagcagccagtaggaaagagaatagctgatttatcagaatttttataacaacttggcctgagaatccacaggcactttcttcatcttcactgtattttacccctaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacaggtaagcctcggaaactgctgcttactgaggccagtgtggaagtgctttctgcactagcactaggccaggttcaggaaggagccagggctggacatcacctacaggcagttgtccatagtggtggaaaacgagctatgattttagaaatcaaaactggagaaaagccagcatttttttcatatttggcattagtgtggattagattctccagcctcacccccgtgttggatttttctgactttattatacctgtttcagtgtaataaaaccattttgcattccagcaataagcacgagctaatgatgatgcagttgagaagattggagcgataagggagatgatgatgtcttgtcttacagtttctacgtttaatttttcaaagcatttttaaatctctgtattatctttgtttattattgctatatccccagaatgtaggtaaaccatttttatgtatgagagagttcaaataacttgcctaaaggtatttatacatttagtgaccacacataacaataataataataaactttattcatcattttccacatgtccagcaccatgcaatctgctgtacagtcatctcattcctgttcctttcctttttccattagacccgactgtgctgggattttaaaaagtgtttgttgattgcttacaggtgaataatctgcatgtatacaattaagaattaataatagggctgggcacggtggctcacgcctataatcccagcactctgggaggccgaggcaggtggatcgtgaggtcaggagatcaagaccagcctgtccaacatggtgaaaccccgtctctactaaaaatacaaaaattagctgggcgtggtggcacacgcctgtagtcccagctactaaggaggctgaggcaggagaatcgcttgaacccaggaggcggaggttgcagtgagccaagattatgccactgcactccagcctggtgacagagtgagactctgtctgaaaaaaaaaaaaaaaaaaaaaaagaattaataataatatagttaccttaactatcaaaagtctactcaggtatttgtaaaaatctctttgagaaggaacagatagtcacaaccattataatggggaattaagttcatatttcttaaggcagagtttgtaacaagtggtcaatataagcagaactttcttatgtgatatctgttgacctttcattttaaatacctacccaaaccacattaaagcaatgtgcatttctggctaaggtaatagacaatatattctttttccatactcattttttctgttcagcaaataagacctcggataaccccattaactagttatgtgctgctgctgctgcttgtcttaaaggaattagcattcctcaaaaacaaaattagatcaatcaacaggatcccctatgaatacacttcacattttgttctatcccctctctggccactggttttctgttctttgcagggaattagcaataaattgttgtcccccatgcagcagccagcatccctttggcctggaaagaggaggagttgccaccaacattggttaagtgactttcaccatttaccaccagccccacccagaccaatttaggtcaactatgtattttatatttcctctagatgtgttttgccattgcctcccaagcggccttacaaaggtctccagaatcgtcctacctgagcctgtcaatgtacactcagatacacaccccaccagcagtgtgagcagaaggatgaatgccaggagcctggggatcaggacacagtccttattccagattgccttttcctctccggcaaatcagaattcaattcaaccattttctgtttggcgagggagttggggtaggagatgaagcctctaatttgaaaaatcagttgagaaagccaaagttgaagcatgtgaaagggacagccccggagtttaattccctatgaaattaatgatgccaaatggacaagcctttggaagcaaggaagtggtgcccagatgattgaagacatgtggtgacaggcagaaagggaagccctgagagccggggtagtgtgaatcaggcaggctctgctgaaagagccctctcaccttgcaacaggggtaggaagagaacaggagggaggtgggactgaaagccgagttagggaagctaaccaggctggtgactaatattgaagcatcatccacaggcagcaagaccagcccagggcctgggggggttgaaaacaaccccagccttgaggagctgggccagaggagcaaggcagaaaaaacaaaatccacaccagctgggtggggcttcagaacagagccctgactcagaggacaggggactgggggagggtatggatctggagtgttggaggggaaacaaatcaaactttggcatgaggctcaaagcagaggcctgtgcttacaacctggaccacagcaaggtggggagcagagagtatatgggggaggatacagtttcggggatgccacctgacttccagagcaccgtattccaggttgagtgggtggggggaaggccacctgactctgaggacagtacagggcctgcaggtgtggctagcagcatgacgtgacctgctgacaagggtgaggaagctttgactcaggccaagcccatcaggactccagacactggagtcattcacaggctccactttaaggtgctgggagaagccataggcaagaactgatcaggacgaaccagatcccagcatgtatcccgctcttcacctacataaatctcacacattacatggtctcacacttgaaatgactccctgggccatacaaagtggacttttgtcactgtgggcaggggatgggcctgggagatgaggtgacataaatggtgatggaactgggtgagaggtggggatggggacagaaaaagaggagaaagcttgctccagaacaatgaggtacagccccaacaagtggtgattcaggtctctacctatcccccagggtgttgtgagactcagaaggctgtttcctaggagaaacaggcatgctgagagaatgcaggatatgggcaagtttccttcaagtggaacggcatccttcccctggacagtaagccggtgtgcacagaaggccaggcttagcaagggcactgtcagaagctgtgtgtagaggatcggctcacaggccagactccagactcagattcaaatccagattctaagagttgctaacggtgttagcatagggaagtcagctgcagcctttctgagcttctgttttgtcatccataaacagcatttatgaaagcattgctgggaggattagaccgaagaaatgcaagcaggacactcgcacagagcctgacacatatgggaacctcagtaaatattttcagtgctaatagtagtggtaatagcctacttctgatcaagaggtcatgtgaattcattttgagaacttaccacacctccaccaggcactaaacacccagcagtgaaagacaaaatatgaaaattgacaaaataagaaaattgaaatgacatagttgtacccagaaaacaagataaacatcttgtggaccagaaacaacatagaaactctacatagttaagcgggggtggaggcaggcagaggcaggccccaagggcattggtgactgggtttgaagacatgcaggggcaccgggacaggaagcctagctttgatcatcctcttccatgctgtgttagttcgttttcacgctgctgacaaagacatacctgggactgggcaatttacaaaagaaagaggtttaactggacttatagttacatgtgactggggaagcctcacaatcatggcggaaggcaaggagaagcaagtcacgtcttaacatggattgcagcaggcaaagagagagcttgtgcagggaactcccctttttaaaacggtcagattggctgggtgcagtggctcatgcctgtaatcccagcactttgggaggccgaggtgggcggatcatctgaggtcaggagttcaagaccagcctggccaacatggtgaaaccctgtctctactaaaaacaatacaaaattagccgggtgtggtggcgcatgcctctaatcccagctacttgggaggctgaggcaggagaattgcttgaactcaggaggcggaggttgcagtgagtcgagatcgagccattgcactccggcctgggcaacaagagtgaaactcaatctcaaaaataaaacaacaacaacaacaaaaaacaaataacaaaaaataaataaataaaaattttaaaaaataaaccatcagatcttgtgagacttattcactatcacgagaacagcacaggaaagacctgcccccatgattcaattatctcccaccaagtccctcccccaacatgtggaaattcaggatgagatttgggtggggggcacagccaggcccccaggctggtgagggacacacagtatcacatgcctttgtagattgtatagtaattatcatttacatcaataacctcttcaccccaaccacaggcagagaacttttccaacacagaaattgagtggtcttcatctttatgctttgcacttctccttgtgccaagtgtatggtctgtgttcaaaataagagagaattaaaggaaaagactggtgaaatttgataaactcgcaaagaatcagatggacctaatatctgcttttaaaacccatccttgctgctcttgaagagaggtctgggaaatccctgctgatctaaataggttgagggttccatctctgctttgttttgtattagctatgtgactaggaccatccatcaatggcttatttgttatcccgagagtgaaacatgcactgaatgtctcaattttcacctggtcactgtgacgccatacacatagctgttatttctgtacatttccactccatgttcatatagtagaaatgctgttccctatacctttctcctttctagggaaatggataaacaaacagatctacgggatctttagaaatgccttgaaataaaagtttagagtgatatcttcctttgtctcaagatcaaaatgttttcatttcctttgttcatttttctattacagacctcacattccaatcagcaaattagttgtttcagaatcctatgatacttatatcagtagaagtttccaagtaacaaaagaaataataagtgaatgtaaaagtaaaggtaagtggtattattctgaactccatctgtacatacgtgattatttctctataatggttaataggttattcaagatgtttcaacttgctttggctaaccaaagaaatgtatttccagattttcttccagatacttttacattaaatttgtaatattctctgagttcctaaaatggtagatattccaggggtttataccagacttagttactattcttaataacttaaattctgcgttatagctattcttcttgcaccctgtgaaagagattccctcttataatttccaaaagctctagcatgccactgttttgcctataattgatgcagcggcatgcacacctacacacagcacacctacacaaacacatacaccttccctgctatcaccaaccaagagcagtgttgtataaggctcaagtgtgtttgctattgaattttctaaacactgagctcaaatatttaatatgtaagactgttcactatcaattttttagtgaaaaaggcatattgcaaaaaaagtatggacattcccttcatctctttttttaagttaaaatacttatattcaaacagtaggcagccatgagcaacagtattatgaatgattcccaccttccagttttcattgattagccactcactaccataaaggtacacaacatgttctatcaaccaggaagtctcaagtgctcatagttctatagtgggaacacttaaaactatgttagaaggagttgcacagacagccctatggacacacaacagtcctgtatcttgattgtcatggtgttacaaaaagctacacatatgatagaattgcatgaactgtatcgtcacatatgcacaaacgacttcttgcacacctgctaaaatctgaatacgctgtgtgtattgtaccagcgtccatttcctgggtttgatactgtaccatagttatgtaagatgttaccattggagggggatgggatgaagggttcatgggatcttgtcggtatgtatgtatatgtatgtaaccctcccataaatccataattattattattatttttgagacagggtcttgctcctgacactcaggctggagcgcagtgatgcaatcatggctcactatagcctcaatctcctgggctcaagtgatcctcccacatcagcctcccaagtagctgggactgcaggcacaggccaccacacccagctaattttttaaaaattttctatagggacagggtctcactatgttgctcaggctggtctcaaactcctgaactcaagtggtcctccctcctcgttctctcaaaattactgggattacagggatgagccaccacacccggccccataaatctgtaactattttaagataaatgttttctttaaaaagattaagctgccttatcagtaacaaagcactttcaaaatattgcttaggcaaattgtcttcttgagtgtgtttgctcccctgcagagcatttagttagcttccagtatttgcaaagtttccgtgtctttatagaaacagtcttcccataccttgccattttcccccaggaaataacatcctgattgtggcccacgcatcttcccttgaagcgtgtacctgccaacttcagggcctgtcacctcagaactccaaggacttcgtacaaatggtccgaaaggtaattcattctcgtactttggggtccgtgatggctagtagtttgaagtcagtacagtgactggctgattaccaagttctttgaagcatgtgtttatgctgagctgggaatattcatttattgcttcactcaaccaagatgtattgagtgatactctgtgcagggcactttattaagccttgtgttagaaaaacaatgtatgagagctagttctagcttctaagagctaaaatgtaggaagcagctaggaattataagcaaattgtctggatttccctgagggaccttctctgaatttccctgagggaacttgggttggatcaatagaggtcagtccaaaagacagcatctgaaagcttaactcaaacacaggtccttgaaggtaggccgaggcatgcagcagtttcaaatgaggaggctaaaaggcaaagccaggaacaagacagcaagacagaaaacccatgaggctgacccacacatctggagtcttcctttctgtgcctgtgggagaggttttctggtcagctgcctcccacacacttcccttcaggcaaattacatacttcctttctctgccgccagagaacctggttcaaactcaattgcaatcttttttcacatttttgaaaagtttatttatgcatctgtcctcatttgtaagtgctggaagacagagaattttgtcttgtttgtaaatgcagctctggacacagacaaaaataagttttaaaattgctgtgacaactgaagtgagggagagcacagcttcagctttgaatgttgcagagactcgtaaggagaaaaaaaaaacgggtgaaacaaattttttcaaattgaaaaatattttccattgggtccaagtataatttcagaaatgtttgagctgactttttcttttcttttttcttttttttttgagacagagccttgctctgtcacccaggctagagcacagtggcgtaatctcggttcactttaacctctgcctcctggattcaagcgattctcctgattcagcctcccacgtagctgggattacaggcacatgccaccacgcccagctaattttttgtatttttagtatagatgaggtttgccatgttggccaggctggtctcgaactcttgacctcaagtgacccgcccgcctcggcctcccaaagtactgggattacaggcgtgagccactgtgcccggccttgagctgcctttttacctggacttgcaattgggaattaactcctggcattgtagccttatgtattttggtcctctttttctgccacccaattaagcagcaatctatgaacaatgacttaattactttaggggaggtcaccatttaatggatccttctgatgaatcctcttgcaatgtaaatactcttctaagttaccagttttacccattttattttatttatcgatttttgaagggaatgcatttctacaaagccactatccatttctgactgcaattctctagggccacatgaatatctttgtatttaggtaaaagttaaagcattaaacctatctcctaatatcccctttctttacgactcttacttcagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgaaaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgaaagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagaagcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttgatccagagcaatgtcattttaaattctgagtggtctcttcctatcatgttttcagatgttactttgttcattattatttcataaatgtgcattcagagtgtgattctgttttcaaaaggccagagggcgctttctgctgatggaaggggaggatgctccagcagcactgtgtgtctctggacccttctgaccaggcatcaagcctccatgccattcagactggggagctgaacacccactctgtgtgaaaatagcaagcttcaaaatgcttcccctgccctatgtgcaaactaggagacaaaaaatatatttccttctacctatcctaggttcatggctgaggcccctataacaaaacatagattaacaaaagaaaaagcatacaagtttttcatgtcttggggccaagggaaagctttccctctgccctctaaaggttcactgaaaatgactgacaagaggcagattaatagaaaaagcataaataaatttattaactacgtgagcttgtagagtatcacagagtgagtgcccagtctcccaacggggtacagatgcttatatgccctacatcttaggggaaagagaatggggaggtgtgggtgattttaggcagatagtaaatgatttttaaggaaattcaatggacttgaagaacatacaatggtctgggacaaagtcggtcaggcctacagagtggacagtcatttgggacaaaagtctgtccaggtttgttgtcagactttagtcttccatcctgtgatgtgagttcagtcaatggaaactccgagaagggaccagaagtaattgtttccttctttggtagatatgagaataacctcatcctgtgctttgggacaggtagaggactgagaggggatagaggaaggaaaagcaattgttctccttggtgggcctgtccagtctttatgtagataggggaaaggtttcttttagcatctgttgatctctaagggcctttaattcaaaatactcacctgggtgtggtggctcgcacctgtaatcccagtattcttggagatcagagccggagaattgcttgagcctaggagtttgagaccagcctaggcaacatagcaagaccctgtcactacaaaaaaatacaaaaattagccaggtgtggtggtgtgcacttgtggtcccagctggtcaggaggctgaggtgggaggatcgcttgagcccagaatgtctagctgacagtgagccatgacagtactccagcctgggcaacaaagcgagactcaaacaaacaaaaacccaaaatactcattataccagggagccatatttgggggtgaagctccctgttttccttcacatgacacaaaagccttcataaggaaatgaagatttgaagaaaactagttaaacctgaatatttcaatgcaaaatttgatgaagaatagatagtcatggagaaacgtgatagaactaagagtatgatctaatggtaataaactgggaggacttaatgaggcctgtgtgttcagattcccctgggtgtccctctgtcttcagagatgagggtgctcattttctcccgctctagggaaggcacctttcacatgaagttctcaggacctgcgtcaggaaaggttagagtccttcctaggttttatcacctgattcaggggagaagggtggggcgggggagaacagtcaaagtgaccttcctgctcctgtttttttctcagattccttcatcttaaactattcaataggctgagatgcaatattttcgggtatagtgccctgaactccatgtcaccttcatggtttactactacccaccatctacctcaaggagttgcaccaagaatgatccagagagtgagaatttgggtaagagagagggcacattcagctcaaactagaatctgcacttctaaaagccatagaccattttttgttgttgttgttgtttttatgtttttgtttttaagatggaatttcactcttgttgcccaggctggagtgcaatgttgtgatctcggctcactgcaacctctgcctcccgggttcaagtgattctcctgcctcagcctcccaagtagctgggattacaggcacctgccaccactcccagctgattttttttgtatttttagtagagacggagtttcactatgttggccaggctggtctcgaactcctgacctcaggtgatccacccgctttggcctcccaaagtgctgggattacaggcgtgagccaccgcacccagctgactctatttttttgaagtaattatatgttaggctaataagatcttaaaataagccttgaatgcaaatttgtaccgaggacatgaatacagattttcattaacccaactgtctactaccttggcagggtttacttcctgaggaaacataacagctaatgttcatatctgacaaaagaccaggctatatttagccttctggctggttctcagccattctctgcttgacagattcccaaactcattctgctcttttgtgatgtacgtaaaggctgcttgcacatccagagaaaacgaatagtgtacttgggatttgtttaagcttaaatcagcaaagtgtctgtttttggtttttttgttttggagggtttatttgaaagttgtttgaggaccaaaaacaatcttcttcctgaagaaagaaaatacttcactgtgccagaaataaacatgtaaagcccaattggcttggttctggctatgtaaagaggtaggggcgtgaagggaatgtaccaagggaacgtaacaagggaactgggtgaaagatcaaaagtggtaaaaggaaggaaagacagaaatgataactggtaaaacaagttttagaggagccagtctggaagttttccaaaaaggccaatgacgttctagttagcaaaaaggaaaaagaaaaaaaaaaaaggccaggcacagtggctcatgactgtaatgccaacactttgggaggccaaggcaggcagatcagctgaggtcaagagttcgagaccagcctggccaatatggcgaaaccctgtctctactaaaaatacaaaaattagccaggtgtggtggtgcatgcctgtaatcccagctacttgggaggcttaggcaggagaattgtttggacctgggaggcagaggttgcaatgagctgagatggagccactgcactccagcctgggtgacagaccaagactctgcctaaaacaaacaaacaaacaaacaacaaaaaaggtggggaatgtgggataatttggctgactaagaagttctcatgggagaaataagatcccaacaagaggagaaaagccttaaaaatatatatagtctgaatatcaccttttaattaagctgacttctgagaataatgctctttttaaaaatcttttaagtatatcattagcagttttgggcaaacagcaaacattctcatttcctggcttttctttccctgaagtttgcattttaagagggatggtttcttaggtaagacaagggagagaattgacaggtacagagaaatactgaaagtttttagaggttcagggtaattaataatcaaatttctcttttgagtacaaagtacctttttagctcaaatgagaaggcagaaagcaaaccaataaaacaaaaaaaaaatgtttttaacatgctctgaatataaaccaaaattttaatccaaaggtatattcaacaagtgactcaagactcaactaataagcccctttatggctttaaccaaggtggcctttccaagatccagaccactctcacaggacaaccaaggaaaggaaagcttagctagccacaaatggatgtaaacccacattttagttcacccatattcttgaggcgctcaactttttgtttggctgcctgcagcaaagaaatctgggataacctacatgcccctgataaatggagaatcaaaaagaaagaacagtcagtaagacaaaacaggaaaacaaaagttgtccatctttgcaaaaattatgactgagcaaattattacagtgaaagagatctgacctaaccaattttgtctggcttctaacctctaagctgtccttgttcatttctaggtgtaggccaaactaacttggggggaacttagtttatagtttaactttgaaacaaagacaataacagccttctccaaaaacaaacccccttcttgtcaggggactatactgcctttgtaggactaaaaaattagccacaggattagaaattatggcttaggagtcattgctgtaaaatctgagatcagtgtttgagatattttgcagaccctgcattgattgatacaccagctgatgccacccaaattgataaactgggtcatctgattttgtgtcatccacccaggaactgacagcacaagaggacagcttcaaacccctatgatttcatcttctacctgaccaatcaacactccctgctttctgattctctacacaccaaattatcctttaaaactccaattccaaaattttgggggagattgattttagtaataactttgtctccccatgtggcatggctggcctcacatcaattaaactttttccttactgcaatgccatggtttttatttgtgcagtgggcaggaagaacacattgggcagttccaaatttgagggctcatccaggatcacccttgtgactactgcttgtggtttggtagccccctctccagcaatggatctagaggccagcccaagaggctgcctaattctcttggactggaggctgtctctggcactgtttctactggcagggcattgacaatccatggtgcatggatttcattgcaatggagaaaaagtcctataactgtaaccccatcattagatgtctgtctgtggtcctatcatggggtgtctgatttggtgcatattctaggtgcttccagcacctcctttcttctcctgattggtttggcttcttctggggtcttggttcagctcctttaaggggcttggctgaatctccctaaatagtaggaagagtcttggttcaggagatttttccttaatcaggaagattttggggagatttctcaggaagagagtaggtggttagtttggaaagaatacttagaattattggttagggatctttgtttagaaggtcttctgtctgtcttgtgtttgttgtgtctgtgtttgtatatgtggaggtgatctctgaaaaaaatgctaatggaagtcaagcaggcctaacttggagaactctccttatttggtcacattaggtaaaccctgaagcaattgttagcagaagctccacaggtctgacacagggtgaccatctgctcttcatcttgcccacagatcacccactgaattcgcagttgaaggtcatctctccccaccttgagtggatcaaagatgacagggatgaacaggggcaaatttgagccttgccaggtcaatatcaggtgctgagaaaggtgactagtgtctattttgttatatgtattttgctttggctgggatggaaaatgttcatttgttccccaggcagtctgttgggcatcatcttgcaaaactgacaggctt

SEQ ID NO: 1535 - DNA, 1938 bp, Homo sapiens
acaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgaggggtggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgaga

SEQ ID NO: 1536 - protein, 595 aa, Homo sapiens
QKALASTGGRSVQAACDWLFSHVGDPFLDDPLPREYVLYLRPTGPLAQKLSDFWQQSKQICGKNKAHNIFPHITLCQFFMCEDSKVDALGEALQTTVSRWKCKFSAPLPLELYTSSNFIGLFVKEDSAEVLKKFAADFAAEAASKTEVHVEPHKKQLHVTLAYHFQASHLPTLEKLAQNIDVKLGCDWVATIFSRDIRFANHETLQVIYPYTPQNDDELELVPGDFIFMSPMEQTSTSEGWIYGTSLTTGCSGLLPENYITKADECSTWIFHGSYSILNTSSSNSLTFGDGVLERRPYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGEALLESNTIIDHVYCSPSLRCVQTAHNILKGLQQENHLKIRVEPGLFEWTKWVAGSTLPAWIPPSELAAANLSVDTTYRPHIPISKLVVSESYDTYISRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 1537 - DNA, 95845 bp, Mus musculus
  misc_feature (1)...(95845): n = A,T,C or G
gcacaaaactggacatcttctggagattaattttctgtccactaagatcctgaatgtcattcgatatgaacaccaccatgtgtccaggcctcatgcatattttacatttttttcacgacaaagcagattaggtaattgctgtaagacatacagagacagggacaccaaacacattttaagaaaacactcaatgttttaattagttatagttcttctctcttcattgaacttaattttggtgtgtagctcagtattagagcaagtgcctaaagagtgagaccctaggttccatcctctgcgctgaaaacaagtaaataactaagtccatatagatggtctgtgggaaaggaagaccccgcacagagagagcaacgagcacagaacgctgaagtatctaaagtgagtgagcctttgcaaactcagggacactggtcaggcacacagcagcagagccaagagcagcttttatagcccagacacagctcccgccgccacttcctctttggctgaataacgaagccacagccacacgcatcacctgcctcttacatttatctcagcacaggctgtacataggttctctctgcattttatgtcctgtttgtttttaagggtcagtaaatgagtaaccgcgtcatgtctgcaggttgctgtgcaaatgttgatacatttctcttctaaccttagttttgttgggagagcttgaccagtggatgacagcagggacagcatcttcttttcctctgtaaccggccttaagctgactcaaggcaccattgtcttaacaatggaccacttatcattccttttcttaggatatacttattttttgttttattaatataagtgttctgcccatgtgctggttagttttatatcaacctgaaacaagaccaactcattttgggaaaaagagcattgaaaaaaaaaatgccctgactagattgacctgtggacaaagctatagtgcattttcttaattagtgattgatgagggaggcccagcccactgtgggtagtgtcagccctgggctggtggtcctgggttctataagaaagcagactgagcaagccatgaggagcaagtcagtaagcagcacccctcgatggccactgcatcagctcctgcctgcaggttcctgctctgtttgatttcctgtcctgacttcctttgatgaggaactgtaatatggaagtgtaagtgaacccctttcctccccaagttgccttcgatcacgatttttcatcatagtaatagataccctaactaagacagtccacatgtatgtgtgtgtaacttatgcatgcatagggccctcagaggctagaagggggtattgtgtcacctggaagtggagttacagatggtcatgagctgccatgtaggggctaggactcaggtcctttgccagatcagcaagtgctctcaaccactgatctgtctgttcatttggggttgttgttgttgttttgttttgttttgtttttaccatatgggcagagtgcatcctaaatttgttttcccaaagtaagtacattcaagtgactattattgaaactaggaagtagaacagtatctcttttgtgcccctgacagttgtgccttcaccctgtagttactgtcccaatgtctaacaacacacttcaagcttttcttaattggggaatttttatatgtatggagtttcacagtgaatgccacagagcctacaatttctttctaaagaggtgaaagagttagggtgttgagccaaacacattatatatatgtgtgtgtaaaattctcaatgaataaaaaagagtcactccaataaactagttccttcatttttcttgacatttaataatcctttatatgaataccctgtagcttatatatccagtcttttcatgaggatcttttggtattttttaatacttatttttaaaagatttatttacttctatcttacatgtatcttttgccagcatgggttcaacctgtccatgcagtacccgtggaggccagaagagggcatcagaaacctatggaactagagttacagatggctgtgagaatcaaactcaggtcctctggaagagcagccagtgtttttaaccacggagccatctttctagcctcttttaggttaatcataaacattctggcacatgtgcagacgtttctgttgagtttctctgcaggaagagaaatctgaggtcacatgttcaccttcagtagacaaaaatcagggcttccaatttgtgtttccaacaacaagaccacacttctgtataggtcatttatttctgctgctaagattcaactaaaggagtagatgtggaccatgggtagacagccagaggttcctttgtaaatggcaggaatatgaccgagtacaaccagtgtgcaaatcagtccagaggctcttcaaaatattaaagatagaattcacatagggtcaagctaggacactccagggtacacaagccaaagagccaaaggcagattactaggaaggtccctgcagacccatgaatgtcaatgcccatcactggaggaccaacagataaaggaagtgctaactacacacacacatacacacacacacacacacacacacacacacacgatggagtgttattcatgtataataatgaatgtaattgcttgctcagagatggatggaactggaggtcatcgtgttaagtgaaataagccagtcttactaagagatgcaacgtgtgtgtgtgtgtgtgtgtgtgtgtgtgtgtgcgcgcgcgcatgcgcgcacgcgagtgttcctcctttctgtacaggatgatgtcagggcaacatgaaagtaaaacatggactcccagacgaggaaagagggaggaaggcaacagaagcaaagagcagtggatgtgatcaagaacaataagaacacgcatgtgcacaaacgtccagagagagccctcagcttgtgaaataaatactcactaacggaaggatcctagcctcacttattagctgtgaaggttgctctggggaatttcatgcaacctcagatccctgacctgtgaaaggcccataattgaatgttcttgaaaaaaactcaagttaggttttatgctaaaggcaacgtgtaggtctcttccagtgcccctgtagtcatctggcattagggcagctttctcctggcagtgttagcataaaggacaccaagctggggaggcctgggctactgtgttccttctgagccttcccacagtctctctgaccctcggtttttcaagctgggaaatggagaggataagactgctccatgggaattacaaggatctaaagctttcatacaaaatttaacaattcacaaagttcagcttttctctcctaagatttcagttctctgcctgttccggtgaaccagatacttagcatatctagaatgtctgtgtgtcaccctcagaagaaagttaactgttgggagagcaactgtcaagctggcctttgctgtaacccttattacaaggacctgaagacatagagcccactcagttcatgttacagatggggaaactgaggccgaggtctgtgttggcaccaatggttagtagcacagccaaagctaaggccagctctcttgccaaatcccagactggttctttagtagctttgtataagcaataaattgtattgcccgtgttaatgaagagtcagtttattaaatgtcatccaagtggtaggggaagagttaaagtcgcattttatccatctgttaattaatcaaattttgctaaactttaaaacatagaaacgggcaaataactatctgcatttaggtttcaaatactatctcactttcaaactattggagaactcgagcctccagccctgccaggaaaactgatatgagccttacccccctgccaaaaacaaccgtacggccagacaaacatatgaggcgactgtttacacaccctgaacggcaggcagtactggactttgaagaaaagcaggcacctgagatgaaccccgttagttctctggcttcttcttctgatagctttctctcaatgtgcgtaagtgcagagaagcacaaggtacagttgctatactgtcatgagcaggtcggcatagggttcaggttccagggtgatgaagaggctgtgtttcatggaaaagaataatgaacaatggacaacttcataaagagaggctctagaactctctagaagacctggctgaaacacaggaaggcttttttttttttttttttttttgagctgtaaaagccagcaggtagacgtcatttaaaaaaaaaaaaaaaaaaaaggcactgaaggcactgaggtgtgggccatgctagagacctggcatgaagtcccagacctcctgtggagatctcataaagaccatgagttgggtgaagaagtatgagcggcactttagaccataaccaaacaccaccataaggctccatttaaaattcaattagacggggctggagaggtgggttaatggttagggcctgtgttgagttcccagcacctacacagcagctcataagcatccgtaacgccaactccaagagatctaagaccctcctgtggcctctgaaggtacccacatgaggctcacaaccatcttaaccccagtaccaggaaatctaatgtcctcttctgacatccccaggcaccgaacctactctcagaactcatgcaggcaacatattcatacataaaatcaataaactaaaaatcaatcttaaaacaaattaaaccagtgattgtcaaacttcctaacgctgtgaccctttaatacagttcctcgtgttatgatgactccaaactaaaagaattgttttgttgctacttcataattgcaatcttgctactattataaattgtaaatatctaatatccagaatatctggtatgtgacctctgcaggggttgcgacccacccaccggttgagaaccattgaattaagccaaccttaatggagaaaaaaacagaccactaaaaaggctactgtttgatgaactcttgaaagaaagagtatgggagaaacacatcttcaatcccagcacttggagtagaaatagaaagatcacgagttcaagtctatccttggctacttaacaagttcagggccaggctcagctaaataagaccctgtctcaaaataaacaagaacaacaacaacaacaaaaaaataccctttaaggaaagatgccgtacttgggaatcacctccatccctgagtttgtttatgcatccattataaaatcgggggttaccaactcatgaaagttgtccactgaccccacacacacttgtgccaaggcatgtgcttacacacacacacacacacacagtggggacagaatatcaatgaatgaaagaacaaatgctctaggttggaggctcagagagttggcttagattcttgagctagaatctgtgactgcttttcaatcattacctgagcatcctcacatatgttacttaaagttacccgggcaagccacttttccacacttcatctcccacatccacagcattggtagaacccacaatgctgacccacagtgaccataccaagagtcagtgtcccctgtgaactcataagcttggtcaccagctgttggaactattttgggggacctcgagaaacttgaggacatggaagctagctggagaaagttggtctattgggtggggccttgagggtatagcgtcccattttctgtcctgctttctggtcgctgtccaaggtaatttgactagctatcgtctgccacatgcttctgaccaggggcacaggcccagagaccatgggctgaaccctctgaaatcataaaccaccatgcatctctatctcccttaagttgtttttgttgggaatttttgtaatatcaaaagttcataatattagccttcaggagtgcagggttaaaatagtgcctagaacagaccacatgctactttttgaaggtctccttaatatgtggattgttttcatgggcttcaaaaggaagacattacctagaagggagaatttggttgaagcagccaaaattcaaacacattcgtttaaatccaccactcttgtgaacactggaagccactggcccacaggcagcacaagactgctttcagcttagtcaacttgagcagtttccaatgtggcaatggaaagtaacctcacagacaacactaaaaggcaaatgatgaaactgggtcaagcgtgctccaattgagggcattgacgtggatctacttcctttcacggtaagaaatacagaggagcagtgcatgaaggactgccggtcaaggagtattattcgtggccagagcaggcagtgctatcggtgacacagcatcagagatggtagagtctggcctgaagctgccgctgtgcctctgggaagggcagagtcaggaagggggccttcctccatctctcttatgagggcagaggagacaggttatccatcactacatcataatgctcaaccggcgtgaagtcataaagccagcagtgagacagatctgttccagcgtcagccagctcacacatccctcccaaactcaaagatggaggcagaatgcctgagcaaccctgtggagcagccacttacaggagggacttcttgagcatagactgcctgccctgcctggtattatgtatagtgtctatctggaaaccccacagatttatttgttgaaatgcttagtgatgctcagtaggtggcgctattttgagagagtattagaattagaagccagcctttgttagaagtagtgggtcttgggggtcgggggtgggaggtcctcgagggtataagatccctggctgctgatccactgtgaagtgaatagctcattgcctcatcacatccccaatcaccgtgatcctgtccaagcccctggggccaagcaaacatgggcttaactctgaaactgtgagccagtatcatgccttccaccagaacttgtgtctgtcaggctttccatcatagcatccaaagggtagcaagcacacctgacaagcctaccggatccaggagaagggggcatagatacatgcctgccagcatacataataaatgtggatcaagagcctactccacaccatggctgcccttaggagcatgaaaccaaggatgaccccagtcatggtggtgctgagcttccagtaaaggtactgaaggacagcgacaagcttaagcagcgggcgtgttgcatagcacgttggaaaagcactgagcattcgggaaagaaagtagaggagttgggttatttggtgggggtagagtggactgcagcatttaggagggcaaagtaggataaagcgtgggttcagaggagagaaagaaggtctcaggatcaaaatatagggcaaatcttgggttcatggtcatataataagataagaacctgtggcagtccctcccccgaatcaatagcttaagcagaagacctgtcatccacagaactcttagaagaaaacacaggatatagttccgtgacatagatttagcaaacacctaaaacacagaaggaaatacaaatcggtcggaatgcatacaaatttgaaagctcgggtggacacgaagagcagccaactaaagcatgtgtgaccaaacctgacaatctctgagttcaagccgcgtgacccacgcggtggaaagagagaaccaacgcctccaagttgccctctgacctccatatgcatgccataatattctcacacacacaatcaatcaatccatcggcttaaaagattagtggtaaaattataatgcactgaaagttatcatcaagccaggaagcagttagacccagcactctggaggcagaggcaggcagagcaaggtcaacctggtctacagagtgagtcccacgacagccagggacacacagagaaaccttggtttgaaaaaagaaaaaaaaaaggaggaggaagaggaagaaaaggatgaggaagaagaggaggaggaagagggaagacgagggtggggatatgtagtagaagggaattgacaaatgataaatctgttgagtgtttaaatgcagaacactaaaataactccaaacaagagctcactttgaaaaacaggcaaatgagttaactaggttttcttcaaggaagaccaataaaatgggcaacacacgtgttgcaaggtgttcattacttctcactggggagctgctaatcacagtcacaaggatgtactgcctcacacctgggaggatgaactgtgggcgagctgcacaatggtaaagccacaggagcaaaacagtatgaagaccaattcctcataatacagataataaaattactatccgatatagcaatgtctcttctgggtacatgcctaaaaggatagaaagcaagacgtgcgtgtgtacaagtatgccacatgttcacaacagcattgttcacaatagccagaggtgaacccagaggaatggataaactaaagtctgtccatacagtgaaatattacacaggccagaaaaaaaaacccacacatatgttacatggatgaacctcaggacactgtataaagtgatattatccaatcacaaaatactgtggtattattccacttctaggaagtcgttgaagtagtcaagttaatagagacaggggtaaactgacagtagcaaagatctggggatgcagagttactgtttaatgagtacagagttttggtcccagatatgccatgttctagagaagatggtgaagcttgcatgccctagcactgaacgatctgctttaaaatgattaggatgggggctgtgtagttaaaagaacttgctgctcttgaagaggactagaattcaggtcttagcatctatccagggcagctcacaattgcctgtaactccaactccaggagatgcaatgcgctcttccggcctccataggcacctgcacacacatgagcatgcacacacagatactcactatttttctttaaaaatgtaaggttaacatggccatttttatgttacatgtattgagtgcaatcttaacaaacaaggagaaagaagggggatgttttgagtagccgctgagggagggagacttgaattcaggcagacaagcagaaggcagttgacattgtgtttgtgtgacacaaccacaccctatccccagacttaacgccccatcagtgacagtgcatatgactgcaggtcatctcaaacatatccccatgaggctagctccttgtcttagggagaatacacactactgcactgaaccaaaattccagaagtctccagaaaaggggatgaccccaagagtgcagtgctaggtctagactgagacacccacagccatttgccaacgagatatgagcttgccaggaaagcttgaggaaacaaaaccccaagccatgctccaccaagagcgaggacctggcaccgtaaggctccacaggctggatggactgttgatttgccagccttgctcattgcttcaccatcagcctccagagttggctgataatgaggtctcagacataccagagcctgaactgcaaaagacgtcagtgaaccgctgatctcacagaggaacaagaacccaaaagcaaaagaagggaatttttaggcgcctttagaatctgcccatattctcatgcggtgagctgatctaaaggattgcatgtttggaaagggaagaggtagccaagaatcatgctcctcccgggcaaacgaagccatgcactgagatgtggttggatcttccttgcatggggtcctggaaaggctctggaagtccccggacacagctgcttttgtgcccatgggaatttataggataggagtaaaatgctataaagcagcgcccacaaggaccctcccataggcagaggacagaggactcaggaagtcagggagaaaaagatacttatctttgagcctgggattaacatacaccctggacctcggagaacaaatgaggaccacagctattgctcatccccgtgcccctccagagcctccaacaggggcatggtggaataccaggatgaagacgtaaacaacgtctacccctcctcctacgacaaactaaggtacagttccaccaagttcaccaggagaaccaattagtttattggcctcccttacagagctatggataaggagttacaggcgagatcacagctgacaggcacagtggagggtctgcacacagcaagaatgatagcctcccagtggctgtgggagggagtccctccctttatccttccccacctatattctctagcccctctcagagacactgaggccacctgcgttgagggaagaattgcccagaactggttctggatactcaggtgatggtcccatgatcctccttccaaaccagaaaaccatcagtcagcaagccagccttgttgatcagcagactcaggtgaactcctgaagatggtgacagctagcctcagaggatagttctatacaatatagggtctttctggcctgttgtgccgtctcagcagggagagagtctttgttcaaagggccatctgccactgtgactgcttaatattcagtgtcactctcctcaggtcttctctagccatgaggcaaccattcatatgggcttggtcaccttgatggctaatctggttgtcaacttgacacaccagggaagagggacctcagttgaagacctggctctctcagattggcttatagccacacctgtagagcattttctttattgctaattgctgtaggagggccaagcccactgtgggcagtaccatacctaggcagatcggagtcagggagctgcatgagaaagctggccgagagcctgggagcaagccagtaagcagcactcttccatggtccctgcttcagttcctgcctctaggttcctgcctcttgagttacttccctgccttcctttcatgatgaatgtatgctgcaaataaacccaagttgcttttggtcaaaatgttttctcactcagacagcaaactagaagaccaccggagctccttaaaagcccagaccctagagctcaaggaaagtggtagagggaaggagccctttaattccagccttggtgatgactcgcaaatgtagccagatgtctaccattatctgcaattctacccagatgtcttaatcagccgtgcttcctctcctttccccaggcctttcccttcaggcttcccaccatctccagagcagcctggaagccttccaggaaattcctaatgtgttggagttagtttcagttgcctgtcagcaaaaaaagcctgatgggtacagatgggcaccaccccagggtttgctgctaagaaacatcaaaagtgtgtgcacccgccagtgtgatggcacaggcttgttatctcggctacttgcaagactgaaactgactattgcaagttcaagatatgcctgggcaatttagcaaaatctttgcaaaataaaaaaacagtgaagatggaacttgttggcagagcccctgcctagaatcccccagtgaggggctaggggcgtggctcggtggtagagcacctgcctagaatcccccagtgaggggctaggggcgtggctcggtggtagagcacctgcctagaatcacccaatgaggggctgggggtgtgactcagtggtaaaacaattgcctaatatgtgaaagggtgtgggttcaaatatcactaaacctctaggcaaacactcccttggtcccaagaggctccatcttagcaagattagtactctggaggttgaaataagggtctgtgaatttggtttcccccagcaaaggacttcacgttctctcgaggaccccaactggattctcgggttgggtcagatgcccaatacagaattccaaatttgcttttacctatggtgacgcacactaatggtcctgtcctggtttgatttctgttgctgtagtaaaatactgaccaaactgacttccggggaaaggaaacatacaggtcacagtcaagagaagtcagggcagtcgctcaaggcagcaacctggaggcaatagttgaagcaaaggccatggaggagtggtgctccttcctggcctgctctcctgacttgctcagtctgctttcttctacaacataggactacttgcctgggggtgggcaacccacagtgggctgggccctcccacatcagtcattaatcaagaaaatgcccacagaccaatctgatggaggcacttccttaagtgtggctccctttttcctggtgactctagtgtgtgccaaaatgacaaaaactaaccagcacaaatctgagaagtaactccctgcccattttcctgcaggtaaaaccaacaaactcacctgttcgccaagctagacctaggtgaaaccattgtttgggggtgtggttggtgccctcccttgggtgaacaaacacttttcacatctctgcagaaacaattagcacagcacctgaccacctggttgggcctttgtgccctttcttcccagatgaatactctgtgttagttagatcttagtgtctacccaacataacctagtatcacctgggaagagggaatatttaattgtcttgtgactattactgtgagattgtgttgattgatgtgtgttagggcccagcccactgtgggcagctccatccttatgcaggtgagcccaagctatgaaaggaatgaggcagagagtgagccagcaaacagcattcctctgtggtttgtttcagttcgtgttttagcttgcctcggtgatggactggaacctgaaacaaatctttccttccccaagttgctttttggtcagagcattttttcttttttccagcaacatcacattgaacacacatcaacactgcacatctgaggggcttctctttatctctgcctggacacagtgtggtgaagccagcccagcatctctgagttctcttgcccttgcgtgcctaagcactgcttgcttctcccgcttctcccgctgagaagctgggccaccccctgagttcacttaactctcggcatccatattccctgaagagcatgcatgtatgcttgaaacccttaaacaacccctcgccatatgtgtcgatttaaatggaaaccaaacggggaaggattctgacgacagtctgtcaccgactgagctctgcttcctccagttaatttatgtcttccgtaatcaagtggctgctttttaaaaggctccacctgggaaggcacattttcccccatacgttcacattcgaaggtccccagcctgagtgttaatcgtcattttaagacacagcactggcagagcgtttatcttccgagctctttacctgtattaattaattagtgctataaatacgaccagcacatgactattctggaactaatcagtcactgactcgactctgggcctggaggggaattagggaaatcgaatctttccgaagttgggtccagacaaaggtaacgctgtcagttctgtccttcgggctgatggggaagtggctggctcaggctccagctatggacacctgcagtttccaggacaatccagcaactcaagctgaagagacacaaatctatcgttagtaacgcacagttaagcttccttgctggttaggcataccatgatggtctaaggtctattcaatgcctgccccgggatgaacactgtgttaggagatggcacaggcctttcctactaaattgttatggcagagttaagcaggtaccagatacaatagaggtcaaactccttcatccccaatacagtcgtcaccatcatcatcatcgggaaactcctagtggagaaaacattacaggagcactaagtcatccatgaagtgttcatcatgggggccggagagatagtgactcggtggttaagagcacttgtttttgcagaggactcaggtttgactcccagcacctctgtggcagcccacaactgtctgtaattccagtttgaggacatctgatgccctctttgcacatgatgcatgcaggcaaaacactcatacacatacaataaaagtcgtttttaaagtatttattagggctgaaatttgaggatgtaagccaatggaagaaatatgtttaaccctcatgcatctgccacagacacaaacacacaaaatacacacgatagatgcatggatggatgaatggatggatggatggactgcataccagacttgctaggaataaaacaacttagtcttcacacttgggcttacaactatatataacaaccgtagtaaacaggactccattcacgtaaagtctgggaggcagagtctagcaaatcctactctgcgttcttcaagtcactggcactgggcttgtctgaaaaggtcggagagagaaaggttgttggcttgaccatggctttccaagacccttgttatttctcaaccagaactgctatttcgtgtatgcattaactctgagtttatggatgcagtttgattctgagtttggctgtaggaggtcctgacagcctgcattggccatcagtctagtatttgttcctccatcaaagacattgaaatggtggtataagaaaaggcacctcagagcccccacgactggcctagaattgacattcctctagccatacttccttttgtctattcctctagccatacttccttttgtctatttatttttattttaatatgtgttttgcctggatgtttgtatgtgcaccacatatgtgcctgttgtccacaagataagaagacagtgaagcccttggaactggacttatgggcagtttagatggctgtgagctgccatgtgggtacttggaacggaacccacatggctggttcccagcacccaagtggcccttggtgttaagctgtcactctggccccttgttcaatttattagtttctcatcatctgcaatacggagaacttccctctcctggagtttttccatgatttgggagctgagatggtactcagacctgtgagtgctgtcccccgactttgcatttgcttggcttaccgattaaatgcggtgctagcgtgtacgcaaggcatggaccccagaagcaaaggactaggaaggtgcgacacaccaaccccagcctggcactgaggaaaggctatcggggagtctggctaggaatgtggatcttcttagggaagtgtccgtgagggatgctgagcaccagcctctgcctgctctagtggagaggggtgaggtaagaaggagagtctgaatttgctgccctccagcagggtgggtgggagaagtgtctaatgaaaggaaagcgctaaagggcaaaggcagcttgtgggcaaggagaggcacgtgtcaccacactgagcacacatgggtcacaacaaaagacgctggtgagagtaacttggaagagagaagcatttatgatgccagagtcattgagtccatcacgaccaggaatcgcacaccaaagtgcaggaactgcaggccagaggaagcaggaagctttctgatcacattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttggtagaatccacattccctttcaatctcccatcccatcagccttcccctggccacacatcctctgggagcagcagaagcaggggcagcaccccctccagcagccagccccgggggtggggatgacctctgtgtcttgatgtaataaatcaccctggatactatcatgctctccttatggacgagtccagagtgcaaagacagatgcttaacttaagggttgaaaatggtgaaggaaaacaccaatcttcattttcttccttaaactagtaccagggtgctctggacatgctcacagaccctaaagctaccgagagacatcctaagactgtcttggaactggccctgtggacacattctccatcttcacctccttgaatggcacttgcttttgtatgtgaccagccagggccatcactgtttctggagaaggtgattctcctgtcccaggtctttggaatcaccaagcagctgctggaggcaagcatagactccaacgcacaacagctcaccaaaatcctgtggctttccccaccaccaccaccacctgccccccaccatctatgaagtacagctaacaaataaaaatggcaaacttctaagggataaatgtagtgagtcgccatcctgggaaatcgtcctttggtgtctatagggattagaactcctaaggatagatgggccaacggtcaggaatttgcacataacaatcctcctgaatcttttaagtcatcgatataatgaaagacctcagggaatagcagtggatgttgtattcagtggatgacaagaaaaagtgttctcactttttttctagtcaagatgcaatttttttgtctccacccacagttggttggatctgaagatgtggaaacctgataccgaatgcttgtgattaccataatcaggttaattaagatacctatcactttaggcaatataggggtgtgtgtgtgtgtgtgtgtgtgtgtgtgtgtgtgttaaaaattcaaggctgggcatagtgatgcatgcctttaatcccagcatttgggaggcagagccagcaaatctatgtgagtttaaggtcaacctggtctacatagtgagttccaggccagccagggctatgtagtgtctcagacaaacaaaaggaacctttgaaatctgcccccttagtaagggtcaaatctgtgcagcaccaagttgtcctgctgctcaccagtctccaggacttaccctacacaaatgaaactctgtacaattagaccagaacctttaaacctaccctcgtccccgataatactctcggtgtttctacacagttatcatcttaggatcccctttcagtcagatcatacagtgtttacttcttgtgtgtgccttatttcatttagcaccctgccctccagattcaccatgatgaatagcagtcttctttgtaaaggctggatcaaatctagtctctttgtacactctatgtacactcttggagtgtacatatatgtgtgcatatgtgtgtgtttgtataggtgaaagaaggggcaggacaaaagagagagaagagaggagagagataggggagctgtctgtcattttaactgtggacagactcactgattattttagatctcggctgttgtaaacaacgctgcagttcatgcagggccaggagagtgcccatatctctatgtgaggggtcacctcatcacctttgggcttatacttacatagaacatcacctttatggggcagagcacttacagtggcctccagaagccccgggcatacactcacaacactgaaaccaacagaagggcaagtttctaagtcagatgttgctgctgacctcccctactgcagagtgggagggaggctcacaggatcctcataacctaccttagttctacaggtaccacttgctgactgtgatattagccgtgggtttgtgctaaggtacacttcttctatatagtatttgagtattttctcagggaatgaagtgaagttttgtgaattttgtttttgtgttttattttgttttctgtatcaactgagataatgacctagtttttaatcctttgttctgtccgtgtggtctggcctgttcgttgagccgtccttgcatcacagagatcagacccatttgatctcagtgtctgcttgagtgtgttcttaagttcagtttgctggatttttgcggaggagattagcatggatcatcttcctttcttacagtggcactgtctggctttgagcccaggtaacgctggcctcatacagtgcaactcagtgttctctcctcaccagtaaagccatctggcccagagcttgccttcactgggagactagggtcctgttccttgtttgttatggctccattcatattttctattcttcataactcaatctcagttcacagtgcatatcagtaaattagaaacatactgtgagttaaccagtttttgcacagtactctcttgtagtcttccagtccttcatgtttctatgagatctgttttaatgtctccttttatactgctgattttaggtctcccctaccccccttcagtccagctaatggcaatccacttgatttatttttttcaaaagcaagatctttatttcattgatcttctctgttgccttcttttttctagatgtgatttcatttgtttctgctctaatctttatccctcctactcctttggttaatgcctttttgctcatataagttaggttgtttgaaatattttttaaaatctattacatttatttatttgtttgtttgtatatgcttgttagaggggcacatgtgtgccacagcatgcataaggaagacatagaacaacttgcagaggtctattctcttctcccatcatctggatcctgagaatcaaaaatcaggttgtcaggctgagagtgtgtgctgagtgtgtgtgtgctgagtgtgtgtgtgctgagtgtgtgtgagtgtgagtgtgtgtgtgtgtgtgtgtgtgtgtgtgtgtgtgtgctctcgagtacatgcacacatgcccaaggaggccagaggcaccagatccctctggagttttgttacaggcagttgtaagctggccaacgtgggtactgggaactgaactccagtcctttggatcagaatatgcttctaaccactgcacaatctccccagccctggctcggctatttcatttctcctttggttcttctttaaagccactgtgtgttggggctggagagatggctcagcagttaagagcactgactgctcttgcagaggtcctgagttcaattcccagcaaccacatggtggctcacaaccatctgcaatgtgatctgatgccctcttctggtatgtcttaagagagtgacagtgtactcacatacataaaataaataaatcttttttaaaaacaaaattcttatgacacatctccctggaaatcctaacccccaaggtgacgttattaggagatgggttcttggtagatgattaagtcatgcaggcaaccaggatcagtgtcctgacagagaccacagaacaagggcctgcttcctccagctgaggccagagtttgaagaaaccaggcaacaaaatcatcttatcttggatttggaagcctctaagacaaagagaaatgggtgtttagtacccactgcttcctagtttatgctactttgcctggggtggacttaagacaggtgttaaggccacattgtgtcagtcacaaagttgatagtctgggtgagaatggcccccatagactaatgtgcttatgcttggtccacaatgaaaccatttcaaaaggattaggaggtgtggccttgctggaggaggtgtgttattgggggttggctttgaggtttcaaaagctcacacaaggcccagaggtccctttctctgcctgctgcctgtgaatcacgatgtaaagttctcagctacttttccagcaccaagcttgcttgcttcccaccatggtgattgtgaactaaccctctaaaactgtaaacaagcccctagtctaatgctttctaagagttgctttggtcatggtgtctcttcacagcaacagaacagtaactaagataccaagtatttatgattttctgccaactttgtgaaaagatatttcaaataccttccattttcttgtattgattaggacctcatttatgctccaaactgtagagaagactccatgtctgcttcagaagcagtatatccagttgccccaggatgcaaagttctagctaagtctcttaggtccacttggtctagcatgtggcttagatccaagagcttttattaatttttcatctgggtgctccaccagtggctggatttgggtctgttactattattgtattgctgtcagtttctcccatcagatctgttgacatctgtctttatatatttggacacaccattgtccggtatgatatgtatctatcactatcccatagacttgatggattgtctcctttatgacaccccaatgattttctttgcctcttgtaatgatttcaacttatgtagcattaactatcctaaaacttactatacaggtctccaattcttcatcctcttgcctcaactcccaggtgctgggaggctgggtgtacccacaatgcccagctccaccccttacttttggacactgtaaagctaacttgagtctcttacagaacacaaaattcattgtgacttgacttcatttttaacatccattcggccacttgacatcttctgattggagaatttaatccatttttatttaagaaaattatttctagataggacaattgccactttgctgataaattgtttcactgtccctctgtcccttcttctgtcctttcaaataaaatctccatgctttgattcttcttacagccttttctgcttctgatgctgcaattttttgagacagggtctcattgtgtagccctggctattctggaacccacatgtagtacaggttagcttggaattcactatgtagaccaggctggcctggcactcactatgtagatcaggctggtctgaaactcactttgtagaccaggctggcttgaaattcatagagatctacttgcctctgtctcctaggactgggattaaaggcacatgccccatgccaagccaaattactttttttgatatttgatatctagtaacaatctgttgtagctatggttgttttagtatgactaaggcaaacaccattatggcattagagatgttgaaatttgaatctataattagatctaatatggagttacctgtccatttcttagaggtcaataacgaaataaaaactctgttcctttggtgatgtttcctaggttgttcacccttcgtgacatctttcacttcctctttcctctggaaacagacacgtctgcctccaggttttacagcatactgacaggaaacactcttaccaataggctagctatggattctggggccctttcacctcggccaggtgcacagaaccttttgtgttttatctccctttgtgttttagttcccctactacatgcccataaattctcatgtctgtgtgcctttctctagtctggcttaatacacatattgttagccatcttccacactcacaccactgtccagggacactcaaggaatctgagcatacagtggaagagggaaggtacagcaattagggtatccataaatccattcaagaaaggggctgcaggtgtagcatcccatacagctcaggagaaggcatcctgacagagcccacaaaacaggctgtgcagttgagtgctgagcccagggtgcttcgagtccctgcctctcttccctgagacagccactttcctgccatgcagctatgctccttgtacaaggattctcagtgggacaaggaacaggtaagtaccttgggtatcatcccacctaactgcagatgctggggatgtctgtgtcagcactggagtgccacatctgctggaagggaggatgtaagaacagttaacaccgttccccattcaatgaccctggtgtgaccagaaaatcagatccttggtgatgaaacaaggtaccctggcatgtgtatcataagcccacccaggattttatagaaaatcagcataaactggacagcttatgaaagaggcttcagagtccaagatcaaggcaatgatgtatttctgttgcctggttgtactggttgagttgtttgtttgttttgttttgtttgttgtcaacatgacacaaacctagacacatctggtatggtggtttgaataataacagtttccatgggctcttatatttaaatacttgacaccccccccccattggtggaactgttgggaagtgtggccttgacagaggaggtgtgttcctggagagtgagcgctggggccatcctcagtcgcctgtctctgcctcccacgtgcaggtaagcctgtagctctcagctgctgcctagcgtcttacctgttgccgtgctcgccactgtgagggtcacgagctcacccttggacactggaagcccccaacaaactcttctggaagttgccgtggacatggtgtctcttcacagccatagtcaagtaactaagacatcagagaagaagaaacctcagttgaggggttgcctcggttagatacccgagggcaaatggggagagactttcttaattaacgattgatgaggaaggggccaacctactgtggacaatggtagatggtcctaggttgtatagaaagcaaaccgagcaagccatgaggaggacaccagtaagcagcattcctccaccgcatctgttttggtccctgcctccctggatctgcctgggattcatgatggacttcaatccaggaggtgtaaaatgaaagaaaccttatccttcccaagttgattttggtcatggtatttattgcagctgtagaaagcaaatgaggtcacctggtgagggcctgacttcttcaaattgtacatcttcacgctgcaggctcaccagaaagaaggggctagctgctctgtagtctcctgatcatcatctgcctcccatgttagaacgcaagctactggaaagcaagaaccaatctgtcttgttcgttgctgcttcttgacccccctgaacagtccctggaatgcagccgaagctcattagatagctgatggatgaacaatgaaataagaaatattagcatcacggacactggattacattaagataatgcccagaaagtggaatgaccgcatcagagggcacaagcgagcatcttacaatttgatacccaccaacatccccccaatgatagaagtgggacttccaccccctgcccgagtctacccagtcttcatgtatgcacacataaatatccatgagcatgcacacatccatgttctatgtcttcccgttgcaggtacaaggagagacctgatgccccagtactaccagaaccaagcgctcagcctgtgaccctcaggggcaaccagtgtgaagccgggagtaagtgagagagaggcccttctcacctctgctgatgagggtgattgctcatcatgatcgcctctcccagtgctctttgcaggaaggaccaacgtttgcaaattacctttcaggtccctgactatcagactcggcaaagcagccgctagcacggcctgggctcaataaatgtttaattaattaatcaatcaagccaaatcaaacacgagtgtgattatctagatatttctatctatacaccatgaggtggctcattaattgctttttttctcttttaaacttttctactgaaatgagaatatgtttgggaattaggtagacgtagccttaaaggtttttatttataaaaaaaaaactgatacgtatgaaatattctaagagtatccaccagaacagattgctgctaaaacaatcgttgttatcctaaagtcaatgccttactgttcatactgctgaggtaataaaataccacagcttgtgaggagacaaggggtttttttgtttgtttgtttgtttggctttttttttaatctgcaaatatggttctatgcacataaaaagccaaactccagagaacctgcatcagcactattctgcccagggtgaatggcctcacttgcgctaatcacaaggacaaagggatgctctgttgcatgagattcttaattgtgcttctccctgtgggatcccgtcagaatctcccggtgccgcagctctgtaagaaaatattgcattgggtcaagtggaggaaagtaaaaagctgataatcaaatatccacgataggcagacgtgctgtctggttcccgcacttaataaacttgcagtggatgccgaaggtttctgagaaacaccccacagcctcccgagtctccgctgggttctgcatcttcacacagtcacttaagaccataaattatctgcctcggtttcatttaaagatcataagatgctgggattttatactgtttattttgagctataaatactagccttggtctttctgggtattaatgtgatggtaattgtgctcctggtgggtttggaacagaataaatgaatggcattcctaaggcccaccagccagtgggtactctgggctttcgccccttcttctgtccctggtagcatctcaacacacaaaccccatacctcaggaaagtgcactagacagagcagggcaccgtagcaggtttagtccaagtggaaattttctggtagcttccagaaggcaaaataataataattcacaaagaaagcatcttccttattccctcgagatttgcctcggttttttttttttttttttttttttaagatcttctgggttgacttcgagcgctcgctcgctcgcacattcgtctgggaagtagtgatctggcagcatccctcagctcagagatgtgccaggaggactccagcaactcatcgaggcctccgattcctcacagactgagccccagcacagagacgcgtgatccctaccataagcgctgccttcacaggctgtcggggagtgtgaacccgggacagcagaactggctggaagcccagcaatagccacttcctccctcgcctcagcggcacaaacactcagatcaatgctgttgcttcagagtctgttccgttccaacattgtcaacacacgtttcagccacacgtcgtccacaaatacacatgccaacacacacagccgtcacacgtccgtcttcaccgtcaactctttacctttaaatgatgcgaggcctgtgtcccagtttgcttcactgttcctgggataaacattgacctaaacccaagcctgggagaaaggggagtgtttgacttcccagttacagtccactatcaaagaaaacggaggcagggaatcaaggtgggaagctggaggcaggaactgagagatcataaaggaaccctgcatactggcttgttccccgtgcctctgtcatccacctttttcatatagccaaaacccaccagcacaatcaatcattaacaaaaccaaacaaacaaatcctgtacagatgtgtccacaggccaatgtaatgggggcgattcctcaatccaagttccctcttcccaggtatagctaggtttgtatcaagtttccagaaactgtgacagtgtgcaaaggaacagaccaatcaggactgccactgtctccctggggctctagccaaaagccatccaactgttgtgcctacttcaggcaattcatcccacaggctctctggagatctgatgtctaatcaagtcaccaaggctttggtgaatgtctgggaatcttgcaaccatgaaaaatcacctggatcttgggttacatgcctccgggatctgagcctgcaccccaggacgtgaacatgcatcccaggatctcagcctgctttctaggatctgagcattcactccaggacctgagggtgtgtcccgggatcagcacctatgacaaagcagtgaagcagcatgggaagagatgacgcttgggtgtataagaccccaaagcaagcacttcccctcccataggaattgtgttttcatacctgactccttctccattgagtgtggttaaaccttaacaagggacagcactggaagaaccaggtcccaaagaatctgtgtcatccatgttaaaaagaagaggccaagccaaacatggtgctcccaggtctggaaggcaagatcacaaattcaaggccagcctgggctacatagaaacaatccaactttagaagaacatggagagaggggagatggaacattttaaaattcctttgctctgcatagtggcatgcatttttaattctagcactaaggaatctgaggcaggaagatctccagttcaaagctagcttggatgcatagtgagttcaggatcagcctgggctacacagtgagttcaaggttagctttttttttttttttttgagatcctgtgatacacacacacacacacacacacacacacacacatacacacaaaataatggacagatgactggttggtagatcaattgatgggtatgatagatccattgataggtagctagattatagagagataggcaagcagatagatggtagatagataatagatcaataggtagatgagcaaaagtaagaaaggggggataataatgtgtctcttggaccctctaacataaaggcacccaagctccatggaaactacacaatgttggcaactggtagatacaagttaacctctggcttctttggtgttatctaaaggactttaacaactggttcctaatctttaaaaaaaaaaaaaagcaatgggggacaacagcccccacatcttttgtctgttgtggggattaaagtattgcatatgtgtatactgcgccccacagaagcctggcacatagaggaggggccaacagtcaacccactaagcaagaaaactcagtctcctcttgcaaggccaccctgcccagagtgggtcagcagatcaggggctggaatgcagcttggtggtggagcacttgcctctgcatgtactgggcctacgttcaaaccagtaccacacccaataaacaacaaaaaatcattaagtcagaagcacacactggtaagagccatgtaaaggattgaagcttccgaccatgggaaaggagagttgagggtatttggagttgagggtaaagcacagagtgcgggcagaagacagaggaagcctggacgaagaacagtacaaatccctttgctaagtgtacctctcccatgcgcaccatcagaggagacagccaatggtaagtccacaaaggatgctactggcgcaccctggagccaaatggctagagctgcagctctccacccctctgatctttgtgcccacattcatggccacatgatgaaccttcagcagcagatgactctccctatcccactccacccacttgtgaaaaaagtgaagactggtcctctctctgcagctcccccaaaataattactcccactatatcatgtaagcccactgcaaaaacaaagacttctggagacttagacctgcctggccaggtattggaccagaacttcccctgtggtatgggagaactgagaggactctgacacctcaatgtgggctgtacacaccccgtcacacagacattgaggatgtggcttatgttgttgcagatctggtctgatgggatctgagcacaccaagaagaggcagccggacaggttcccagagcagagacttaaaggctcctgggaagacagcttgagagcctacgtaatggaagaggaggtgtatggagctcagtggtatagccagcctttcctgagcatgcacaaggtccagggttcagtcccctgcatctggagaaaaggaagggtagaagagagaaaagagtaatttccttttagacttcattctggtgaaacaaaaatgtctgtctagatttggtagcacacagctgtaaccccagctctcaggaagccaaagtaggatagatggtagtgagatctggtctagcctgggagatattatttagcaaaacagtatctttaaaacacaacataaaaactgcttagaggaaatcctttgttaagcttcctgtgaggtgaggtgacactctagaagggtgttatgcgatagaggtgaacaagcctccctctgatgaatggcatactgccgggaggagtctgtctttcttctgtgcataggaccatgggaatacccgagccatgtggtgtagggaaagaaaagaaaaaacaaagatttttgcatcctgatatggtgacaggcagtgtcactagaagctagaaacacctatagacggagctacaggtctttatgctatgacgaggaagaaagtctttctctagtacaatattcctgaccttgtatgtatggctttcccacagctggtctccagatatcacctgggtgtccagtgattcaacacatttctgccattgagcacagagaggcgtcaggccccacaagacccctacttcagacacccattacatgtacaggaatcatcagacctcctgtaagtaagagggtttagaattttaaaaggaccttctcattttcccggagtcagttggtgaggcagaacattccacccctctaattactgggtctttctaatatccagccccttagaggcccaaccttagtcaccgagttaacacaaaaccagatgccactgactggctgtagataatcctattgctcagaaaactccaaagatttgggggctctgagccaggaattagaaataagactaaatgtttggttctgttttttccctttggggagtgagggaaaccggagaccagaccctactatatagcccagtctgatcttgaacttgctactttgcccaggctaaacttgaacacacagtctcccaagtgctgatgtcacaggcatgcactgccatgccctgtacttgaatggttttcttttgatgtcacagacccctttgtcatcacagcaatcattaggttatgtgggtgaggactttaggaatgtctgagagcaatgtcgaagttgtcatgtaagccaaacacacataggacacacaggcccaggaggataaaggcagagaaaccaggtgcattgcacaagagtgcagaggagaggagacaggctcgtgtgcagccatggccctgcagctgtgttcttggggctccggagaagttcatttccagtagagcccatgcctttccaatcgcagggctctaactgtattttgatgtcccacacaaggcaatatgaggtggtagtggtggtggttagcagagcagccacatattgccataaagtgctcgctgcgatgatacgacgaattttcttgcctattccgtgcacagagcattgttcagattgaactgtaagatcacttcagatgcactattgattttcattattttcgttttctccatctgcgagttccttgaagccattccccgctttgattttatctggcagaacaatccccacctcctctttctagtcattagttcataaaaatctcaggacctgggagtccaaggaaggaagcccatttacatagaagtttgtccttccagaaggatagtggtttctgatttcctggagcctctggaagcttttcacactgtgacagcaggtgtgttgtgcaccattttgtctcagataaaacagtctatcttggaaggaagctttcagctgggcagtggtggcgcacgcctttgatcccagcacttgggaggcagagacaggtggatttctgagttcaaggtcagcctggtctacagagtgagttctaggacagccagggctacacagagaaaccctgtctcgaaaacaaacaaacaaaaaaaaaaagactgagaattttctaggggtggggtaaaacattctaccctgcaggtaaactccctaagctcaggaagaaaacaattcaaaggcttcaggaagtccctgaaactgaccaaataccagaagcacctccttccccaagcatacataagcattgaagactggagagactctcaaaccagctgacccacttgaaagaagttctagactgcagtctagatccctctccaacctacccagctgcctgcaggctgtgcagtgtgctccaagctcccagctatgtgagtaacccccagtgaagctgatccactctttggtctgtcattgattctgtatttgggaggaatagacattctcatctccccaggaatagtgtcacacaacaaggtgtcaccatgaactcagaagggtatgagactatccttcttatacaattctgaatcatcttctgtgatgaagaaacatcctcccagtttccagatgcccccacgaggggtaaagccataggctgcattgagctgctccggagcatggggctctccaatgctcattttcccaccctctttgcccttcctctgctgtttcctgtagctacagggacacacagcattaaggcagaaacagtcctccagaaatcaacacggtaatttcccagcagaggcctcttgtgactttgcagtggcatccaggaggctgggatccctcgggtgtctttgcagagtctctcctctgattcgctgtcatggggaacagattatctctgcatacgagcagagagatattaaaattggacagcattctgcctctgatattggggaacaatcagagatggctctgtatagactgacagagcaacaagatgtacaactccaaggctgctaaaaaataaagctgtgtacagagcggctgggagggctgcagaggccacagctttcgagggggaggcagagactaagtctcgagcctgctgtagagaaagatatcacagacagaggacacgtgtggctttgtgtggggaggggctggtggtgaagcacattcacaatcatccatccatctgtcctgggtgctgactccctgccccactcaaaacagcccattctgggacttgcagctaggaagatggacaattgtgctataagcataccaaataacaggactttaaaacactgcaagtgtggaccggaaggatgacttagctcctaagagcactttgtgctcttgcagaggactggggttggaggttccaagcacccacaccaggtggctcacagttattcttaattccagttccagggatccagtgccctctttttccctctacagacaataggcacacatgtactatgtacatccagaacaagcgcacatatgtatgagacaaaactaatttttttgttgttgttgtaaaggtagcaggcatggtatggttcattcttttaatcccagcactcaggaggcaaaggtagataaatctctatgagttcaaggttaaactgatctacatagagagttccaggtcatccagggctatacagtgatatacttgtctcaacaacaacaaaaataaataaataaacatacaaacaaacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccacagtctgggtgatgaggaacacacctatgagagtcagcatctcaaacgaggggaaaagaagaattcagggatttgtggtgggtctcaaggctaataatatagccccattttagggcctagagggatagctgaaggttaagagcactggctgctcttgcagaggatccaggttcagtttctagcacccacatgacaactcaaaactctataaaactccagttgtcgaggatctgacgccctcttctggcctcctccggcactgcacacacatggcacatctacatacacagagacaaaatactcatctccatggagtgacaataagtcagtaagccagcccttttttaaccattctcaggtacttctgtttattctgctgcttttgtgtttagaaaattgaggcgctaactcacatgtgatatgagcgggtggttaacacttgactctacaacatgggaactattttagattttgtttgcctgtgttttttttttaacctacttcttcagcagaacaagtgccaagcagaggttagaaagaaatgttagcacaaatgtaaacatccacttcatgcagattcaagcaaaggcggactctttctctgccaaaacaaaacccccgcccccatttcttatctgcaaaggttaaacaaggtcttaacctaactgttgagttaaggatccaaatatcaaactcaacccctgtgggtcttgaagctaaccaaagggagaagagagcgtcccttagtgaagaccccactgtgtgtgctggaagtgagtaggcaaactgagggtgctggggaggaataagatttctccaagaggcaagagtgttgagaaagagaaactgaaaacagattagcgagaagcaactggctgcctagcagcaaatagcagggctttgcctcctgcaaaggaatctcatccaagtgctttgggtttgctgtgcgcatggcctctgtctaatgagagggtttccagccagttggatttcacactgttcagtgccagcttggcaatttgttttgaatcaaacccttcagcctgttaacctggtgggtaagtcttctgggtgggcagccagaatcctacaggatattttgcttttcttaaagaaaaaaagaaaaagaaaaatggcgttggtggtaatagcggtaaaggaaaaggagaatgggttcaaaaatgggcatggtggtgcacgcccgtaattctgacggtgtgtcaagaggctgaggcaggaggatcacaagtttaaggccagcctaagtttacatgtcaaaatgctatcacgtaagttgaggcagggaagtggggagggacagagggagagaggaagggatgtcgagagggaggaacaggggtgaggggagaagaatccaatcagattgttgtctagacactctgagcccagcaatagggtcttaccatgtagttgcagtgggtagctaagggcaacggtgagagactgggttgtcttggagacctctggggccacctgcaccagtgtcttctacagagatatcccaagtcctgcataccatcaacagctcacatcttctgggagaagccttgtccagccactcatgggcttctatttgaactcccttttgtttaaactatcatctggaaataccgtatgaaccaggaagcaagactctagtccagagcaagtgagctccaatgagtagaaatctagaaacaaagtcatctgtgacaggtaactgggattgtcagcccaatgggagtaacaaacacctcaagggagtcacgaagcccgcctctgggtgacactatgatgccatctccagagacaattagatcatgaggtctttgaccaataccagcagattatccaagtgcgggcttataatccagcggaggaagtagggggcggggctgagtttaaaggtgtaggtcagtgtgggtgtgttcttatggctgtatcttcccctagtcctttcctgtgtccttcccctacttcctctccattgtaagatgagctgttctgacaagtgtccccaccaccatgatatatatgatgcttaagaaaatgggaccctcagaactgtgagtcaaaataaccagcacccctgccttaagctctctccgtagcctggtcacaggcaaagcaaagggggcttacacaaagtccaacctcatttgcattagtggcaaatacgaaagtcccgttgggtcagcaagatggctcagtggagacaggtgcctgctgcacaagcctgaagacctgaatttgaccctcagaaaccacaaaaaacaaacaaacaaacaagggacacaatgccgctataatcccagcattcctaaggccagcgggaagtagacacagaatgacctggaaggtcctgagccaggtagcctggagtttacactggcagacacaagggagaccctagagaaaagaaatggtcttgttagctttgacattggaagcattggatggtgtagtatagaaggctggaagccctcactcccaagtagcagaggcaggggtggctgttttaaacccttcccacaaggtcggaggtaagacagagagaggatcgacctctgtagaactaaaacctctcagtcttccttggcttccactccattgagaacctcacagggctaatcagccccccaggctgctgataccagacaatgaaagctgttctccgtcaacacatgaagctgaagtgacagttatccggggcttggatgggatagcaacaaatgcctttgacttataatgaatgagaaaggctttcttagcttacagaggtcatgaaaagaagcgtgcccacactcaaaggagcatgtgtttgaggggttatatgcttaaatgtacatgccgtgtgtgtgtgtgtgtgtgtgtgtgtgtgtgtgtgtgtgtgtgtgtgtttcaaaattccggcagcccaactgtccattgattttctgacaagctgcatggtccctttcaactaccaaaaccagaaagatgaccccgagcaagaaagtcctgggagtgcacaggaggaagagctgagtgagcacttgatttgactggacgttgacgattgatcccaatagtgtctgctcccgatgcagtcagtcctccaggcaccgcccggggagtcgagcacagaagctgcaaagtggctggctctagcaggactgagcagggcaaacgcgtcaccaacaggctgtgccttttaccctttctcccataccctcttccttgctaaaccattcgctcacattcctaaagctacccatcaaggtccattcccttatttggtcacttcctcctcctgagactgatcaccaaggtcctgctatgagagttttaaagtccaacaatcaaagccccaatcaaaattaacaactcctcctaacatgagggtttccccttttttctttataaaccaccatttgcctatggaccacatctttctcctctatccagatgcaaccctttgtccctccagggcaaacatccctttcctcgcctttattcccttgcacttctccgtctcctctgtctcctgcctttgtctcttatcccctaccctctgtccctccgaggcaaatcaatctccttggtgctgagaacttgggcttgggttgtctcctgtcaacttcaaggtactttcacacaacagtggaaacattgcagcgtggagaactaggaattttcaaataaattttagcatctagtctcttaatgtctagagcaaatagcatcaacttttgtagaatatcttcttttgtcttgtatttgttattttatatcactgtgaccaaaacacctaaacgaaacaatgtaacacagggggaaagagtgggatgcagggagtaggctaggctacaaccttcaaagccccccttcctcctatctccaccaattaggcaccacatctgatagtaccacagcctcctcaatgtgttcaaaaatcccctgtggtaatcaggcctcaggctagggatatggctcagagatgaagaccaccgacttctcttgcagaggatctaagtttaattcccagaaccaacgtcagatggcttacaaccagctgtaatgccaactccaggggtatgcaactctctggcctcttcaggcatgttcacacacacacacacacacacacacacacacaattcaaaatgactttaaaaagtaaatttgttgggattggagagatggctcttgcagaagacccaagagacccaggttcagttcccagcacccacatggtgccccacaaccatctgtaactccagttccagggaatccaaatgccctcctctgacctccttgggtaccaggcatgcatataatacatagacttacgtttaggcaaaacacccatacacataaaaataatttttaaaaataacatgagcagactctgggttagatgttttagaggccccttttccctgttgcttctgcttagacacccatgtgtctttcactgtcactctgaatgtgttctgggaacaagaaactgtcatcttagggaacctgctctcaatatatatctttgtgtgtgtgagtgtgtacccatgtgcatgtgttcgagtttgcatgtgcatgtgtgtaccctcagcacatgaagcagcaaccatgctacaggtcacctctgaagtccatacacacatgccattgttagtgcaattcaaagaatttgtctgggtagaccattttcactcagatacttcccaacacagtcactcaactccctcaaattgacactgtcacccaaattaaatcaatagttctttgcaagagtagaataagtattttatctaataaccggcttgtttgagatttgcagtgctggatggtgggaccaaaaggcatctcttaacaatttacatttaaccctacaccatttccatctttgtatcaatgacactcagataaaatgtgaacatctaattgaattctgttttggatcacctatgacacatctatttacgacaattctccagaaagaaaagaccatgtatctaaggggtggttatcaaaaacacatgtcacttttaacataacagactctgggtttgagtcacagtgcaggcaacttctctgtgccgtggttgtgccgtggtcgatcttcactgtcaaccagatctgatttagagtcatctgagaggctggtggggcacaccaggcggggaggtgagtgggggtattctagagtagtttgaccttctagcctcctgggagtcctgcatatacatgacatgtgaaataacataaactcagaaagtcacacacacacacacacacacacacacacacacacacacactacatgcttactccagtcccaacacagtatacaaacaagtgggttgggttcggggaaaaagggctctgagtccacagaaccccaaccatttgatttccaatctaaatctagtccaatgtctgtacaccacagcagagcgccttatgttggaattcttctaaaaacatcctattgagcttggcatagtggtccatgccggtaatctcagtaccagggggttagttcaaagccagcctgcactgcagaaagattaaaggtgaaaaaaagattaaacccacaacacattctgaatttacctttccaacatcccataaatgacatgtcagcatacctatctcttaaaattaaagaggaaaaatggggaaacatgggggcaaacgttttagtgtcttgtatcttcagtaattatacagcaatactgtaataatctgacagcaattgacaagataaaagtgcacagtaatcatgtattgtgcctgatgtaagcagtatggtatcacctaacaccgtgccttttataaaactgctccatagcttgggaaccccctcccagtagtgaatatgcttctaagggggagggggtgttacctttctgtgtttctattatagacatctctcagtaaatttctctgactcctttcataaatacatttctttatttctcatttaaaaaaaaaaacaccttctttcctgaggggatttcatatatgagccggcccctcctatatacaaccatacatgataaaaggccagatgatacgaaaacacgaaagcagacaataggatgctaaatgcagtccggcagacggaaggcattatgggtacgttaacatcttcaaaaggaatattttacaatgcaaaaagaaaatctagttttactgcagcataagacaagacccagctttctcacaatttatcactaatttcttcattttgttgttttggatgtgcttttagaacatgccggacaactagtaaaaacgagtacacaattcaaatgacgttttcgttaagttttattgacttaacgctctgataataaaattataacaatcagtgttattctgatttatcgcgatttttcctttcactttgtaatgaactcggagtgcagcagaattgaatgtggcggtgctgccacctcaaggtccctcactgcaaacgagatggctcagttcaccctgagcacactcgaacacagaagtagccaagggcatcacggatggaaatactgccccacagtcatgtcacggtaaatctgaacatttatttgcagtgaaaccgtgggttttatatgcaatttctagtgaaaagatatcccagtcatgccaaagtgcactgtggatgccaggtccaagaagagaaggaagctattagaccacagtccaggggaaacgtcagcacggcaaaatgaacaataatctttgcatagttaccacattggcatggcttaatccagatatactggcttctctaaaaagaaaagccatgccctgatgtgtttctcttgtattattggttcttggctccttcttcatctccagtctctctctgttgttgacctcatgaatttgacaccccccatctggattttcctgatgcatcgctcataccagccaaagaaatcaccgcacactaaattcctcatggaaacccgagctattttatttttgttttgttaatttttatgatttatttatgtttgtctgtgtgggcatgggcaacaagtgcaggtgcccttaggagccacaagggggcattcagattcccccctcccccccccccgcccccctctccgatctgaaatcacaggtggttgtgaaacacctgccgaggatgttgggaactaaactcactggttttgcaaagtggaaatgaaagaaatgcatcggtatttttcctccaaattttaaaaagcatataccttctgaccaggaatcccctgttctagcaatttgtttctccagcacaaggtcacgtgtcccaaagcacagctgacggggtagctcactacagcaaggggttgccaacaagtgttgtgtccttcagcacaagacttgtaaaggaaggcgaagctggaagactggattctgcacagccttcgcagtcagcaaagcagctctgtatgtaccaatatggcaccattcctcaaatcatatggctgaataaggccagggagtaatatgtaaaacagggtgtatgtgtttacatagagtctctttggaaaaaaaaacacacaataaatcattagcagtgattcctttgtagaggggctggtagtaagtataagggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtcccgtctcctccctgcctcccatctcctctgatttgccatccatttttcttctactcgtctgttcgcatttcaacttgtctgattccttgtgttctgcctgcctctagggagcctctatcgtcttctctaccaggaggctcagagccagccctcttgctcctagtgccagtacatggccgtgcttgccaggtacacgattcgtgcaccctggacgtacaaagagtgtgaagaagcggcatgaagattaagagtcccatctgccatctgccctctactggaactcaaagtagtctgcaaagttgtctgtgctccgcttcttctctaagacgccatagccatgaacttatcctccccacgatcaactccggccagcatgcaccaggaggatgcaccgggagctggagaaatgaaatgctacaatcttgcaagaaggcgatgagacccacagtgttgcgcatggattctgaaatgtctcccatggttttaaagttttggtccctagctggtagtgctattttgggaggttctgaaaactttaagatgtggagcctaactggaggaggacagacccttggaaggtatatttaccccctcccactctctctctctccccctccccactcttctcccctccctctccctccctgccccttccctgcctctcctcttcctgcaaaccctgattcaaatgtcagctcttctctgccacaagatctcccaaccatgatgttcttctcaggtgcaaggaaccaaggaaccatgaacagaactctctgaaaccatgagccaaaacatatgttttttttttttccttgtttccaacaggcaatttggtcatggtgatgcaaagggaactaacacacacagtctcacaaatggactcagggccacagtaaactagtgaggagactgtattggagatggctgcagaagggctgaggaagagggagagggggtgaagagaccatctctggctcttggcttcacgtcttgactggatttcctttgccttttcttcttttattaaaacatctcgatatccttctctgacttctttcaatggcacatcattaacagtgaagccaaaattccatttggtattatgtaatagcacaaagtccaccacattcccatcagaatagtttcataagccacgggtgtgcagcatttcacaggaacatatatttctgctacccaactctcctatgcacagattgagtctcttttgttaccaattttaaaatgccacaattcgagctagccctgcaccaagccagtgcaatttttaaaacagccctgtcgtcttctctacgttatttgaaggttatttggaaagctagaagcagaggctggagagacggctcagtggttcagagcatgttttgctcttacagaggacctaaatttggttcccagcacctagatcaggtgactcacaaatgcctgtaactccagctccaggggatttgatgccccattctgaactacaagggcactgtcttcatatgtacatacatacatacatacatacatacatacatattgaagctaactcatttaaagttagaggaaacctagtggctggaaagatggctcaacagtttgattactaacctaagttaggttcccggcatccacctcgggcctactgtgcccaacattctgccctaaccatgtggttctgggctatataagaaagctaagctgagcagcggtgacacacgcctttaatccaagcacttgcgaggcagaggcagattgacctctatgagttcaaggccagcctggtccacagcattctctgtggtccttagtgaaatgagttacttggtgggaggcaatgatgtatagaagagctgagttcctgctctagcttcactgaatggtagactgtaacccgaatgctgaaataaccatttctcttccctgcgttgttcttgttcagagtgtttatcacagccacagaaaggaaacgagaacaccccatcagagacacttccagaaagaaaggtagtgcagaaactgggccacgacaggcctgctggaccctaggggaggctctgtgcttgagcagccctggacacaccgcctgactactctgccactttctgacagccagccatcactctaggacataaattttaagataagcaatgcaggaagatagagagagcaaactcagagagcaacaaagaaaatttctgaagattaagggaagtccgaacccagccaaagacaggaaataaatgttcattgtctgactcttcctccttcatttccttcctccttccttctccttactccttcctctttcctttcaagacttccacgtgcacatgaaataagaaactacttcaaacgcatgttcgcctccacacccaacctgtcaaccccaacgtaccaatggacacttttcaaactactcccacctgcgcaggtgatgcaaacttggttctgaaaaacagttctagaattccgagcctcgctgaaagacataaggtgtgtcaagagaggtggaaaggagcagggtcagactctaaagccatggctacatcctcatcgaactgagccctgagcacagcaaacctatgggattgtagaaaggtcacccatgggagagccaaaagggacacttgaggggataaaagaactccttgaggcagtgcctgtgggaggaggaaggaattttctagaaaagggagattaaggaaactattggttagccaagtctcagacaggacatctgctgtgattatcattagctattgccaatctgatgtgaagtccccctgtcccgtattcccagtatagtagcaaagtggagtggacagttctacagccatcactggtgtgccagagtttcaaagatttttattccacatttaagagatttacaggaaatctccagacagttgagctgaggagctcagactgtctttcctctggcaggaagccagccatttggaagggtggctttaattcctgggatatggagtcacacagtcaggaagcagccctgaccccagtaaggtcagtgctgtggccaactaccctgggctcaatttagagacataactatggcaacgactgtgcccaatcggttattagaggagatttattgacggatatgcttgaatagcagggccattaattgcaattaccagacaagacactttgctcatcttgggggactgaatgccaaaatgccctaacaactttaaaatcccatttgctcctgagctctttgctggtctcacagagtttgctccagattcccagtcctgaaggtggggctgatgggggcggggaggagagaaaggggcatcacttgacatggccccagcttgaggaagacagcaagagcttggtgctgcttaggcgagagctcaaggatttgcatgcagtccctactagaccatcctttgaaaacgcaagggaggcaaaagcagaaccgctctctggatcccaccaacagccataaataaaaccccttcctcctttgctttctaacccacaatggccattttctccaacatactcggctcaggctctacccactgctcatcccgaatctagaaaacttatcaccggatttcatccttctggtctacctcaaggtagtctcccctgaacactccattctgtactttatagggtctctctatgtagccctggctatcctagaaattactatgtagaccaggctggcgttaaactcacagatatctccctgcctctgcctctcaaatgtttaaaggtgtgggctaccccacccagccctcctgtaccttcgacccatttcttagcactgaagttgtactatgcattggtctgtctgttcactgacctctttctctttctctggtaagactctcagatccatgagagcagacattcactctgttctttccattgctggactgtaagtgtcatacacagcacctaccaacactcaaaaagcattattaaggcccaatccgatggctcagtgggtcgaggtgttagtatggaggtctgatgacttgggttcaatccccaggtcccatagagtggaagaaatgaaccagctccagagagttgtcttctgacctacacacacactccacacattaggtgagtatttgttgaaagccaagtgtggtggcacatacctgtcatctcagcactcaggaggacgtgaggcagaaggatcatgagttcaagactatgtgcacatacatgcaaatgtccactcacataaaataaaatgaagaaatcctataaaaataaaatattttaaatatacatataaaagcgtacctttgggaggagagctaaagagatagtccagtagttaagaacatgaactgcttcttcccagcattcatgcatgcctggtggattgccaccacctgtaactctggaaacaggggatctgatgccctcctctggcctcctcaggcactgcactcatgtggcatacacagagagacacataaatatgtaccaagtgaggagatcacttggtaatttcttctttacagacaaagcaccaaaattgtacttgtattgaagtcagtgaggtagataatggtttagagtctttcaagagagagttgaatgtggctttccaatccaaagctgtggaaagtcaaaccccacttcgtaaactatctgccaagggtctaggctacaagaattctctagtaacagacatgaacattccttacttgtgatactgcgaatgggctgtatcaagtaccccctttatttttcatcttcttgctgtgatgaacatggtgactcaagatactggaattttccgtacacagcactgaggcccgctgtcttagttagggttactattgctgtgatggaacaccattcccagacctcacatcagcagtgtatggaaaggggttgacactgattgagtaagacacacagaagctatagctatgaggcctaagacctgaagagtgggttatgggattgaacctagtcagaaaggacaaggaaggcccccctgaaaaaatagttgttcggttaagacccaaagactgagcgaagcacactgggggacaagggagtgaaacatctggaaagccaaaacacacttctatgaggatggacagacatgatggagatgaggctggccagcaccagaaacatcaggctggaccttgaaggatgtcacttggagattctcaggctcctccaaaaaggaaaagactgacgggctaatactttaatttggaaatcctgtcctccaaaggcctacatagtaaaggcttggtcacaggacctcgatgctgttaggagacttaggagctgggtgggacgcagtgggaagaagggggtaacagcatgtcctcaaaacaggtactaggctgacaagctcctcttcttgtttctctcagtcaccacaggcaaacagctctgccttgtcacatgcttctaccatgatgtcctgcttggccacaggcccaaagcaacaggaccaagtgaccatgaaccaagctttacttgagttgatctcaggtgtttacaacagtaatagaaagcttaaaataagctaacgcacatatcccataggttaaatcaatggttttctgagtgtcagatccatatgttctggttgctgcagtaggaaactggaaaacagactaggaaaccacaaggaaagggcaatatcaagggttaaaatgcaaaggattccgtagttaatcagaaaaagagggctggggagatggctcctaagaacacttacagctcttctggaggcccttccgttcccagcacccatatcaggcagctcacagccacatgtaatccaaactctaggtgagtatctgacaccctcttgtggcctccacaggcacctgcactcacacatacacatgcccccacacagacacacacatatacacataacttaaagataaaacaaatctaagaaggaaatcagaggaggtggcattcagggaacacaccctgagagagacatgtgaggccaccaccaccgagggttcagggacccaaggagctggactatagtttgcattgcccctttaactaacacagagaaagacaatatggaagctgtgtttcgtgtgcggatgccaatattactatgcatcagtagagcagggtgctaattttaatctgcacaaaaatcacaaactttgcctgctgagaggaaccttaaacagcatctgaatatttgtgcattttccaacactctcacagatgctttcatgaataccttatttcttattaatatgcatgcttggaatactttttcatattttttttgaatttttactcatttttcctttgtgtacgagtgttttgcctacttgtgtactccatgtgtacagtacacatggaggccagaaagagtcggatgccctagaattggagttgcagacagttgtgagctgccatgtgggtgctgggaattgaacctgcatcctctggaagagcagccagtgcttttaactagtgagccatctccttagcccctgtttggaacacttcaaataaactatatgttttcttgtgaattggacctatgtgcgtggccttccaggccttccttactcacacctaaacattaggatggggacatacacacacactcacatacaggcatacacagtgtatccagaaagtactcagtggatgctattagctgactgacttattgacagccaacctcaggatggtaatgaatctgaagatcagcaccacacagtggagaagttgatcacacttccacttggaagaacttgattcttaaaaagcaaaaggacagggccaaaggcacagctcggcaatagagtacttgatgagcatgtacaaggccctgggttcaaggcccaacactgcaaacaacaaccatatatatacagtgtatccagaaagtgttcagtagatgctattagctgactgacttactgacaacaacccatgggctgataatgaatctgctggtcagtaccacacaatggagaagagactatatggacttccaaagcatgccctacagctcctaaaagaatgaacacacacacagagaaggctatagaacctgagtctcagcccctttccacacagggaagatggggccttccatctgtcagagtggacttgaaccaaacagaatacaaagggtgccatgcagctgactgcagatcgaagggaaatgaaaaaagtaggcaccatggagtgtgctgtcctagaagaaaggaagtagtgggtgttcttaggggatagctgaggccaccaccactttctttcactgatccctgagtgtcaccctggccacctaccaagttcctgtgctctgagccaacattctgtgtgtcgtgaatgtgttagtgcgctcacttctccaaacagaggacagacatctcgggtgaaacctggagaaaccagcccctagatgtcattgttgccactgaaatatcaaatttggagccttttgaacatttaaatctgaagagagagcggtgtggatctgggtaagcctcttaaatcatgcaaattctattcgctttcaacaccaagagccaagtccaaaggcttctggacttcttaaccaaaatgtatctaaatggcagggtgttaggggagttcagttgccaaaaaaatccatacttaggaaaaataggccgagccccgggtggtcatatgtgacttggctccaaagttcacgctacaactctcagctgaggacagaatggctgggtgactccgcccacgtctcctctcctttgtgtcctttgatgtctgctctgcgactgtctgtcactggtgtgtaccacacactaacacttcccatccaggacatgctaaaggagccaaggggctggccatctctcaactccacttccaatcagtgaccaaaagctcatggactccctcatggtgtcctttcactctgggtcacccttctgtgaatcttttgcaattgtactatttattgatcactgcccatcagtcatgtcagtacctcctatatattaaattgtttaaactttttagggtgtatgggtattctgcctgcataaacgggtgggcacaccatgtgcatacgtacccaaggaggccaggacatggtgttggaggatcccatggaactgcagttgtagacggtagcagactgccatgtgagtactaggaattgaatcccagtcttctagagaaacagccagtgctttgaattgctgagccatctctccagtccagctttaaactttttagcagtgctttgagtatcattatccccatgatatgataaaataaaggacagagattaagtgtggtgacttgaatgtgcttggcccatgggaagtgtcactattaggaagtggccttgttggagcaggtaagtcactgtgggggtggactttgatgcttctgtgctcaaactccacccagtgtagaagggagcctcctcctagctgcctgcgaaaaacagtctccttctgggtgccttcgaatcaagatgcagaacttcagcttcttctatagcaccatgtctgcctggatccggtcatgcttcccaccatgatgataatggactgaatctctgaacctgtaagccagccccagttacatgctgtgctttataagagttgccatggtcatggtgtctcttcacagcaatggaatcctggctaagacattaagtaatatactaagtctcacagctaagacgtgctagaagattctgaaactaagagtaaaacccatttcacaggctagactcttagaactcccgagccatcactaagactgacaccaaggttgctaagtagatgtcaactttattttctctcctcccaaatactttctttgaggtaggtattagttcattaagacagggtctcactttggaacctaggctgccctcaaactctgcaaacctcccgtcccagtcctctgcctactagcatagcagacacgtaccaccacacccagctccaaaagactgctgttgagttcctcctctagctaaacccacgcccaggagcaggtgtgcttaggcgaaatcactctctctttcgatcgccgactatagctgcattcaagactctgctgccagccagaggaaatatcaatgaacacgactgacaggctcctggagctgagagggaaccactcccccaccaccaccaccagggtagacagatgcggaggcagcaacagcacctgtgactcgagacggaacagctcacacacaaatgtgtgaagaagcatggcagagccccaggcacacagcctccacctgcgaagccctcatgagatggtttccacctggttcagccacaactccatgatgccgttccagctggctccctgtccctgcactgagccctccatgccagtcggagaactctccagcatctgggcacttgatctgcagcatatcacacctgccttcatgccggtcctttgtcttcacacacacacacccagatggttcatacttttaattttatcttaagtgtgtgtgtactggctagttttgtgtcaacttgacacagctggagttatcacagagaaaggagcttcagttgaggaactgcctccatgagatccaactctaaggcattttctcaattagtgatcaagggggaaaggccccatgtgggtggggccatctctgggctggtagtcttggttctataagagagcaggctgagcaagccaggtgaggcaagtcagtaaagaacatccctccatggcttctgcatcagctcctgctttctgacctgcttaaattccagtcctgacttcctttggtgatgaacagcagtatggaagtgtaagccgaataaaccctttcctccccaacttgcttcttggttttgtgcaggaatagaaaccctaagacagtgtgggtatcttgccagcatgtattgtctgtgcaccgtgtggatgcccggtccatggagggcagaagagggcatgcagtccactggggctggtgttacagatggttgtgagccactatgtgggtgcagagaatctaacctgagccttctggaagagcagcaagtgcccttaacaactgagccatctctccagtccctggaatgatcacctggtttggaggcttcttgctaccaagcgcttgatcacagggcaatctctgcaaggtgattctgtgaacgtcactggagctgaaggagaaaggcaggtcagcaaggtgagtgtcacaggagcctgctcacctcctcagagaagcctgaaggtgtccacatgcctggtgctgagtatgccatgctcagctcaatacacattgcagcaggacccgcctacccgggtcagcacttaccagaaggccagggaaggcagggaaactgggccctggactttcctcggacactaatgtgcatttccatgccttttccaatattctccatgcttgctttatcaccgtacatgaagaaagaaaaactgagggcctaaagcctacttgctatctctggttatttgtttgttttgtggttctagctccttggtttagtttggtttcaatactggagaaggaacctggacccccaactctgaagcaaacactctgctgctgaactctattcccagcccccagcccctttcttccccactaaggtagttttttgagttgtttgtttgtttaaatttttaagataaaagtctcactaagttatccaagttggccttgaatttgcaatcctcctgtctcagccttctgagtatctgggattacaggttcataccacctggcttgattatggacttgatgtcttctttattttaagtcagggtctcataatgtagccccagttggcctcaaacgtaccatcctccacttcagctccctctaagaggcaggaatactgacatctgccaccacaccagctttcctaatcaccaaaagaagcaagaattagaacttcatgctggcaaaatggctgctgtcaccgttgccactggctcctcctagtccatcaagaggagctgtcaaaataacaaatgacatattttgaagtccaggattacccctcagctagtcttccttggtgtgataggcagttacctctccctatagtgtctttcttcacctccagcttttcattttcttcccgtgctgctctcatcaataaaggtctctgctctaaggaaagagcccttctcagggaagaatttagcagtatccgattacaaccctcccgggaagcaggtgctattacctgtcaacagggtttggggcatagcaaatagctaccacccccactcagttgggctcctacctggctcccagtcagataaagtggcaaaaggagacagtccttttggagacctcaaaatctcattttcattccccttgcagagaagagagtggctttattgacagagacgactgaaaattgcttaaaaattgccaataaccagttcgcattgaggcagagagacagtctggctgaagcaagctccctgctccagcgtgcagccctgatgggcctccttttgccgcagccgggagtctatggcacatgcagtctgcaaggagcctcctgtcatcctcagaagcatcccccactcctcttccactccctgcctgctgctgtggtttcctggatccccaccacacaccgtcacacattcggagaatcactgccagaaactcagctcttagactgattcagggacccaaggtcacaccctgggttgtagttggacaagggaaagggctcacttcccactggagtgctccttggcttgactgtgcaaccaagataggccactagatgtcactaccatggataatgatgatgatgacgacgacgacgacgacgatgattcttctcctcttcctcgtctcccaccccacccatgtactttcctctgcttttttcagtgctaggaatagaacccacggcattgtccggctaggccattctcactccctaaattcatgcccttacaccagaccattgaaacagaacctccaacaaggagagctgtagactaaattccacctcagcctccatggcacagcctctccacttattatgactgggatcctcagggagatttccctaagtgaattccatccaaacagtagagctgaaacggaagccagacccctgtcagctggagcaagcaccaggtgtggtgatgggtctctgctttcctcctcctcttcctggctgtagatgacttctgcacatgctcctgtcttattaagaacctcatagggaataaacgaagaggctggagagatggctcagtgattaagaacactggctattttgcagaggacccaggttctgttcccagcacctacctggaggctcacaccatctataactctaattccagtaaatcagagaccctcctctggcctctggaggcaccaggcatgcatgtggtgcatagacacacagcaggcaaaacactcatacacataatttaaaaataagtaaatctttgggttttttttttcaagagttgtggtgatttgaataagtgtagcccagggagtggcacttttaggcagtccatccttgttggaggaggtgtggccttgttggagaaagtgtgtcactatggggatgggcctcttggcctcttgacatctgaagctttccttgtctcagtctcccatgctgtcctaggaatgctgggattgcagacactcacactaggtgcccaattttttgtgggtcctgaggattcaaactccgatccttgcacttgcaccgtagacacttttaacccactgagccagcttcccgaccccagcacagtgacttcagatgccagggcactgcagaagtaacaggggctctcacagagaatgaatgacaggtgggtaatttacgatggttcttgagacctgaactataattatgaagtatttctaggtatatattcaggatgcaaagtgtacagaatccagagctaatgttaatttattactgacagctagatatatgataatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgatgcctgacaaggccatcctctgctacatatgcagctggagccatgtgtactccttttgttgatggcttagtccctgggagccctgggttctctggctgattgatattgttgttcttcctatggagttgcaaaccccttcagcttcttcagtcctttctctaactcctccattggggaccccgaaactcagaagcaatggttggctgcgagcaattgactctgtatttgtcaggctctggcagggcctctcatgagacagccatatcaggctcctttcagcaagcattttttagcatccacaatagtgtcggagtttggtgactatctgagatgaatccccagtggggcagtctctggatggcctttccttctgtctctgctctgcactgtctccatatttgctcctatgagtattttgttctccttctaagaaggaccgaaacacccaaactttggtcttccttcttcctgtgctcatgttgtctgtgaattgtatcttgggtattcagtgcttttgtgctaatatccactaatcattgaatgcattccgtgtgtgttcttttgtgattgggttacctcactcaggatgatattttctaggtccagtcatttgtgtaagaatttcaggaattcattgtttttaatagcttagtagtactccattgtgtaaatataccacattttctgtattcattcctctattaaagggcatctgggttctttctagcttctgactactataaataaggctgctatgaacataggggaacatgtgttcttgttatatgttggagaatcttttaggtatatgcccaggagtggtatagctaggtcctcaggtaatactctgtccaattttctgaggaaccaccacactgacttccagagtgactgtaccaccttgcaaagtgtcctctttctccacatccttgccagcatctgctatcacctgagtcaccagcaggcaagggctctgtgccacagttagagtcacagcccctcctttactttttaagacaagctgccttcaacctcattgtgaacctcctgcctctgcctgctgattggatgagattacagcaatatttctttttaaaaaaaaaattcttaagggttatttttatttttactttaaatttttggattttatctgcatgtatataagagtacttcacccatgccaggtactctcagagacaccagatccccagaactagacttctaggcaattgtgagcctccatgtaggtgctgggaatctaacctaggtcctctcgactagcagccagtgctcttaaccaagagacatttcttggggcccaatctttcattttctgagacaaaatacttgtttttaaaagatcataaaacaaaagctatattacttccatccagtgtagtggcaaatgtctgtaatcacagcacttgggaggctgaagcaggaacatatgtggctctaggccagggaaaatctgactcaaaaagaaaaaaaaaatctttttttatacaggtcatttacctcattcaattctcggcgctaatcagaagacttccatgactaatccacaagaaagctaagacgaagtgtccttcagaggtatcatagcttaaaagactggcatttattcaatgtgtgtgtgtgtgtgtgtgtgtgtgtgtgtgtgtagttgtgcgtgtagaggtcagagaacaactttcaggaatgatttctgtctccctccactgtgtagtccaggtcttccggcttggctatagcacctctggggcatgtcgctcactcagaaacaagactttctcaggtccagtcctggcggctcactcagtttcctgccggttaccaacttgaaacttactgcactttctgtgttactgagatgtaaacactgtgctggtttcagttgcatcagactccatggtcacgtacatgatacaagcccaggatactggcagaagtgaaacctttaaccttatcaactaattaaggaccccaaaggagaatgaggaggtatgtgagacagggacttggttatcagggtcatctctcatctgagaacagaatcagatcccattgaacaggggctagataattgcataagtaagtgtcctatctggaacatgaaatcttgctatggctgcttaattaaatcatgataaaaccattctgtgtctggtgcgaggtgctgagagttcattgtccacaagtttaatggaacaacgactgggtctttgcattcctttgactttaaaaaacgtttactacaacctttctggagagcaactttttctaaaaaaaaaaaaaaaaaaaagtcatattaagcaaaactagtggtgcaggcctttgacatcagtacacagaagagagagatgggaaatgggagatagagatgtaaaaatgggagattcaagctaacccggggctacagaagtgagttcaagaccagcctgggtaactctgtgaaagcgtatctcaaaataaaaagggaaggggacctgggggtgtaactcagtggcaaagaacttggctaggaggtgtggagtcctggagtccagccacagcactacaaaagtgtgtgtgtgtatgtgtgcgcacatatgtgtgtgcacgtgcacatatgaactcagatatatatacacatgtgcatgaatgtgtatgtgtaggtatatgtacataagtgtgtacacaaaccagcttggagagcaatgggtttatttggcttacaggttacagcattatcaccagggaagcaaggacaatagctaaatcagaggccatggaggagtgctgcttactggcttgctacccgcgggttgttcagcacactttcacatacaacaaggggaagggaaaacattgtcagatttgatcctggttcctcctttcatgctttcctatctggggctgaccctaatgtctttctccttctagccttccatgctaattcctccttcccccatacttcgcctctaacttgtaactgaaaagaatccctcagcccttgattttcatttcttcactatttggcccaaatggtgaaggagtctgtgagccaccagagagaattctaactctgctggttttccaacacccaaaggctggtgacctgttttcaaagatttgcttttatttgtggggtggggcagggcgggtatgtgaaaatgaatgctgacactcatggaatccagagatgccagacctcccccacacacctcactcccccccccccgacccccggagctggagagacgactgattgggagtgttaggatggacccctgcttacccttgcacaagctaggaaaccccatctgccctccttcctcgcaaccccacccacaaacaaaggaagggctccaagtgcccaggctgttgcaacctcctcctctgatgctgccagccaccccagtcccctcagtccccagtacgctcagctcttgggcacaaacccagcttactgctgacatatcatcacccttcgcctacagtctataaaactacctcaccctagcccggatgcacgatttgccccgcccggttctttgcgacccgactcgtggatcccacctgagaacggcatctaataaacctggctttatctatctctagtctggtctaatctggtctatatctgcgtcatctgtagcgagaagaagcccatccatgagctgagggggtgtgagctgcctggcatgggtgctgagaaccaatacgtcttctgcaagagcagaatccactcttaaccattcagtcatctctgtaaccccccagctggtaaacttttatccagagacacagcaaataagatggctgccgtacctaaaccattactttttcgtatgtattttgacgactcaaaacccaacctgcttgaagtgggttctaaatataccaggaaacatccaaaaggtatctcacctaacaaggccagcctggcgctatcactacgatcctccctaaagtccttcctctggccacgcccacccattgaatccagacccaagctcgtggctctgccattcctgctagcccctacctgccggcttattcttgggttgaaagctgggtgagattgcttctctcagtttgtattcatggtattagcacaggacccaacagggtttgttacagcagagcagatacttcacggaaacagatccaaacgacaaacatgacggctcgctcggagttattaccgcaagctcaccaagtcagaccttacaactcctgaaaaatctttcaaggaccgcaagaaggttcagttggtaaaagaactttctatcaaagctgcaacccgagttcaacccttgggacctacacgggagaaaaagtgaaccaactccagaaaattgtcctctgtcttccacacacgaatcaataaatgcttttttaaattttaaacataaaaaaaaaaaagaaagtatttttgacccagagccagcactgcctctcatcagacatacggttaggacctctacatttttcagcatacgatgcctgaaaaaaataatagctccaattagagcctggtatggtggagacacatctactctcccaagctaccctggagggctgaggcaggaggttcacaacttcaaatgtctgcctgggctaactacataaggaattagaagccaggatgagttgtttcaggaaactcaatagctcagtggaagagcatttatctaggaggtatgtggttcaatgggtaaaggtactcgctgccaagtctgaaggtttgagttcaatatcagaacccataccatggaaggaaagaacagactcctgaaaattctcctctgaccacaagtctccacaaataacaataaataaatacgtagataatattttgtgtgtgtgaatggcttacttatctgtatacctgagcaccatgtgtgtgtctggagtctgtggaggtcagaagaaggccagagcttctgagtccctggaagtggagttacacatggttgtgagccactgtatgagtgctggaaaccaaacctgtgtcctctataagagcaaccacggagccatcgctccaaccctcgctccagccatcactccagccatcgctccagccctcgataaactttaaaaaaaaaaaaaaaaaaaaaaaaaagtccagccagattcacaagcacaaggatgtaaagaacgatggggtaaatgaggggatgaagaatgccccagcaggttgaggccacagtggatatcaactgagttctagaccaacaccagctctgacaggacctggatggccacagcatctgcccagagccttaaggccctttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcacctgaccggctcgccgctcacgtgatctgtctcggcgccgccatcttggagccacggccgaggaaggggcaaaaagggggaaagagagggaaaggagtcgggagcgaggcggacgagggcgagggtacggtggggtcccggccggccaaaggaggctcgcaggagcagcagcccgccgcccgaccgcaggtaccgcgccccgggccgcccctccgcttgagcgccgccggccatgtgcggcctcgctggtgacgcccgcttcctcctcgccggtgacgcccgcggcactgccacgcacccgagcctgagctccagggccctgtgtgtactgtcgtccctctgtcgggcctgtggagaccccgggcccgccgtgccgctgggggtgggggtcccgttgctccccaggtcccgctgaagcgcctttgccttctggagacgtgaaagcgcttaggccagccaggatggagcttaagtttctttaatcccccgtcctttaagcactgcgtggtgtaggaaatgccagcgcaaacgaaaaatagcaatcgtggcctcccacacgtacacatcctctgggattgactgatctttccagagatcgctgagaccattggtgaaagtgcccacctttccagacctggggcatcccgatcgttgtttggagtccgaggcctgggtgattaattaggtccaggcagccacccccaccaaaggttgctgacagtggacaggaatttgctttcagtctacatggcccaaggcaattactggatttacccccttttctgtctgagtttgtactttctactctactggtctgattctgtgtatggattgctatattgattaaaaagagaaagtttgacccttcattcctttaccatggtaactctggaaactcggaggatgccctagcggtgtactaattttacttaactgtaatcgctaagttactttctaagggaaccgaataagcctactttaaagcaacaataggaaaacagtagccaaaaaaaaaaaaaaaaaggaggaccagggcaggaaactgctttggagaatatataggtcaagccacgttgtcgcatcttttcatggtactcttctgcccactgtgtttgactaatttacataatcaccccttaggctgtaatttcggttaaagttagaatagcaatatgtcatttattattccatattggttagaaaattatgtcagtaaaagcagtagtttgctgagtgaattacttacatggagggggaggtttaaaatatacaattgttagaagttttccaggctgatttgttttagcttctgcaaaatcctctacttgttaagtaaattatgtaaatttgcctcacacaattacattgcatgaacagctttccgaaatttcttttcaatgttaagtattggaagtttcttcactgccgaaataagttactgtgtttcgcccgccaagggagagacgtgtttgatggtgtttatttccttcttggccacagctggattgtgaatatcgatccaggagactatctgtttcagaaattgattggaaagacactggctctgccactaacagccatgtaaccttgggtaagtcacttacatctcactgagatgccttatttataaaccgccaccactgtgactggacccacagaactctgagcaaacgaagctgtttgctgctgcctagcatccatccggtgctgttacttgatcatgctcaccttgagcatggaaagggaaatcggtatactagggaaagcgtggtttgagttctgaagccaggcactgtttcacgtctgtgagcctcagaggtgttccttgacactttgtgtccaaagaagggcttggccaccaggaattacaggaatattacaggaaatggacgcaggcctaattctgggtttgcagctccaggacaggtggtcttcagcgctatgtttggcatgtgtgtttcataaattacaatgaagctgaacactacttgatgttagctacgactgtgttttaattgtagctgcaaagtcaaaatattgtcccaggctaggtgcaggtaagacactctatactatgaaaccagtatacttctgtatttatactccagtttttctctcagttgctattattacattgagctgagaagattttaaataaattgtaactgacctttgtaagatgtgaagtaaaactagcttttaggttacttttaataggcagtttgtgattccatctctaaaagttcatccagctttcccctcacatttcacaccagaagaagctaaaacaaagagtgactcgcctggatcatgcagccagggcacttcagagaacagaggaaccctaccttcttttggctaaaacagatgtctgaaagagtgtgaaattcattggccatcgcttctgttgttttggtgtggggttttgtttgtttatttacttagttggaaaaacgaaatgcatactctaaaagaagatttctttatatcgtctttctctctttgtatatacccagaaaattagagcctttcttcaagcccacatgaatcatttcgctcagttctacatgtagccatactgctataactaaaaggaactaattacatacacaaatacaccaaatagcaaattacaagaaaataaagacaactgaatttgttcacttttcttgggaaagacattaattacaagcttttccctgtggatgactgttgtcagggactcggtatgaaagactgtagaacactgctggtttaggagagtacctaattcacttgttctgactgggtcttctgatctagtggttacaaaaaagctatctccctcgtggctaacatttctaggcttgtgtcttggtgaaccttgcagtgcagtgatttttatctgttcactaccttagagagcatgctaattcctattgtaagatgttcgtgttagagttttagagtaggctttctcatttctcaacctttcttgtcactcttagccttgcatttacagcagagaagcaaatagctctcaaatcaggataactgaaggaggttatatttacaaagataatattaccaggtattggccttctattcgcaggccacagagtgatggtgttagtgggagaagcagcatcaggagaacagaagtgccaaagccagaaatagatttgtagagagcagccatccaggaagaactgacctgttaagaagcaaccaatccggggctggagagatggctcagtggttaagagcaccgactgctcttccgaaggtcctgagttcaaatcccagcatccacatggggcgggggaaaaaaaaactaaagaacaaaaagcaaccaatccagggtgacctagaagcagaaaccaggacattgactgccctgttccttctcacctgtgttcttctccatttgcagtgccctgccagaggactaggaagcagagtcccatagagagaaggccacaaggggcccagagagcacagatggtgatgtctccacacccctagatgctggggactaagatggaactttctggtttctttaacagttcggttacatcgagtgatgtttttctggacgctgtcttgtgagagggcatgtgacgttttactgaacataaacacttgagaggactcatgatatttaggaagaatataaatagagccccacaaacactgagaaaacgcgcttgcattgcagtaccacgtacttctttgctggtgttcactttgtagagagaaacacaccaaagaacttctcatggtattccggctgattctggccgcttctgctaactggtgccaatttggctgagccttgctgtttctgctggattgtgccactactgctgattcatggttggtgtttgctatttaactggactgttggtatccgacaataaagattggaattaccccaagggactacttctaaacaggtccacaactctcttttcctagtaaccttctttttcccctacttctggttgatgggttagaaggaagattgcagagtttaagaaccctaaataaagtaagttttgaacaatctaaccctacagggaccagtggatatactgccttttccagaagccttgtgcttgctctctgcgcagaggagccttctcttacttaggatttggccatatatacttagccttcatgttaccacagcgttggaaagccaacattagtcttctctagcttctccatgtgcttatctatgttcaccttcgagtaactatgtcagtgtaaaagcctggcctacctactttctgtgtgccttgcacatggtgatgttgagggtgggtgtatttggtttgtttttattatgaaaaactttagtcatttgtacaagtagaaagaagagtataatgaagaggtaatcatgccaccttcactgacagaattacttctccctctatcaccttcttccacagtcctaccctacttttgtcccccagcatcatttctttcagctgtgtttgcttcggtctcttaagtccaaggatggaattcagattatcgtgatccgtggtgtgatttgagtcactagtactgtatgctgactctttttcatctctagttcaaatgaattttattagctcacttgacatattaaattatatataaatatctacatatttatatgtacaatgtatatagtacacataggctgcatgaatgccataaggaaaaaaataggaaattaaagacgtagttggttttagtgacctcctctcttgtgtacagtggctgtttgtgaccttttatttaacagactttccttttaatgagtttttgcttgcttgttggttttgcctgcagacctaaactggttttttcaggtgcttcttgatgcgttttatgttgtcatatcggtttgatagctgccttactgtacttatccccaaatgtatgcagcctctaaaatgagatacttacataaatgttctagggaaattggagcatctgctgcaagttgccattagctcttaatgcctgagcacacgcagctctgaaagtgagtgtgtgtcagagtcttttgtattagccgttttcttgggctaagatgaactcctcctcttgacttcactttctttttaagaagcacactgaactatccatggggagcaatttgcactgctctgtcttcctcctgttggatcattaagtagaagagaggaatcaggagtcacctttgtaacactaggtgtgaagtctgttgaacaaacattaaatgttcaccaagttatcagctagcctgtgtggctcttacacccacaggaagggagatcttgtatttacaatactatacgttgtatctggccaagaaactgaaaatgctgtgaattgttacttttattatgtaactaatatattgttaacagttgaactgaatggcaacagaagtccttcagttatgaccccacaggggaatcagcagtcacatgaagaaccacagcttcccttggccaaaacccactgggttcttgttttgcttcaagtgtgtctgtgcatctacttgcatgagtcgtcttttctgctaaagagtcactgtttctgctaaagtagctcaccagccaatccccaggctgattccacctcactccacctgactccctgactccatccccagtgctggggttataggtgtgtgctacaatgcccagtacagttttcacatgagttctgggaatccaacctcaggccctcgtacatgcaacaagcgctttatccatgaagccatctccctagcccctaaaactggagtcttcagacagtgagatgtgttttaagatgccacaaaaagggttttttggtcattgtttccccctgaagaactacactgtcctttatcagtctctcctgtagcaactcaaactttggtgtctcaatctaaaaagatttgttccttctgagacacaacaaaaagacacaaatgttcttagagggatttttagagctgagatggctatgttattatggttctggaatattccccttcatgaggtggttgttacaggctacccctaggagaaaaaagctaatttttagctaggaataaaacatgtgcattttatctgacatggacctagataaagacaactcaagatggagagagtggcacataggacaaaaaggcaacagtgtggccagagacttcggaaaggggcaagcccaagtgcaggcgaggagttccctaggagcctgcctggtgcagtgccgtaggtatgctcctggctgggaactaaagccctcatgcaggattcagccctgtagagagaagagtgcaaaactggagtttaagaatgattcctagtttttggtctgtaacttgtggtgctgaaaatcttgttggcatttattgaatgttgtgagctaggttccagaatgtacctaaaatgtggaaaaacaaaacttgttgctggaaaagagcctaaacttaaaacttcggtccaagtcaacaaaataatctcaatttaagtcaaaggaaatgtctgaagagaaagggctgccaggaagtgtaaaggagattctgaggcctccagagggagggtgatgttgctcctaagcgctgtgtaccttgctgcattattctgtgcgcctgcaggaaacacttcccggcctctgtctggcactgagccagaaccagaatgacagcgtttgcttcctaagcccatcccctgctcaggagagagacacggatggggatggggaacatctgaccactgatgcgacctctaggaagccacagcagagtttgtggtttatctggcggaccataaaccaaaggaaagaaaggaggaagtagatcattgctcttatttagtttcatttgcaaagtacttcccaaaattcagtattccttatagtaggatgtgaatatattttcagaatttcaaaaatttgagcagagaagtgtgatttttcgttatctacagttaaaatttggcataagaaatagtttatccagagttacatgaaatcatgttggcttcacagactgatgctttccagtagctcgaggtgactccacaggccccaaggatggctgtttctttaaacaaagaatcatgtctctttagttctagaatctcaagggtttctttaaacaaagagtcatgtctctttagttctagaattgcaagggattcaagggacattagttctagaatctcaaggaggctgggtgacaggataaggtgttaaagtcttacccaaggaacagggtctttatctgtctctaggagaccgtttcaaaaaggaattctgagctgtttaagtctattagggacagttgggtgcattgataggaacctcccaacttagaagatatttaaacatttcagtcagacaccagagttgacattatcccataacccatgctctctgctgtgcactgtctctagatatggaagaaagcagcagcattgccatgttggtgcaagagattggagaaccggaggctgtgttaactgctgaaggagtcctcagcccttcctcagaagttgaccaacaaagaaaagctaaagcagatccattggtccacgttatccagaagctaagcaagatagtggggcatgagaagtcacaaaaatgtctactgattgggaaaaagcgcccacgtccaagtgagacagcaaactctcttgaaaagctagagaactgtgagattccagctaaagccactgagtcccctgctgctggggttaggaaaaccgagatgtcacaggcaagttccactcttgcttcaaatgatgggaaggctatgtcctaccagtgtagcctttgtaagttcctgtcaccatccttttctgtgctgaaagagcacgtcaagcagcatgggcagcagcatgacgtgatgctcatgtgctcggagtgccacgccacctccaggagccagcaggagctcgaagcgcacgtggtgagtgagcacgagaacagtgccagtagccaggcccggtccagcccctccggtcagggagccacagaaagaaagagtgagaccatggtagacatcccagtgaacatgggcagtccacagacccatgctgtccagagtgcagccatggcagagtcgggtcggaggaagtggtatgcatatgaacagtatggcatgtaccggtgcttattctgtagctacacctgcggccagcagcggatgttaaagacacatgcttggaaacatgcaggggaagttaactgctcctacccaatctttgagaatgaaaatgagccccttggccttctggcttcttctatgtctgctgcacctggtggggttgatgcagttgtcattgctattggggacagcgagctgagcatccacaatgggccatctgtacaagtacagatttgcagctctgacccaccgtcttcatctcctttagaacaaagcacagaggagggagtacatctaaaccaggcagtcacgctggacgctaacgaggaagaaatgctggaggtgatgtctgattccgaggagaatctctttgctgatagtttgctatcttcagcacagaaaatcattagcagtagcccaaacaaaaaaggtcacgtgaatgtcattgtggaacgtttgccaagtgctgaagaaaccctcccaccaaaacatttcctcattaatgccgaaatggaagaggggaagagcccgagcccctccgaagcccagactgggtgtgtaggagcaggaaatatgtaccatgctgataaatgtactgttgatattggggggttgatcatcggctggagcagtgcagagaagaaagacagtgagctaagtaagggcctggctcctgatgagaatgccccaccaggacggagaaggacaaattctgagtctctcaggctgcactccttagctgcagaagcccttgtcaccatgccgataagagctgctgaactaacaagagccagccttgggcactatggggacataaaccttttagatccagacactggacaaaggcaggtcagtggtccattggcaacatactcaaaaaaaatcatgtctcctcttaagaattctacagatggagtaacaagttttaaccaaagcaattccactgtggtagctctcccagagggaaggcaggaattgtcagatgggcaagttaagacaggcatcagtatgtcccttcttaccgtaatagaaaaactgagagaaaggacagaccagaatgcatcagatgatgacattttgaaagagttgcaggacaatgcccagtgtcagcccaacagcgatgggagtttgttggggtccaacgtggtggagtacatcccagatgccgagcggccctaccgatgccgcctgtgcaactactcaagtggcaacaggggctacatcaagcagcacctgcgtgtccatcggcagaggcagccttaccagtgtcctatctgtgagcacatagctgagaacagcaaagacttggaaagccacatgatcaaccactgtaaaaccagaatacaccaatgtaagcagtgcaaagaatctttccattacaaggtgagcggcggtctcaagggttggcagggactttatagctgtagtccagccaccccagtttgtttatcaatgaaaatgagttccagagaagtttggtaatttgcccaaaggtacccccaacaaattaccattgaagataggtctggaagctaagtctccatggttgctgtccagagctttcccttagtctgatgccgtgccctttgcagcctcagcgcctgttgctttcatgttttcctgtgtgtgtgtgtgtgtgtgtgtgtgtgtgtgtgtgtgtgtgtgtgtgtaaaacacgggttttcacttagaagggaacatagcgtagactgacaggcacgcgtctgacggcaaaggctaactgcatctgcacacagaccagtattccctgcactcatagcagctgctacacaaccagcaaacagtggtctctcactgcagaagggaagcagcctgtgagacctgctaggaggcagcacaagagaaatgataccatatttgctattgctggacactttgagggactttgttaggaaccaactccaagacctcacaccagctaggcaaatgcttgcctacctgtgaagtgcattcccagcccttgtttttgtgagagtcctcctgaatgtcccaggcagaacttgaacttgcagtctttcaggctccctcctgtgtgctgaggttacggggctatacccccacacatagccattgaatagacttctgtggactttcaaggcaggtgtttatcttaagtattgagccagcagccagcagaaaatggcttttatcctctgtaaagggtacctgtagtcaatcctaggtcattattgacttgcagtccctcagtgtgccaggtattgaaagtgaatctttattggccaactggggcttagacttggtctcacagattacccacagttggagtttagatggttaaaaaggagcaaaggttgctctgcccgaggctcatgggcacacggattactcttgtgaaattccaaatagcgcatccagagaggtcccaacagcgagttccaggagtatctagagatgcttttgctgcctctgtcctcctgatttggggtggagttagttcctgtgacatgtctagctggtctcagactcagaagttaacaagagcgcctgtgtttgctggataaggttttgtttgcaggaatgtcgagtcatcccctaaccatctgctccttcatctctggcctgcttgctgtgtgggaagcatgcctgtcgtggggtgtttacctcagaaaacaggcctctcttcagagaacatgaaagactatgatgaagccgggcctggtggcacacacctttaatcccagcactcgggaggcagaggcaggcggatttctgagttcgaggccagcctggtctacaaagtgtccaggacagccagggtgacacagagaagaaaccctgtctcggggaaaaaaaaaaaaaaaaaaaaaaaaaagactatgatgaggttgtgattgcctagtgtctgtctgtctctaattttgcatatgctgagtggtttttggtaggtttgacgttagaatattagtttttttaaaagaaagtagtaaagtagtactaaatcataaggatttggctgcaactgcgtgagcagatgatgggtaaaataatcaccctagaacccagtcggtaatgggccaaaggttccagaagccgcttcctcctaaccatgcaggtatatttgctgggagctaggggttaattttcttgctttatttttatttttattttttttagagccaactgaggaatcatgagagagagcagcactgcctgcccaacaccttgtcagtagcttcgaatgagccaagaatttcccgtgatgccgctgatggaaagtgtgctcaggaaggtatgtgtgcattttcattagcatctatgaactgcacaggatggcggctttcattaggacggttttgtgaatgcatgtaatgtactctgatgatgttcacgcacacaccgtcatcctcacttgtaccttgttaaatacagtctgcactgacaagcttatgaggtgaaaatgcccttcgttgtcatggaacagtgtgtgtatctgccctcttctatactgtgggtgagaatgaatcttccctttgttcctaaggaaactccaagaattgactagagtaaattacaagttctgggtcagaagtgctaaattagtaaggacttggctaaacccaggcagatagatcttatggttaaaatttgcaggggtttgtaagggccaggctagagcagagacccttggaaggtaacgggccggccgcaagctgggaaggtgggggctagcgcagaaggcgagcctccgccccctctctagcaccaaatgacctgcctgctgaggcacagcttttgcagatggcaacccccacctcaaactttaactgaggcttcctgctgtgagcttactcttctccaagtgtgacttccagacttcatctgcattatttaaacacacacaggaaccttttatgcactagttaggtactagtcggcggagtatctggtaataggaatattagaatcaaaagatttaattagagctccatgaaaaggcggatgccacatccagagaatgagggattgagtgtaataagctgtgcttcctggctgtggttcacgtaaattgatatgctttaaatgtctccagtgtggtacacagtgtttatgggaaataaaacatattggggtgactttcctttttagatttcctaagaattaaagttagaaacaactgcagagtaaaatgttttaccataatgtctcattaaattataccccagaaagcataactgattccagaatgtttctgaaggaactgattttgacaccactgtagcaccagaatccccttgtcaaacagatgccaccccgtaaaaccatcccgaacaaaaggagtttacgacatggcatctgctttcgaggtggatggctgagcaaaaacagttttgtttcctttctacagaatagccctaaatgcctctttttattttaattcattatgtttccatatcccttctaaaggagacattaagcattagacatgattggcccgtaaatcctaatgagggaataaagtgtgtgcaacttagtagcgccacctgcagttgactccagcagcattgaaagcaagggcttaaaagtaatcagtggtttttagcagattcagtgaagacatcaacatggacactccagagacacagtgttcgtaccttcctctgctctgcaatttttctgtgtgacttcgacgcttgctcctggggttaatgaggtgtagatttaagttgcataccataatcatcttggtttttggtttggtttaggagttttgttttgtttattttttttttgcagtgctagtggtaggtgcatgctgagcaagcactcttcaactgaccttcaccctagcccttaccatgattttagttttaacccccacttagctgcatttgctgctctgtcaaactatagcaggcctagctgatctcttcctgcatactcacacctggatgggtactttgattaataacgtgtggttgtgattcatgttttgataacaatctcttaactattccgtacgtttattaaacaaaaagggaagggcatgactgtcgctgtgtgcagtctttgctattgatatagcatggacgacactagcatgctttcattacagagaactgatgtaacagtactgcagaattcgttcaggctaaaggcatggcacaccgatcctgagggggttctcttgccaagtgctgggagcacagtgaagggtgtcactgcccttgtggaatcagaagtggactagtgggtatgatggcagcaaatgtcctggcatagcacttctggacttgcagactgtgtctccttgtgaagtttaaattgtcctttcgtagagacctgtcatttgtgcagccctgggtttttaatgccagcgttgcagagtctggctggtggtgtgcagaaagagcactaggctcattcagccatgtgagaaggtcctctacttcccattctgtagagaaggcaaatgtggcctcaagagctgacatcatttgctcattctcacaccagtggtcgagcagaaattaagcccgagtcgttgaactttaaatccagtcttgattctattggaaacatttgctagaagtagcacggtctctcattctgtgctatattaggcttttccatctgtcagttttattagttgtcattgatctgtaatatttttcacacacaaaaaaattatccaatatttcacacctcattttttttcagtttttttttcaaaaactatatttggaacaatgccatttataatcaagtccaagtttttaacctaccaattaaaagcgatgcttagattgtaattatgattagtgtattaatgttatagatttataccaggaaattgggacgttttgtcctgcttggcagtagttattaactaaagaaaagttcaattttagaatgcttaaatttaacttaagaattttctttgttgaaatttcaccgtgggctttcttttcttctgcaatgttacttagatcctgtgtgcactccttcccacctaggcttgcttcatggcttgctccctgcccagaacacatggctcttcctgctctgcctaagccttgggcttccatgtgtacctgctgaggaacacagggagctgggaaccaggacataaagcataggcagtctccaggagcagtgcttaggatggagccctagagcttatgtgagcagctcctcatttgcagaatgagccggtaatagggcctgtatcactgggctcgagtttgctgcacatgagtcttttcgggtctctgcccccctcctcccctcccccagcccattaagcgtgactgtgctgagttgtagaactcctcagaactgttgatttcttttcctcctaagtttaattgatggctgacattaagcagtagtaaaccaagcaaacctacatggtaaaaatgtcagagttttatacgcagcttgctgtgtatgactcgtggccagtttatttttattttatgtagatcactgttttgctctatgaatgtatgtatgtgtgctacatgagtacagtgcctggagaggcaagaaaaagacatggatccctgaaactcaggtcatagacagttgagagccaccaagtaggtatttggaactaaacctgggtcctctgcaaaactagctagtgcttttgactgagccatctctccagcctctagccatacttgataatactttattattttagcttgttggcaaataaatgtttctttaagacactgtgaccattactgattagaataacacctgtcaagttcacagtgtaacttggttaatttagctgctaacttagtcagcacaacatctgagggcaagttcattctcctgtagaacctggaacatggtacacagaaccagcccaacctgtccatgtttacaggtcagatgatatggtgttcagttcatgcttgctgatggtctgagtgcaagaaagtctagggagctgcttcaagtgtgttaattatactgtgagagagccttgattaaaaccttggcacgtagtatcataattacttgttcatgatgaggtgtaaatgctcccatgtgagtcttaccaaatcatgcctctaaacctttttccttgaagggaacaagccttcaacccagaaacagtataggtgtgatgtgtgtgattacacaagtacaacgtacgtcggcgtcaggaaccacagacgagtccataactcagataagccatacaggtaagtgtgattgactccagcattctgaagtttatcttggaatattttatgataaaggaatgctttagagataggttgaaatatttggttaaaacacatgttaaaaactaagaaatggtcacatgctggtttcttacatctcatttaagtttgttaagaaacattaagcgtgagtctcagttcagcagacattttgagacactgggaaaactggtagatatctatgtccaccagttttctgctctggtttctctggagtataagttatcagagcagtttccggtgctgcagacctcatcaccgtgatgcaaaagttgtatgctgcacatgccagcaaaggcatgaaggccataaacacacctatgaaaagtttgttttctatagtttgaaagtatcatttaatacagttttgtcacaaaagcaaattctgtctcattcgtatttagagaaaataaggtgtattcttggccagacagagtcagcagctaagcagtgactactgtttaataaactttgctacccaagggtaaaacactgcttacaataacagtgtgagcattctcagaatttgtccatccgtcataaaaacatgccaggcactgtctataaggccagggacatgagccccttagcaaaacagtttccccctgatttaatcgctttacgtgtgctgcacatgagcctggacaagttgctccattgatccaaatcatggctttaactttgtctactcgttacctctttttatctgagacattttacacagctccagatatgtaggcatataaataggcatataatcaaacatttactgatagcacaaggaaacttacactaaacattatttggtatttttatattttgccatttttaaagacagaagcaatgttattgagatatgtttacttatttactttacataaacaattataccttcgttgagcaattgaaactgaagaatatagatctcatcttcagcatttttcagagctgatcaatattttgattctataatcctcaaagctgagaacatcatttcatatgaatacctagtacaaaatagcgcaagtaagtttggggccatttcaggaactttgggaaattatgtctatattcctaagccaaaattcattgaagttttttttgtttttatttttgtttttttaatgtaattcaagtcagtttctcaagcagcaatttcttttaagattttatttattttatgtatgtgagtacactgtcactgttttcagacacaccagaagatggcatcagatcccattgcagatggttgtgagccaccatgtggttgctgggaattgaactcaggacctctgcaagaacagtcagtgaacccatctccagccctcaagcagcaatttttaaaatcaaaccatgtagcacagcacaatctaaagatacaaggatttgataattatatgctgggactgggaatgttgagtgtgttgtttgattgccttgcaacgtgaagtcctgttgccaattctcattgttatataaactaggtgtggtggcatggacagagcggtggcacttgaaagttagaggccagtaggtcagaaatcaaggtcatcacgctgggctccatgtggagttagaggccagcatggactacatgaaaccatgtctcaaaaaataaattaagtcttttttttctgtaaggaagctgtgtatgtctgtctataagagcagaaagctttgcaggtacagaaaaggccactgcaattcataacatcatgtagtctcaggtctcagctagcatgcatcaggcagcattcattggcacttcctgacttcaccagggcagggtgtgcatgtggtgttttgagagcgaaggctgctctgaagcctgctagaaacagctcaggttcttaaggctcgagtgactgtttcattgttgtatgctcagaaacccttgctgctgccacagtgtttacattgagtaatccagctgcatatggggtcaagacccaccttaagagactgagatcaaaatgaaaacttgacagacttgtttcttggactggagaattggctcagtggttaacactagctgctctccagatgacccaagttcagttcccagcatccacatgacagcgcagaactgtcagtaactccagttctgagatctaatctaaagcccttgttgagcagcaagcacacacatggtgagcagacatacctgaagacaaaacaccatacgcatttaaagcatagttttaatgtggttctaaaaatgaaatgtgcttgtacactcatgctctcttctgtcgtgtgtgtgtgtgtgtgtgtgtgtgtgtgtgtgtgtgcgcgtctgtgtgcgcacgcgcacatgtgtctgtgcataatctgggagacacttggatttgccttaatatctatttttaaggtagagaagcctttttactagagcacgatgaccattcattactgatagtctcagtgctgtacattctaagtgtttatatatatatatggtactccaaaatacagagtctgagtctcttctgcctcactctagagaaggctttatcctgagtagattaggctcacagctactgccgttggcatcttcaggatgctgttcttgcttagaagagacacaggagagtcacagctatcctagtgccttcttgtgtctccttagtcttgctttctggccttgccactgtcagttctttgtttcagtgtatgccctgtgctgccccacgggttttgcactcgaatactttgtctccattggtatagtctgcaaatctctcggctggtaagcactttcttggtgtctggttttagtggggatcactgtagtcctttctgacttatttcataagcaatctagttccctttattacagtgtttgggcttgtcctcagagtctacattgtatacatttctgattattactttgttttctcttaagaaaaatataacagattctgatagagcaagaatgtctttttgtcctctagatggtctttgtacaaatgtacaggaggctcttgatatgtttgaacagcctctggtgtaaaagccttcctacagcgacaacatctttgcttgcttttgacctttctctgatatggttccagcccgtcctagcctgcctgtatgatcggcaggtacctgtcgtatgtgagctctgcctgtgccagcagttagtccagggcttcagtctgaaccctcctacttaacagggcttgggctaaagtctgagaccctgcctaacatagcagatgctcagtaaaggctgacagtttctaatacacctcagttctgctcatttataaaatggctctggttcactatgcaacttttatcgaaaataaatgcatgtcaatattactatgctttttaaagaactgcttgaaacatatatgctaatttgtatactaccctatcaaaaaaaaaggatagattttctttcccataaacattagtttgctcatagcaggaaccttacaagatctaaacactaagtttgattgttaggttccctcaccctccctgtctctctaatatgtattatttattattatatctacatttatatctgtgcaccatataagtttagtgtccatggaggccagagtagggaatccaatcccctggggctagaattacaaaggtttgagcagccacgtgggtgctgagaactgaactcagacctatgcaagaacagccagtgcttttaactgtgaaccatctctagcacatttgcttatgtttcatatctctctgtctccctctcctccctcactcttcttttccctcaacttatctccccatccctccttttctctttcccaaatgtcttaaatcaactttttaattgaacataatagacatacatcctagaaatgatacagatcctaagttcacacttgacagataatcacaaattcttgtctagcttttgacagcacgcccttcttggtcctcctgtcatcaagtgcccttggctcctttttccacgagcaccgtcttgacgtagaatcataaatttgttttgtgggtttcagatttaatagaaatagaaccatatggtacatagaattttgtgtctttttactcttaactctgtgtgtgctgataaatttcatttctatattatattctattgtaagaccatcatacatagctaggggtgtacttcagaggtagggtgcttgcctgtgtgaataaaaccctgagtttgaccccttgagctaccaaaaaacgattatttactcattctgtttatggtagtttgtatgtgctcggcccagggagtggcacaactaggaggtagagtcttgttggagtagatgtggcccttgttggagaaatgtgtcattttgggcatgggtgggctttaagtccctcatccttgctgccttcagaacataaggtagaactgtcagctcttccagcaccatgtctacctagatgctgtcatgcttcctgccataatgataatgaactaaacttcagcctataagcaagccccaattaaatgtccgttataacagttgccatggtcatggtgtcttttcacaacaatgaaaccctaactaagacactattattgtagactttggattgttaccagatttcttttttcctgttaagaatttaactccatcttaaacattccttcacttgcttggggtgcacataagcccatttcaagtgtcagcagctgccaggagtggtgagctcctgccctctttagtgctgtgcaggtggggaagtgcactggtccctggtatgagagatgctgtctattagtgtggtgggttgtttgccttttcttggtcgtatgcagtacttcatttttattctgtgtggaagtcctttgctttgcactgctgacactgtcctgtgcaatggcttccctgatatctgatgtacagaagtttctagttctctatggacaggtttgttcatttgtatctagggctcttatgtagttaactctgaaagtggctttgattttctcaggaatccaggaagtaatggtacagaagtaaaaatatggcataataactagaatgaataaataaataagcctttaaaacaacagtgggaagggaaaagaaagccttcaggtttctttgaatgggaataacagagtggccttatagcagggtcaggcactgaggtcagtgttagcagtgatgaatggtgtgtttgagaattctgggctgggccatgtgctgaggtcttcaaatgagtgttcaagcagcctggtgtcagctgtcagaggcaggtggcaggctgggatacatgatgtgcctttccccaagacacacatgaagtacagcttgaacccttgcttcagtgggccttcctgcctgggctgcacccttgaggtagcatgcctccacatcagtagtgttgagacagcatgctcagggactctgggtcaggaatgaggaaagggcacatccagattgtgagtctgggtcttatgcaggaaaggtttgaagctggagggtagcagaagctggggtttcatttgcccaaggctctctgaccagtctgtgattggtgctatattgtcagcatttcaacaggaacatgtccacaggtgcccaagtctgcatatcatgtccctaatatcatatagcagtgtttccacatagcctgtgcacatgctcctttgtgtgtcaatcaattctagatcgtaagctctaacagtgtcagtgctgactcagtgggtattgtttaggggataatggagtaagaacatgtgcagatttagtgcagatgaagttgtttttccaaatgtcttccacctgtggctgtggaggacacaccacactgtcatttataacttgaaaaccacattccatccccaccatcacagttagacttagatctgctttaatctgtaggaactaaatcataaatcagtgtgctcttggcttaggggagagttcacattttcgaggcatgggttgattttagagaacactggttactggtaatttaatctgaacagtggtgtgggtgatgtgggtttgaaggggagagctgaaggaacttcttagcacagtggcaggagcttttaaaggcatctcagggttattgtggagcttaaatcaccgtttttccagttcttatttcttaaaagcgtagaaaatgagagttggagagttggctcagaagttaagagcactggctgcgttttgagaggacccaggtctatccagcactcatgtggtagcttacagctgtttgcaggtccagtcccagaggaagatatgccctcttctgacttctgtggatactaggcatgccctggtgcacccatgcacaaaaacaataaagtaaataaatctaaaataagaaaagtgagccaggcatgatggcatgttcctttaatcccagcactcaggagacagaggcaggccaatctctgaattcaaagccagtctagtctacaagtgaattccaggacaatcagagcaacatagaaagatcctatcaaaaaataataacaacaaatgcatagaggatgaattctatgtaatgatacaaactcagttgcaacatttctattgaagcgattagcatactcaagcctccctaatacaccattaggcaatcagcttcacctgtcttccctggccctttcacagccttgtttgttaactcagactgagaagctaactaagagagggcccaggccagggaaatacttgtttcaaccagcacatgcccttgtgtggagttttgcacctacatacgttaactgccttactagtgatgaagtactgatgaagtgtagagagaatctaagaatcacctgtcagtaaaaggccagtggccaatgaactgaggcagggaataaataggaggtgggacattggcaggaagagagaggattgtgggaaataggagagccgagggagatgagatgggagatgaactgaggagactgacataaactagcaggtagaagagctccaagagaaactgaggatacaagaacaacgaaatggggtgggactgaaggagaggcgaccaatcaagtggtagacataggctaaattaaatggttaaatacgttaagagccagtcaggaaatgaaccaacacttatagcccaagcatttaataataaataattagtctcagagtcattgctgatgggaactaagtggctgggagggaaaacagttaattcattttaacagtgaagagcctataaaaaattctaatttaatttttagcaaagacatgagaagcccaaggtctctctttgcactggctttcttttgatgacgaccttctttatcaggaagaaatgatgctttatgcagctatggatggagtgttatgatcagcatagaaagtggttggttatgtccttatagggctttgagccggccatggcttattgacaggttatcagactggccagcaattgactattagaatgtttgcttgttttctcgtgtctcggtgatggttttgacagatgtgcacagttgaagtgcccatggctctgtcaccagcagcaacaggcagctccattataggagcagtgtagactggtaacagctgaagccaggggaaatgtgcccaggccactgttgtctaggtgtttccacccattctcccagtggatgttgtcctagatggaagtagggcattgctgccctcgtggtgagaggatgtggtccgttactctgttagatgttccttctctggaaacttgatgggttttgatcggattgaaatagtgtcaggtgcttcacagtctgccttagcagagcatttggccatggaaaagtacgtgttggtgaaacgaacggtaagaaggtgagcacagttaagtcctggggtgggagggtgctggcacagtgatggtgttcatcggttactttcctagttgctgtgaggaaacaccttatagaacctacctacgagagggtctgtctggccctcatctggttgggtgatggcatagtagaatccatggtaatgggagctgcttctgaccatgaaggcaggaataggagtacctcagggcaccgggaaacagagtttgccaggactggggccagattggaaccttcgaagcccaccccacagcaatactgtcagcagggggctcatacatcaacataatgtagggaaagcctaagtgcctgggtttgatcccacatggtggaaggggaggaccaactcccacaacttgttctttaccctgtgccgtggcatgcacatacctgcctgcatattcatatacattctccctctctccccgctcatctgtctctccctcaataaataaatgtaaaaataagccatgacagtgattcaccctcaattttaaattttattatgagtgtgtgagtatgtatatgggaacctgtgtcaagtgtacacactgtgaagtggactgtctccttccaaatttgctggtccaaggggttgatcaggttgccagagtgtcaggttaggagaatgttttatttatttatatatatgtgtgtgtgtgtgtgtgtgtgtgtgtgtgtgtgtgtgtagctgttgactggactagtgtttctcaaggtcagagacccttggccttattcttagtccttaggacatgtaataaaaactgctgtcttaaaggtaagctgggatcagttagggtacgagttaattcatacctgtgcccgtctggacagccttgtatcttgggtataggtgggagctgagctgtctgatttgttaggtgtgtaattaggtacatttgtggcttccaaaaagatcatagttacacaatacaaactagaaatgatagacaggtatttccctacttaataaaaacttttattcccagaaaacctgtatccacatgtttatagtaactttattcataatagcaaaatctggaagcaagctggtgaggtatcttagtcaggaaagtgcttttgagcagacatgatgatccgagtcacatctccagaactcacagaagaaaacactaaaaagacacggtggtgtttgtaatcccagtactgagggcagagactggtggcttcttggggatagagctggccagccaaccaagtttggtacttggtgagctccagacctgtctcagaaaacaaggtgagttggtgattgccagttgttgaggcagaagggaagggtgaataagcagagcacacgggactttgaggtgctcctcagcacgacactacagtgggatgcacagagctgtatgtttttctaattctaagcagaaattagacaaactataagtaccacttctaactgttcagagttgtaacaaatcacactaattcaaggtgttcagattacttaaaacagaatttggggttggaaagatggcaaaacaatcaaaagcactggctgctctttcagaggaccagagcccacatggtggctgacttatttgtggaaggcacattactgaagtcgaaccatctctccagctcagcgttccctacccactgtgtgtttacttaatttatgtgtgagtgttttgcctgcatgtatttttgttaaccacatatatgcacatataaaaggtcactgggtataccggaatgggcattgggtgtcctgaagcaggagttaaaggtggttgtgatccaccatgtgggtgctggaaatccatcctgggtcctcagccagagcagccagtgttcttaactgctgagcatctcctcagtccccagctctactttctgctttcttgataaacagaagagaacattatatacctgtggttaaagaattttgaacacaccaggctgtgatggtgcatacttttaatcccagattaaggctggcagaaacaggcagatctctcacattctaggccagactggtctacggagcgagttccagaacatccaggacaatacagagaagccctggctcaggggggaaaaaatcatttagaacaaaaattttgtatattactatattagaaatctttccacatcatatattttagctaaagtaagatggatgttttagatccctagaaaaatctttatattataaaagatctctgtcccttgtttttttggtttttttgggttttttttttttttttttttttttttggtttttcaagactgagtttctctgtatagccctggctgtcctggagctcactctgtagaccaggctggccttgaactcagacatccacctgtctctgcttcccaagtgctgagattaaaggcgtgtgctaccaccgcccggctctggttttcttttcttatttacacttctttctaggacccctgtgaagtcagtgtgtgccttagaatcagtgataatttacattctgtgaatggtagcccaactgagaatgcttagggcttatggttacagatgcatatgagttttttaaagtttacttttaatatgacttttgttaaataccattacatcccttcccctcctctccttcctcccttagtgcctcccacccgtcctccctcgcacctctcccatgttctccaccactcaagtcaatagccctttttctttgataatcattcttacatgtctgtatatgtatagatgtctataaatacaacttgctgagcctgctgtattgtttgtgtggacatcctcacaggcctgaccaccttccagtggacagccggtgaaaggaactcatcactggggggaggctggtcctccccctctcccctcctcagcactcaataggtgcctggacttgtctgtctaggagagactgttttcctagacttcctgatatcctggctcttagtctttcctccctctcttgagtggtgtccttgagccacaggtgcaggagccaggctgtaaatgtgtccacttgggttcttctgtggttgtctccatttgcctgggagagacacttacccaggaaaggtggctcttgcataaaatcaccctaaattttcacaaatttgagatggttgtgatttccctggtgcctgtcttccaggtgctccttgtgtgggtatgtgtgcagccaccccccttccttgaagtcacacatgtggaaacatgcaagtgaccagaactacaactacgagcaagttaacaaggccatcaatgatgcaatctcacaaagcgccaggtacgnnnnnnnnnnnnnnnnnnnncttttcataagagttctggggaaatcccgtgggaaaccgctcttaaccagcagtgaagagagaactggccctaccacaggcagtccagaaaacttggtgtcgtcctcagagctcacttcccagctgcccggtgaagttatggacgccagcgagcttgagaaactgaaccccacaggctgcagctctgacgtctcaggaagaagctgcagcctggccgcaccaggcaccgagtactgcgtgttgctcttctgctgctgcatctgcggctttgagtcaaccagcaaggagagcctcctggatcacatgaaggaacatgagggggagatcgtcagcatcatcctgaacaaggaccacagcacagccctgaatgccaactagctgggagcatgtgggagggattctgaactgcaggccaacctcggtgccatcacgagcttaccagacatggaggaagcaggtggtatggctaatactctggtgcttgagtgaggatacagagctgtgaccctttgtgagcctctggcgccccttcttaatgtcaccgctgattattaaaagcttaccatagtccagaatctgcaagcagaggagttgagaagacagcagagccacactggtgtgatgagggaaatggcagatgggaaagggcagccactgtcgccaggatgggcagtaggaagagggtcagtgacttccactgtctccagagagcagtggggctgtggaatggccttcataaatcttttccttgtgttgataggaattgatcacagactcaatgtagggtatggtcctttactccctaaaaaaggagagagatgcccaaatcactcctggattataaacatttgggaagtaaattatttcaaattcatagtgactccatacaagactcaaaccaaatctcaggttcacagaaatggatgacttctcagaggtcagtgtgaacaacccgagcccactcctccagtcacacagccacactccccttcaccgccaccgctagcagttgtctgacagcctcctcgagcaggaggacagagactgctactacatcagctgtccttgagctagctcacctgcttactcaagcacactgtagcttgagagccaaagaaagcagctttggggaggccggtgtggtggcactggctacgattcacaggtgttgtgagcaggggattgcaggatcgaggccaacctggattagcaggactgggcctcatgaggttaaaaagatcccttgtcgaatgatcaggtgcctcaaagtagcacagctggtacggtttgctctgcttcgaatttatgagtgtagttacacttaatagaacaacccaggtgactaaggatggtccaacctcagtctgtttgaataaaagactggtatggttcacatagtcaggaggcagacacaagtggatatcagagtttgaggcaagcctcatctacatagcaagttccaggctagctaaggcttcaaagtgaggtctcatctcaaaaaaattaaacaaaataatttttaaaaggactggagggatggctcagcaatttagagcactgagtgctcttcctcaggatccaggtttgactcccagtaaccatatgaaacttacagcaagtgctggggatctggacactctggcctcaccgagcacacatgtagttcacaggcataattcaggcaaaacactaacaataaagtcttcaagtaaaattttggtgagaactttgaaaacctggggctatgcatagcagttgagcactcatgtacatctagccacaagaaaacaaacaacacaagcagtttcctgtcagaaacaccattcggcaagtggctagtatatttctaagagagtccatttgttagtgtgcaagaaaatatactgagaaactagctcagtatatttgtgctgaagtttgcatcacacagacgtgaccccattagtcccatggttggttccatcactgctaagggtgacgtgaacaaggtgctgtttgtgtagttctgatcgcttactgttctgtgaaagcagactgcagtgctgctaatgtgggtgttttgtacacacccagagtcgaggggcagctcccggaaggacagagtccgtgggtgttgacaagctttatagcttgggttcctgaagttgaggtgtacggaaaacgagttattagctttcacgtggggtcgggagctatggcatggggccagacctgtggaaacactttctgatttgttttatgtttttccaccataattttgatgacactatttaaagaaaattgactaaaaattttccattcactgattttgggtagctttttgggggatggtggggagcggagtctttgtgtgtagtcctggctgacctagagctcatgaagaccaggctggcctcagcctcccaagtgctgggattaacggcagtagccatcacacctgccaagataggcttaatttatctgtgaaggttaattcatttctgttatatggattttaataagaaaatggatttatagatactaattcaatttccctaaatttattctatatggacttagatgaattttctcatattttcacaattcaaatatttatatttaatgccaaatgcaaaaaaaattcatgtttccatttttatcacccattgctattgtgcctactgggtctggttttcattttgctgttagtctaaccaataatagccttcagtgaattttctgtggctttaattttccacaattggttaaaaaatagtaatcacccaaaccccctaccatttcagcagggcggctggctcttcagaagatgcttccacgtcccttcagaccacatgatagcaagcatgagtgcaagccttcccccacccacggggaaatgtaataacccaaaggttcagagcctccgctctgtcgtgcgttcatatgagcccttgggcctgggccctgcatgtcctgatagcatttacagcaaggctctaccacgaagcaagattctgagtaacacaagcatgtatgtatggttgtcattgctggggagactcttacccggtcagggtcactgctcagaggagtatcctgaccactgctctaagctttggcatgggaaaccctgatttttgtctcttgctctgaccacctgcgcttctaagagcaaatggggaatactgctttaaaattactgtgttcagtaaacattagatggagagagaggtgccagttgtgacctttataaatatcattttgtcccttgctgtgatcacaggactctggcagatgccctcactggcctgtcagccatgtgcctgttcactttatctgtggcttgaccacacgcagcgatcgataccggctgaagcttctgccctggaccgctcagtcccctgttcgaggttaccatcggtggctttgtaattactgttcttttcctcacaaaacaaatgtgagcatcatgtttacatcgcatctctgcagcgtagttggcttgacaaagatgagcaggtgtctctggtctcagtttcataagcacttatttaatccggttttcaattgtgcagcaaggtgctcaaagtaatagtctataaatatatttaatagaaacttgagtttgacattcatgggcgtaaagacatgtatttttttttaaagaaataagtattgcgtaacactatggctttgcttctgtagcccaagtagagaaacttctggaacgccatgtaaaaaagcaatgattgattctgacgctgattcattaaaactggatgattggcgtttggtgacattctgttgcccgcccacccatcatgctgcaaaccgtgtttgtggcagcacaggccacctggttagaagagtgagtgcagcaagctctctggctggcacctcttaattttcagaagaactgtccaaaattagagtaatttattttgctttacaggagtttgccatgtattgacttaaatattgtattttggtaataaattttttttgttaaaaaaccacttgtttctaagtttccttagctgtctgcgtgtattcctgtcttgggtttgttgagttagaaacttgcatttaagccactgaaagcttcccgggagctggttggggtttactgttaggctctgttaagttgctgaggtagccctggcgcgccagggctgcgtttcacaagcatgggctctgggccttctcccctgttcaacagccctttagcttccacagcagacatggcgatgcttccagtgctgagctgggggtgccggctcccttcctgtaattagaactgctgaaggccaccgactacaacgctcctcatacttcgatcctctcgtagcctatcaccaaacaatctcttacagtcgattccttgcagaggccacaggtgctctaatgactacagcactgggtttgcttcccccagttcgtgccctaggatcccaggccctcccagctggaagtgactcaaaacaaagaattctccttgatagctacagcctcttggactgttctctgtagggtgatgtggtcctatctcttctctcaaggaccagatctcaacactgtgccatgacaagctaggagtataagtcagagcagggggggacctagatccagatcatggggtcccatatgacagccatagccacatgactactgagcactggagatgggacttgtgttctgagggtaaaacagaacagttgcaaaaattgagtacaaaaaggaacgtaaagcatcccaatagctttatatgttggcaacgtgttaaaatagcttggctatattgagttaaataaaacatgttaaagtcatttcactttgtgttagcttttcgtttctatagcaaaatacctttaacaaaaccaaaccaaaataaaaccctcttaggttgacttggctcatggtttcagaagcttctagccaagatcatctgcagtgaggcaggatcttatggtgggaacatgcaaagcagatagagagctcatagtggctaggatatcatggtggatagctcagtgaggaggggcaggcagacaggtgacaagataaaaacataagacttacccagggcagagccaggaactgttatctcctgccaggccccacctctgatagtggcatcaaatgatgaatccatgcctagcttgctggctgatgctaaactcagtccccaaaagttcacagccaaacctaacacaggcacctttgtggccactttatatccataccataacacacattattgtggttattagaaactttgaaagtgcatacatggcttatattatgtttcccttatgtagtactggtatagagactggcagactgtggcctccatttcaaacctagcttgctgcttattttcattaattgtcccatgggatctcagccacatcatttctcttccctgaacttttttattagctgttatctaaaagtctctgtgtttgagtgacacattgtatgacccacagaggccgtatgtttactgtctgatacagctgctgagctctgggctctgaaacaatgctgaatccgggatctgacagctaccagagagcgaaacgtgttataactcaagctgtttccccgggatgttcagagccgggctgcgtttcttcctcgtctgtcttttgggagtgagacacaactgtgtaccacggtgtgtctttgaagtccagaagaaaactttggactgggttttctccttccaccttcacatgctttcctgggatccagctcgggttgccgtgacacatgccttcacccactaagccatctcacggtattcccaaactcacctatacaacttcaacccaagtctgttgactctgtgataggtatgtaaagtcaaacaaccacctatctatctagtaggtagatactaaacggtgctgctccgaagttacccctgtcaaccacaacatgtctacattgccctccctccaggctcatcccgtgctgtggccccttcagtagtaacttggtcacagagcctgcctttgtcagcacggtgcagggtgagctcagtaaagtcactggctggagtccgagataacagcaaagagcatgcaggcccctatagccaggctcaccggtgagcatgcaggcccctatagccaggctcaccggtgaggacattggctttggctttgctgtaaaagggctgaggatgtcatggagattcctttcagatcaactagggaaaatgtaaaatgaaaacatccctggctcaatgaagcctcagctaagtggtggtgtttgaaggtctttcattattgttgggtttccaagggatttctttctatgagtgtgtctgtgacacaaagaccagaagagggcattaggtttcccagacctggagttagaggtggttgtgaacagcacaggtgggtgccctacaaaaacagggaacattatcactgagccatctctccagcaacccaacagcttgtttagaaaagagggtgtgtatcctaagctccagcatgagcagcaggctccaatttgtgtactctgttaggggctgtagatctagttttctggcagtgccttcatacatttagtatctagatttagctcttttttttttttttttttttggtttttcgagacagggtttctctgtgtagccctggctgtcttggaactcactttgtagaccaggctggcctcgcactcagaaatccacctgcctctgcctcctgagtgctgggattaaaggtgtgcgccatcacgcccggctagatttatctcttgatctggaaagtataggtaagattatgccagcttaaggaggtttttttttttcttcaataacaggtaatcactttgaatttttaaccttataaaagatatatatacacacatatatacatacatatgtaacatgttatatatacacataaattatattactttttaattcaagtttaaaattctgattttttagtcatttattataaaacaatacaatggaataccatgccatataatgaaggcatcagatatggtcttttttgtttaccacttaaccagatttataccagttgggttactgagtccagctaccacagatgccactctgtaacagtctgtaccattgagtagatgacagatgcctctccaggaacatccaggggcacagactcctcatactgagtgcatggtgtatttacacagatcagaaagtgaggaatccttgctgtgagctgaggcccaactattccaaagaaaaccagtatgtctgagccagtggcccactgacagaacagaactgcgcgtctttatttcatttctgatgtgtgcattatttctcagctctccccttcgttaaaacaaagtatttataaatatctgtgtcatcaccattggcatcagtaacaatcacttaaattagtaccacagatggggtgtagctcagtggtagacaatgtgtgtagcatgcataaggccctaggttttatccacagaataaaaataaataaataagggaaattaataataaaacatgtcatcttagggctgttgagatgggagagctcctgtctagtatgtggaaaaccctgggttcaaagccaagtcacaaaaacacagcataaaattcttacctattaagtgtgcacacagtgacctggaaaagctcttgtcggagtaaaacatactaggcacggcaatgttatcccatagctgttattccaacacttgggaggtggagcaagaggatcaagagttcacacccagcctttactacattgtgggtggaggctagcctgggctacagtgaaaacgtgtctctaagtaaggaaaaataaaaccacgttactcatttttcaggtcttctatgaacacctgctggtatcatttaaagacctatcactgcggtacacatcttcggatttgtggctttccctacttgtcattttattaattttagtatccatattcagaaataacgtggctgtggttcactgaaatagacacatcaatccacagcttgctctttttgtttatagctgctgcagtcttatttaaattcagtgcatccaatcacaaaaggtgttagaaagttttatttcaggcttgtgagagaaagtatagcagggtgtgattgaagtcttaagctgggtttatttctgctcccctgcagctaacagtctacaaaaaagtatgcaaaggaagccattgggagacaggagttggagcacacacccaacttgagaagccaaggcagagggaccaaaacttcaaggctggtctgaactacatagcaagaccccgtctcaaaatcccaaaagtagggctcgagagatggttcagtggttgagcctgggctgctctttcagaggatctgagtttggagcccagcacctttctgctactctacctccaggggatccgatgcctacgcgggcaaacagacacctagaaataaaatcaatcctttgttttaatccaaaagtaagcctgaagtggcaatacatgcctttaatcccagcactcaggaagcagaagtggacagatctcagtgagtttgaggccaatctggtctacacagggttccagccagccaagactacatagtgagactctgtctttaaaggtttaaacgagtgtgggaaatcaatggttggaaaagcaccgtcacgtctcagccatgtgaggacacccctgctgatgtgcttcctcaccatgatgccactcaagaccttgcactgtagcactgtacaatttaaaacaccagcgtctctgccgacgtgggcagccctgtgttcttgcaaatgctaaacaggaaattccagtgttttgtctgagaatctttatgtttctatgtgtgtgctcacacatacatacatgcacataagtgcccacagtggccaacaaaaggggcacacacacacaggtaccgtgagatctcctggagctggagtaacaggcaggagagagccacccaacatggattctgggaatcaagctcaggtcctctggaagactggtccactgggttaagtgttgagtacatactcaagtcccatctgagaatttaatagtccgtatgtttgtgtgttcgtttgtttaagtttgtgacaagagccaggaaagaatagagggtcctgatgggacagtggctgtgagttgcatctgaagcatggggtgggttatgtctgatctccaaaaagctacactgacagtgagcatgttccctcagcctggacaagagaacagtcttggcacatacaaggggatgtggttgttgagtgtgtagaaaccacattctaggagttggaggccagcctggtgtacacagagagttctagcccagcctgggctccatagtgagaccctgtctttagaagaaaaaaaaaaaagtgtgggaaatcagtccttggaacagcatcttcagatcctctagggactctaacaccctgtgctggcctccacgtgtgcatgcacatacacacattcacacatacacaccacacacacacacacacacacacacacacacacacacacacactcacattcccttccagtctgtgtgtggctctcagggatgtcagtgtaacctaggaagaagctatttcttcagagggaactggtgctcaacagccagaagcctgaggtccagccacccacctgttggtgcagaacagtggcttgcaggctgggaatactatcccactttctacccagtggcctagtgatcaagtgggaaatggcaaagggaggaaaagaaccaaatcaggccgggcggtggtggtgcacgcctttaatcccagcacttgggaggcagaggcaggtggatttctaagttcaaggccagcctggtctacagagtgagttccgggacagccagggctatacagagaaaccctgtctcgaaaaaccaagagagagagagagagagagagagagagagagagagagagagagagagaaccaagtcaggggctggagaggaggcttgcctgcctttcctgaggacctaggttcagttcccaggacccacatggtttctcataagcatctgtaattccagtttcagtggatccaaccttcctcttgctatatatatatatatgttagtatatatatattaaaaataaagtcctatttaaaaaaaactagccctgggtttagctatcatctattgatgtcacacttaaaagaataaatgtgaggggaggacaggaggcttaagagatagctcagcagttaagagcacttgctgctctggtctcagcacccatattgggcagctctgtaactctagttccaggggaacccaatgccctctgctgaccgccacagtcactggcatgtacttgcaacacacatacaggcaaaacacatgaataaatcttcaaaaaagaagagacta

SEQ ID NO: 1538 - DNA, 2940 bp, Mus musculus
atggtggaataccaggatgaagacgtaaacaacgtctacccctcctcctacgacaaactaagctatgctccttgtacaaggattctcagtgggacaaggaacaggtacaaggagagacctgatgccccagtactaccagaaccaagcgctcagcctgtgaccctcaggggcaaccagtgtgaagccgggaatatggaagaaagcagcagcattgccatgttggtgcaagagattggagaaccggaggctgtgttaactgctgaaggagtcctcagcccttcctcagaagttgaccaacaaagaaaagctaaagcagatccattggtccacgttatccagaagctaagcaagatagtggggcatgagaagtcacaaaaatgtctactgattgggaaaaagcgcccacgtccaagtgagacagcaaactctcttgaaaagctagagaactgtgagattccagctaaagccactgagtcccctgctgctggggttaggaaaaccgagatgtcacaggcaagttccactcttgcttcaaatgatgggaaggctatgtcctaccagtgtagcctttgtaagttcctgtcaccatccttttctgtgctgaaagagcacgtcaagcagcatgggcagcagcatgacgtgatgctcatgtgctcggagtgccacgccacctccaggagccagcaggagctcgaagcgcacgtggtgagtgagcacgagaacagtgccagtagccaggcccggtccagcccctccggtcagggagccacagaaagaaagagtgagaccatggtagacatcccagtgaacatgggcagtccacagacccatgctgtccagagtgcagccatggcagagtcgggtcggaggaagtggtatgcatatgaacagtatggcatgtaccggtgcttattctgtagctacacctgcggccagcagcggatgttaaagacacatgcttggaaacatgcaggggaagttaactgctcctacccaatctttgagaatgaaaatgagccccttggccttctggcttcttctatgtctgctgcacctggtggggttgatgcagttgtcattgctattggggacagcgagctgagcatccacaatgggccatctgtacaagtacagatttgcagctctgacccaccgtcttcatctcctttagaacaaagcacagaggagggagtacatctaaaccaggcagtcacgctggacgctaacgaggaagaaatgctggaggtgatgtctgattccgaggagaatctctttgctgatagtttgctatcttcagcacagaaaatcattagcagtagcccaaacaaaaaaggtcacgtgaatgtcattgtggaacgtttgccaagtgctgaagaaaccctcccaccaaaacatttcctcattaatgccgaaatggaagaggggaagagcccgagcccctccgaagcccagactgggtgtgtaggagcaggaaatatgtaccatgctgataaatgtactgttgatattggggggttgatcatcggctggagcagtgcagagaagaaagacagtgagctaagtaagggcctggctcctgatgagaatgccccaccaggacggagaaggacaaattctgagtctctcaggctgcactccttagctgcagaagcccttgtcaccatgccgataagagctgctgaactaacaagagccagccttgggcactatggggacataaaccttttagatccagacactggacaaaggcaggtcagtggtccattggcaacatactcaaaaaaaatcatgtctcctcttaagaattctacagatggagtaacaagttttaaccaaagcaattccactgtggtagctctcccagagggaaggcaggaattgtcagatgggcaagttaagacaggcatcagtatgtcccttcttaccgtaatagaaaaactgagagaaaggacagaccagaatgcatcagatgatgacattttgaaagagttgcaggacaatgcccagtgtcagcccaacagcgatgggagtttgttggggtccaacgtggtggagtacatcccagatgccgagcggccctaccgatgccgcctgtgcaactactcaagtggcaacaggggctacatcaagcagcacctgcgtgtccatcggcagaggcagccttaccagtgtcctatctgtgagcacatagctgagaacagcaaagacttggaaagccacatgatcaaccactgtaaaaccagaatacaccaatgtaagcagtgcaaagaatctttccattacaagggaacaagccttcaacccagaaacagtataggtgtgatgtgtgtgattacacaagtacaacgtacgtcggcgtcaggaaccacagacgagtccataactcagataagccatacagtgtatgccctgtgctgccccacgggttttgcactcgaatactttgtctccattggtatagtctgcaaatctctcggctggtgctccttgtgtgggtatgtgtgcagccaccccccttccttgaagtcacacatgtggaaacatgcaagtgaccagaactacaactacgagcaagttaacaaggccatcaatgatgcaatctcacaaagcgccagtgaagagagaactggccctaccacaggcagtccagaaaacttggtgtcgtcctcagagctcacttcccagctgcccggtgaagttatggacgccagcgagcttgagaaactgaaccccacaggctgcagctctgacgtctcaggaagaagctgcagcctggccgcaccaggcaccgagtactgcgtgttgctcttctgctgctgcatctgcggctttgagtcaaccagcaaggagagcctcctggatcacatgaaggaacatgagggggagatcgtcagcatcatcctgaacaaggaccacagcacagccctgaatgccaactag

SEQ ID NO: 1539 - protein, 979 aa, Mus musculus
MVEYQDEDVNNVYPSSYDKLSYAPCTRILSGTRNRYKERPDAPVLPEPSAQPVTLRGNQCEAGNMEESSSIAMLVQEIGEPEAVLTAEGVLSPSSEVDQQRKAKADPLVHVIQKLSKIVGHEKSQKCLLIGKKRPRPSETANSLEKLENCEIPAKATESPAAGVRKTEMSQASSTLASNDGKAMSYQCSLCKFLSPSFSVLKEHVKQHGQQHDVMLMCSECHATSRSQQELEAHVVSEHENSASSQARSSPSGQGATERKSETMVDIPVNMGSPQTHAVQSAAMAESGRRKWYAYEQYGMYRCLFCSYTCGQQRMLKTHAWKHAGEVNCSYPIFENENEPLGLLASSMSAAPGGVDAVVIAIGDSELSIHNGPSVQVQICSSDPPSSSPLEQSTEEGVHLNQAVTLDANEEEMLEVMSDSEENLFADSLLSSAQKIISSSPNKKGHVNVIVERLPSAEETLPPKHFLINAEMEEGKSPSPSEAQTGCVGAGNMYHADKCTVDIGGLIIGWSSAEKKDSELSKGLAPDENAPPGRRRTNSESLRLHSLAAEALVTMPIRAAELTRASLGHYGDINLLDPDTGQRQVSGPLATYSKKIMSPLKNSTDGVTSFNQSNSTVVALPEGRQELSDGQVKTGISMSLLTVIEKLRERTDQNASDDDILKELQDNAQCQPNSDGSLLGSNVVEYIPDAERPYRCRLCNYSSGNRGYIKQHLRVHRQRQPYQCPICEHIAENSKDLESHMINHCKTRIHQCKQCKESFHYKGTSLQPRNSIGVMCVITQVQRTSASGTTDESITQISHTVYALCCPTGFALEYFVSIGIVCKSLGWCSLCGYVCSHPPSLKSHMWKHASDQNYNYEQVNKAINDAISQSASEERTGPTTGSPENLVSSSELTSQLPGEVMDASELEKLNPTGCSSDVSGRSCSLAAPGTEYCVLLFCCCICGFESTSKESLLDHMKEHEGEIVSIILNKDHSTALNAN

SEQ ID NO: 1540 - DNA, 34161 bp, Homo sapiens
tgtgtactgcctttcaagttaccctcattcccatctaagcaccagtggaacacacacacacacacacacacacacacacacacacccttccccacccacacacacacgactgtactcagaggagcttaatcaacactgttagttgactgacttactgacaacagaccaaaggctgcctctgagactgatggtcaaagccatgaaggcaagagatgtatttagtctccatttaaaagaatctgattcggctgagctcagtggctcatgcctgtaatcccaacaatttgagaggccaaggagggcagatcacctgaggttaggagttcaagactggccaacattgtaaaagcctgtctccactaatataaaaatcagccgggcatggtgacaggccctgttattcccagctacttaggaggctgaagcagaagaatcacttgaacccaggaggcaaaggttgcagtgagctgagatcatgccactgcactccagcctgggcaacggagcaagattctgtctcaaaaaaaataaaaatgaaatgaaagaatctgataaaaatataagggagccaggcatggtggctcatacctgtaatcccagcactttgggagaccgagtcagaaggagtgcttgaaatcaggagtttgagaccagggtgggcaacatagcaagacccccatctctaccaaaaaaaaaaaaaattaattagccaggtgcagtagcatgcacctgtagtcctggctactctggaggctgaggtgggagggtcacttgagtccaggagttggaggctcagctaggagtcagtaggtaggatcaggccattgcattccagcctgggccacagagagagaccctgtgtcaaaaaaacaaaacaaaacaaacaaccataggggagagatgaaatgaaccgccaaagacttgctccaccggctcttcaaaggatgggaaaaaccaaaagcggctagaacctgaggccccagcccctctccgtgcaggaaagttggttctgtcactcatgggaagagtggacctggattaaacaggaaagctgagaaggatgccacatccctggttaaaaggtcagggggaaaatgagtatatcaagcaaactgagaggtgttgcaatttcagaagcaaagtaattttcttagatgacagcataagccactttcagctttttcttttctttgatccatcagcgttgccctggccaccaaccaagttcacacagtccaagcagacattctggattgcatcaacatgttagcactcttcgttttcaaaatgtagaccatatatagctaagattaaacctgtagcaaccagcccctagatgtcattgttgctgctgaaatatcaactcttgagtcttggaatttttacatctgaagagatagcagtgttcatctgaataagccccttaaataatgcaaattcaattcactttcggtttttcaaagccaagtccaaagtcttctggacttcttaaccaaaatgcaactaaatcttagggtgttagcacacattcagttgccaacaaaatccgcattcaggaaaaataggctgaaaaacccacgtagtcgtatgtgacattcctaacgtgctcacatcaaattccacgacataagctgattatggagtcgctgggcgattctgcccttcttcttttcgtgtgttgtctgacttctgtgcctgcctctgtcatcggtgtctggagctcagagccgtctgtgccttgcgaacagcagcttccaatcaagggcgcgtggaagagcagaagcgcccaccctgtttccaacaagccattgaatgcgacatattctttgttcacagtgtccttcaactccatctcttccttccatttcatatcattccagtcccagtctttgcaagaacaatactttattgtttactgattgctttctatgagtcagacacacattcggttctttaaacttttcaatggccctgtaaggtaggtatgaagtaactgaggcacagagaggtacagtaacttgcccaggacacacagctagtgagtgctaacaggttttgaagcacagggtcaatgaaaaccggtccacagactagattcttagggcctctctgtggccaactcccttgtctctaactggatgccacgtttattctctttccaagcctccggccctcaatctcacaccctatcttcccaaaagatgcttttgagtagctcctccaataaactttatgcttgggagcatgtctgctaaatgaaatcacttttttcttcgatcattcagtgtttactgaatgtagctacattttaggccctgttctaggccggaagggcaggagagatattgatgaacaaaactgacaagctcccctgggctcttgaagctcatttcccaccagggtagacacgtgttgaggcagtgattacacatggaattaatgacaagagagtgaagtccacaaagacgcaggaaatcacacaagcagagcgcccgacatgggccctccaacagaaggccctcaacagaggcctgctgcctgtctctgcctggcccagtcccagccccaatctgcctttctggccagagctcttcctgctccccatactgagtcctccaaccccagcagaggggtctccacgatccagatagatgccctgtgtccgtgtgcacctccctgctccattcaggttggtccattttcttccacgtgccaaggtgacccattcttgaacttaggtagctcagattctgctttcccattacctggtcctagggatgtccctgcaggtggcctagagatatgagtggaaggaggaggcctgatgcaagagggatggacatggcagcctgaccacctaatcatgaagcttcatgcaccccacagctccactcatgcctaattctggatgcaccacttatatctggcgacagatttctactgggccttcctgccttctggccttgtggagctgaagatgaggccagaaggggcatgcaatttgctatttgcagtgtggatgatacggtttggctctgtgtccccacccaaatctcatctcaaattgtaatccccatatgtcgggagggtcctggtgggggtgattaaatcatgtgggcggacgtctcccttgctgttctcatgatagtgagtgagttctcatgagatctggttgtttgaagtttgtggtacttccccccttactctgtctctctcctgctccaaccatggtaagatatgcttgtttcctcttgcctgatgccatgattgtaagtctccggaggcctttcagtcacgcttcctcttaagcctgcagaactgtgagtcaattaaacctcttttcttcataaattacccagtctcaggtagctctttagagcagtgtgagaacggactaatatagtgaactttctctgggtacgatatgcattttttcctttcctttatcactcatgtctctttctcagtgaaagaaacatcccaggctgggcatggtggctcacgcctgtaatcccagcactttgggaggccaagatgggtggatcacttgaggtcaggagttcaagaccagcctgggcaacatggtaaaaccccatctctactaaaaatacaaaaattagccaggcatggtgacatatgcctgtattcccagctactcgggaggctgaggcaggagaatcgttggaacccaggaggcagaggttgcagtgagctgagattgcaccactgcactccagcctgggtgacagagcgagagtgtcagtgtcaaaaaataaaaattaattaattaattaattaattaaataaacatcccagaaggtcaaatactataccatgttccctctgcttggtcttccccagtatacgaagagctcaagctgggaatcttagaagatagactccttgcaatctgcagttatccatttactgatgtcttaagcaagaagtagaactcccagccagtcggtgatgatgccagcagctcctcctagtctatcacctcaaaaggagctgtcaaaataacaaatgacatatttttaagttgcaggattaccccttagctgggctttcttggtttgattagcagttacttttccttttagtgtctttcttcatcttctcctccttcttcttttcattttcttcctctgctccactcatcaataaaggccactgttttcaggaaactgcttccctaggaagaattgaacagtatactattacaatcatattgtcttgttcagaagcaggtggtattacctgtcaacaggggtttggggcagagcaaatagctcccacccagctcggtgaagccactccctggctcctgggtagagaaaaatggccaaagaagagagctctttggaggcctcaaaatctcattttcattccctttgcagagaagagactgactttattgacaaagacgactgaaaattgcttgagcgttccaataaccagtctgcgttgaggcagaaagacagtctggcggaggcaagctccctgctccaccgctagctccgccgagccacgctttcctgcagcaccagtctgtggcatatgcagactagactgaaaggagcctcctgtcggcctcaaaagcagcccccctccacctccactcccagcctgctggtgcgtttcctggatcccaatcacaaatcaacacgaatgcagggaatctctgccagacaccaaactcttaggctgattcaggagcttggggtcaggcctaagttggcttggaccaggcacaggtcccattttccactggagtgccctgtggcttggctgcacattgcgcgtgggccactagatgtcaccattattgattcttgtccttatacccaggtcctgagtctaagacagggtctcagggctaggagaactctggagagaattccatcgcagcgttgactgcagggctgctatatttgctatgtctgagttcctcggtgggccttttctaaataagttagcatctcagccccaaaacagctgagctgcaaattaagcaaagaccagtattagccagagccaaccctgattttcacaatcacgtcccctgccctttctcctcctcttcatcgtcagggttggtcattatgcatccttctggtttacttgggccctcaataagaaataaattaatatgtatgcctcatagcaccaaggattttagatgttgatgtgctgttgaagaaacataggtctgtggcttttagcagagaatgaatgacagagggataatttatgatggtccttgagacctgaactacaattatgaagtatttctaggtgtatattcaggatgcaaagtgcaaggaacccagagctaatgttaatttattactgacagctgtatatataataatatatcacgtcttttcatcttacattccttctgacttacatcaagcaatcttttcattcattaataaaatcaagtcttgccattattcttaatgatgaagtcccatcttgaacccagaggactcctatcattaaactccgtgcttctatataccagtcatctgaagctcaaaaaaaaggataaattgaacttcttgttttacaagcaaggtgaaaacatcggaaagatagagcccacttgctcacagtcccacaagggctaagtagcaaagtcagggacaatttcggggtttatttttctcagctcgcactaccacatccttttttgccttttagctctcttgcctcctctcacctttctacaatctctccttttttgaggcagtattttttttttttttttttttttttttgagacggagtctcgctctgtcgcccaggctggagtgcagtggcgggatctcggctcactgcaagctccgcctcctgggttcacgccatgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccgaggcagtatattttttaaaggtcatgataaaaattacaccttaaagaaatacgggccacacgtctcgtccaattttcggttctgtgccaaagacttacatgattaatcccttcaaaacaaatctaatctaatcttatcacaccaaagacaaggtgtccttcataagtattgtggctggaaacaagtaggtcttcctccagtttcaactcgttcaatgtctcattcagtttacaaccagtcatcaccttggcaacttactcgaggcactgtcttcagcgttcccaaaacgtaagtagtgctccagttcagcttgtaaaatcatcaaactccgtggtcactttaggagatacagagacccatgatacttgtagataaagcgaaacctttagcctcatcgactaattaatggcctcaaagtaaaataatgaggtgtgtggagatagggattcagttactgggtcatctctcatctggagacacaatcagattccactgaataggcgctagataactgaataagcgagtttcctatctataatactaaatcttactaggattgtttaattaaatcatgataaataacactctgtggcaggtgagaggtgctgagaagagcttaggtgagatgtccacaagttcaatggaactacatctgaatgcctttgcattcttctgacttaaaaatgttgactgtaactttccagagagttcttttctaggaaagagaaatactgaggtgctgtgtcccaggctttttgaagttgtcttggttttcctatcagattctgcattgtatactttctcagtcttcaggaatgaaggtcctaattccttcattatcattcctttctgcctataatgatttcttcctaatggctctggctgttccaggtacatcagagtagggagtgggtatcagtggctgtgtcatgctacagtaacaagcagatttctcaaagaactaacattagaactaccattccacccaacaatcccactactgggtgtatacccaaaggaagataaatcattttaccgaaaagacacctgcactcatatatttactgaagcactattcacaattgcaaagacatggaatcaactgaagtgccatcaatggtagactgcataaagaaaatgcggtacatatacagcaaggaatactatgcagccataaaaaagaacaaaatcatgtcccttgcagcaacatggatgcagctagaggccattatcctaagcaaattaacacagaaacagaaagcccaatactgcatgttctcacttataagtgagagctaaacatggggtatacatggacataaagaagggaacaatgaacactgcagatcccaaaaagggagaggcagggaggggggcaaggtttgaaaaactacctatagggtacaatgttcactatttgggtgagggaatcaatggaagcccatacctcagcatcatctaatataccatgtaacaaatctgcacatggacctccctaatctaaaattgaaggaaaaaaaaggccaggtgcggtggttcatgcctgtaatcccagcaatttgggaggccaaggtgggtggatcatctgaggtcgggagttcgagatcagcctggctgacatggtgaaaccccatctactaaaaatacaaaaacaagccgggcgtggtgatatgtgcctgtaatcccagctactctggaggctgaggcaggagaatggcttgaacccagcaggtggaggttgcagtgtgccggaatcgcaccattgtactccacccgtggcgacagggtgagactctgtctcaaaaaaacaacaacaaaaaatcagctccaaaatcatcagagacttgctcaccctacatatccaccaccatgggtcagctggggactcagctcatcattgtccctctaagatgctggctgacgggatggccgccacctgaaacactgccagtcatcaagccaaagggaaacatactctggagggaactgcactggcaattaaatgctccagtatgaagggaatgccctcactcccacacacgatccattagccaacaccagtactggccacacccccgagccacagggtcaatggaaactaaccttatgccagaagagggacaatgggaactagctggtgaataccagtaatgaccaccacaggaacttcaaacgaagatacactttcgttcgcttgttttaaaagttctttattatccctagattatattttctctattgtgtttctgcactctcccttgatcaaataattctgtcatttcgtctgtctactttcagattcatggacattacacttaagacatgactaacgaaaagcctctcttcagataatgataagttaggattgtttgtgccaatagcccaaggcaaggaatttctcatattacttgtttgttctccctttcaacacttcgtatttctgggttttcttcactgttttttctttccacccttccatgctagtctcctgctcaatctcttaccttttatcgaaaaaaaaattactcaacattttattttttcacagctatttggtctaattggcaaaggattctgtggaatagcagaattctaactttgcagccgggcgcggtggctcacgccggtaaccccagcactttgggaggctgaggcgggcggatcatgatgtcaagagatcgagaccatcctggccaacatggtgaaaccccgtctctactaaaaatacaaaaaaattagctgggcatggtggcacgccctgtagtgccagctactcgggaggctgaggcaggagaatcacttgaacctgggaggtggaggttgcagtgagccgagattgcgcccctgcactccagcctggggagagagtgagactctgactcaaaaaaataaaataaaaataaaaataaaaattctaactttgctggtttcctaacccccaaattcagatgaatttgaattctgaaatacagtaacaggaattatcagcctgtctgattctaaattttgttggatcttcctcccaggaccgtggacagcccagccagctgtaaaggcctctaaaaagatctggaacagatccccaagaggtatctcaccaaatgagtccattccactacaatggccagaatcttcagttttacacccttgctcatgcccaccgctcacccggagtccagacccaagcaccatgctgcgtagttcctaatacggcaaaactatccagcatttttggtgaaattggctggaatgcttcacttagtccgtttttcactgttagcaggagaaccaccctagtatctttcataaaacagatccgaatgacaaacaccatcgtgccctcggagggctgagcttgtgttactgggtctggtcctacaaaccctgaaaatcctgaatctctcaagcaaagagattccccagggccagctctggcccttaacaggcaccccttaacgccaagctgcgaatctggctaggacctctatattttagccaagaacaccttgaaatgtacagtcctaccaaaggaactaatacaaatccagaagcacaaggctaaagaaaaaaaaaaaaaaaaccccaatgcccattgttgaaagccaattgcggggtgagtggggtgataaggctagcccacagcggatttaggcgacgtggggagatgccaaagtgaatacacggtgacttctaaatctagacgtctggaaggggccatgagagccagacaactgggcccgaaccccgcccgggagccagggtttgcaaggggctaaaccggctggggagcctccctctcgcgggtccagcctcggcggcccgggacgccggtaggcggggcctgagcctcgccccgcccccgctgcccgccattcgggtcacctgacccacccgcggctcacgtgatccgtccccagcgccgccattttggagctccggatgaggagggggaaaccgggggaaaagagggaaaagagccgggagagaggtgggcaaggacgagggcgagggcacggccgggtcctggctggccaaacgaggctcgcggaagcagcagccgccgcctgaccgcaggtaccgcgccccggggccgcccctccgcccgctgttagcgccgccgccggccatgtgcatcctcccctcaggcctctgccggcgctcgcttcctcctcagccggccgacccccgcccggtgctagccacaagccccaagttccgtgtcccggttctgtcttctgtgcagcaaggcctgcggagactctgggcttgccctgcagctgggggtggggggaacttgctgctccctgcatactgtcaccagcccggcccgcccgcaggcgttgcttccttctccaggcgttgcttctttctgcaaatgtgagatcgcttaggccagccgggatggacccagccacgatgttctcacagcatcttttgattaattttctaagctccctcattcccgacccatcacctcagtcctttagccagtgcgtggtgtagaaaaagctactacagaaacgcagccctggtcttctgcatttattaccatcctctggagatagaatgatgtctccagagatcacggagaccatcagggaaagttcccacctcttaagacctgggggcatcggaatgaatggtttgtgtagaaggccgggatgattaataaggtggcggccactttcccaaccccaaggcggtatttttaagtttctgcagtgggctgtaatttgctatcagtctgcatcgctcttctcaggcaattactggatttatcacctctttgagtttgcactttctccagtactcccctctcactcagagtatgggttgcattattgattaaaagaaagcctggcccttcattcctttacctcactaactcgttgaaaattaacttcaggggagccctaaagatgttttttctgccctggcagtgagctattttacttaaccgtaatcgataaggtagttgcattctaggtgaaacgaataagcatttttttatcttttagatttattccagccagtataagaaacagtggcaaagaaatgtaggaccagagtaggaaactgcgttagaagatatataggtcacaccactgtgtcatatctttttatgctgtttttctgcctattgtgcttggttgcagaatcactcgttagattgtatttttagtttagattaaaatagcaatgtgcaatttattgttccattctcattagaaaatgttgtcagtaaaaccaatagtgttgagtccagtacctaaattctgaggtaaaacaaaatacacaattattgggagaagtttccagagctattttttcctaacttctgcaaaatcctcaagtcggcttgttagataaattatttaaatttgcattacgtaatagggttgcatgaacattcctctgaatttctttttacatggaatattgagaaatttttcactgccaaaaaaaaaatcattactttgtttcaccaagaaagagaaatgttttgatactatatactttcgttcttggccacagctggattttgaagattgatccaagggactgtattaatttcaggaattgatttgaaagacactggctctgccacttaacagccatgtaaccttgggtaagtcacttaaaccacactgagtgtttccttatttataagactgtataacacccacctagcctgtcctaaagagttatgaggatcagataccactaacatgtttgatagagcctagctgtaaggagctgttactcttttcagtattgatattttgtacatttttattctcattgagaattaagatgaaaattggtgtattagagaaagcatggttttagagtgagattggcctggattcctgttcttaaaccagttaccactttgtgtctgtgagtctcaggtttctcatctgcaaaaaaaaaaaaaatacacaaaatttgaatattacacaaaatctacagaggcattactccctagacttgcacctcatgggcaaggatttcctcagtcatttttgtagtccccagcattctggttggcacattataggtgctcaataaatgacagtaaatctgaatattggttaatgttagttagaccttatgtcttcattgcagctgccaaattagaatattctctcaggctatgtgccaactaagaaactctagactatgaaactccatatacttgtgatatttatactcatttttttcttagtggtaattaataattaccttgggctcagaagattttaaatcaaataaattgtagccaatatagtgaggtaaatctataaataatgtgtaagcagtttccaggtaactttatagacagtttataattcagggacctgaaagttcatctagcttcaccctcttgttttacatctgagcaatctaaaactcacagagacagtgacttgcctaaggtcacacagctaattgagggcactttaggggagggacccttgagcttatgtcccctgccttcttttggctggagcaaaataaatttgtcatattttagaattacaataatctggaagaatggggaatttattggccattacttttatagcacaattttttttttttcccattttggaaaaaacaaattcttgttctgaaagagaaggttcttttgtatcatattgtacttttcttcatataaacacagaaaattacagccttttctccaggcccacatgaattgttcaacttgattttactcatgatgaccatactactgtaattataaagaactaattagatacccaaataaccaaatagcaaattataaggaaataaagacaactgaaataatttggctcctaactttttgtgagaaagatattaattagaagcatttgcctgtggaatactgttgtcaaggaaagatttgagagagttggtggaaagggttatagaacttttctggtttgggatacaacttttgtttattacttatttattggtaacaatttaatatatttaatgttgttatgtctaaacattacaaacaagaaatctcctgttttgctaatgcctgtcgtcttctttcctcctggtgaactttcctattcagccatatcgatcttttcactcacccccagatagcatgcttattcttacttctaaaaatatagtcatgtcatggctgcttttctggtcactgctacccttgtgtcaacttgtatcagcagtattccaaggaagcaaatggcacgttgaaatgaggataattcaaggaaggtatatttacaaagatattagtaataaaggtgttggacttcaataagcaaaccacagcataatgcagttatctggagctagcagcattaggagagggagaggcatcagaatcagaagaagggtcttggagagcagcctacctggaaagaaatagccttctattgaggaacacagccaatccaaggtgacctagaggtagagaaccaggacgatgaatattctgatctcactctgctacctccctctgatctgtcatggttcttcattggctgacctcaaccagaaggcagaggacaggggagcctagtgatgtaatccctctgacagagagcagaatggaaaggaggatacagtgagcctagagggcaaatggatgatgtctggcatgctgcccatcctttgggaaccagtggacatcttacctctccatgaagcttttgcttaccttgctagcccaaaagagctcttcagtatctttcaggatttagtcattgactgttgccttttattttaccttgtgtaccattgcgttgtttaaatgctgttactttttaacttccaaatgtttgccttatccactcaactcagttttaaactgcaagtattaagaatttaaaatttttcctgatactttgccttgcgccttgcacataacaatttgtttgttacacacacacacatatttgtatttctgcattagtggtctaaataaaatttctgtgattttaaggaatcaagaaagttgaaggattggccttaaggtaacttcccctctgtgtatactttattatgatctgtttagcctttttattatgaaaaatgttaaacatttacataagtagaaagaacagtgaattcctaggtactcatcatgcaacttcaattacagaattagtcattctttctttattctcatcctatccaccccaccactgcagtatcaccaaggtaattgttttaaagctgtgcttacactgatctcttggaggccaaggagagtatgcagattgtcatagtttatgttgtcatcactattgagccactgacattgtatgtatactccttatttcatctcttttgttcagatttgcttcacttgacacacaatctcatatatatgtatttctgcattagtggtctaagtaacatttttgtgaaaattgaaagagttggccttacagtaacttcccctctgtgtatactttattatcagctgtttatctaacctttttttttttttttaacagagacttgtttttatgagattaacctgtgcattgattttgcatggggacccaaactggtttttcaggtgtttcctgacgtatttcatgttgtcatatctgttttatagctgccattactgtacttatccccaaatgtatgcagcctttaaaatgagatacttacataaatgttcagggaaaattggagcatctgctgcaaatttccattagctcttaatgcctgagccgacacagctttaaaaatctgaatgttttgtcagattcttttgtattagtctttttcttgagttaagatgaactcctccttctcttcatttcactttctttttaaggtacacactgaaatatccacagggagcaatttgcactggtctgtgtcacttctcttattaagtagaagaaagataacatgagtcacctttgtaaccctacgggtgtgcaaagtctcttgagcaaacattcacttgttaacctccagatgatcagtcagcctacatgggtgttacatttcatggggaaggagaccttagatctacagcagagagccgtatcgtgttcaggaggattcctattattaaacttattatttaatcaatttgcatttaaccattgaactgacagacataaggccttaagttaatcaccttaaagggaaatcagtagtcacatgaagagccacagctcctcttggcctaaaaatgtggaattctaagacaataaagtgacttaggaagtcacaaaagggtttttctaaggaaacaaattgttcccccattggtctcctctttaatgacttacagctgagcgtagagatctaaaaagacttttgttccttctacctgagaaagatgaaacagaactagtcttttgagagattgtttaagggagagtggctgaaggaccacgggcctttgggagccagggtagctgtcattgttggaatggccatggaatgcatgtgagggcagttagagacagctagtagccaagagaaaaaaagctgatgccatagggcagagtattattaggaagaagggaagaaatagtactgaagaagccaagagtaaagtgtttgcatttttgcctgatgtggacctagatctagaaagctggcttgccagaaggagtagaaaatcaggaagaaaagccatagttgctgcccagagttgtgggcgacctggcactgaagctggtcagctgtgtgtgtgtgtgtgtgtgtgtgtgtgtgtgtgtgtgtgtgtgtgtgtgtggcgtgggggggcggggcctgtttttgtgtttgtgtatatgtgtgtgtgtgtggcgtgggggcgggggggggggcggggcctggcaggacattaggtatcatcttggcaggggctgaagggcccttatatgttgattcaaccatgcggggaagaacagccatgattcaccacctaaaataagaattcagagcctgggactgaagtttaagaatagtgtggtctttggtctatagctagtgccactaaaaattttgttggcatttattgaatgttgtgagtaagattccagaatgcacctaaaatgtggaaaaacaaaacttgttgctggaaaaaagcctaaacttaaaaatgtgatccaagtcaacaaattaatctcactttaagccaaaggaaatgtttgaaatgaaagtactgccaggaaatagaaagagtattctagacttaggcagaaagatttatgggtattttatgtttagtgacttcctcagccataatgcattattagaacgaacaaataacctcttctaaggactctgttcatatctggaactgaaacacaactgggatatcaattttttccttctctgatgtcccttaccctttcagggaaaaaaaaaaaaaccatatatgtggatatgagtaatagttgaccactaatatgacctctaaaaaaaaaccacagcatagtttgtggtttatcttcaggaagataaaggaagtaaaagtaggaactagattattgcttttatttaatttcatttatatagtactttcccaaattcaatatgccctgtacaaactacatgactatagtttcacaatttcaaagatttggggagaaaaaaaacaaatttgtgattttagtaataaaactgcagctatatttggtataagaaatactctcaagaattgtatcagtcattggctttacagagtgatgtttcacagtaactggaggggtttcacatgccttgagaatggctgtgctcctttaatcaaggaataggagtctttttttttttttcttggcattgtgcaaaagggagggagtacttttggtcctgctggatgctgaaggcaaagaaagtgaagaaaaatggagaaaaagatcatcatttccgaagaaataagtgatagaggggagtatcttcatcattagtcttgatagaagattgcattgtaaagagaaattctaaccaatttaaatctatactggggatcgccgggtgtgtggacatggagcttccagcttagaaaatacttagatgagattacagacactaacattctcttatattttccaaattacatgcctgtaattatcctgtaacctggtatttttctgttttacattatcctttttagatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataaggtaagcattggttcaggaagtctttcagaggaccttcgcatcttagagtgagaagggaactttgtagatctaatccaatcacctcattttatagataaggaaactgggtcccagaaaagtttgataagttgcccaaggggatcccaacttaccagtattaaagttgggactgttcagaatttctgctgtagaatccttttccctgcctgctgcctccttgacagcctctgtgttttagtgtgtatagtttaaagtgttgattttctgttgcaagagaattgtagggagtgtatagtggattgacatacgtttgacttaacgtattgacatacgtttgacttaaacaaatttaaccgtacatcatcacaacaaaaaaatacatatttttcatcttatatggccccagaatgccaggcattcagttcagcttctacataaccaacagtgatgtgtatcattgcagaaggaaaaatgggctatggcggacctattaaaaggtactgtcatggaaatagagccatgtgtgtcatgttttatgggcagggtaaagaactttcaagagttattttgactgtctgatttttatcttaagtgctgaccttatcaaaaccaatatcctgtatgaagtgctattcttttataaaggaaacgttgaatcattggtttagaacttttcttcagtgggccaggtgactccttgaaaatgtattacaaatgttatcctaagggctaactaggaggtagactttttccctcagattaccgagagctggggtctagctgtggtaaaaaggtcacaggagggaggccgaggcgggcagatcatgaggtcaggagattgagaccatcctggctaacactgtgaaaccctgtctgctaaaaatacaaaaacttagctgggtatggtggtgggcacctgtagtcccagctactcgggaggctaaggaaggagaatggcctgaacctgggaggcggagcttgcagtgagccaagatcatgccgctgcactccagcctgggcaacagagcgagactccatctcaaaaaaaaaggtaacaggaataagaaagcccttgagtctgaggttcactgcttctcagattacactcatgaaattccaagtaggatgtccacataggctgcaaagacaagttcctgaagtctccaggagtttcttttgctactgagctcttgattcatgggaatggaagtagaggagacaggatgtccttggaggagcacttccagttagatctcttacacatttagatatttcaatgaaaaattaggagtctggtgattactgattggatttttttttgtgaagttgcattattctgaacactctgctcgttcctcctctgggcctaccagtgtttcagtaaatacggacacgccctgtgtaatcacctaagaaaatggtgacttcctttcagagaatatgaagaggaactgtccgttgaatgtgattatgatttgctaatgtacttctttctataaattgtcaaatgtgtcaaatgatcctttagcagacttgattttaaaatatggtaattcgttgtactaggccatgaaagcaatgaacctgttcttctacagcctcctaagagttggacatgtatatttattgaaaattacatatttctttccactttttagagtcaattgaggaaccatgagagagaacagcacagtcttccagataccttgtcaatagcaacttctaatgagccaagaatttccagtgatacagctgatggaaaatgtgtccaggaaggtatctatgtattttgttatgcaggctgcagtgacttgcacatgacataaaagtgcccttagttgtcatggttggttattttcagggcaaaagcctatattctcctccatttttgtaccatggatgtgagtgaatctgatctctgtttctgaggaaatgccaagtactgaatgaagcagatgattactaggtcctaggtgagaagccctagatagtaaggattcatcttcagttgaaacttaagagccccttagaaggtgatgtaccagcaagccagaaaagcaagccagaaaagctacaacatggaaaacaggcctcccctccctctctcggcaccagttgacctactgagaacagagcttttgcagatggtaggcccccaccccaaactttaactggggctccccgctgtgatcttattcttacccaagtatgactgccagatttcatctgcattattaaaaaaaaaaaagcacacacacagacacacaagatctttttatgtactagttaagtagcagtcaaccgagtttctggtaataagaatattagaatcaaaagatttaattagagctccatgaaaaggcggatgccacatccggagaattaaggataaagtgtactaagctgtgccgctttggttcagctcacttaaattgatatactttaaatgtctccagtgtggcacataatgtttatgggagataagacatattggggtgactttcccttttagatttgctaagaattaaagttagaaacgactacagagtgaaatgttttaccataatgtttcattaaattataccccagaaagcataactgattctagaatgcttctgaaagaactgattttgacaccactgtagcaccaaaattctcatgtcaaacagatgtcatccctgtaaaactctctgaaacaaaaggagtttatgatatagcatctgtttttgcagtagatggctgagctaaaacagttttgtttcctttttacaaaatagccctaaatgcctccttttattttaattcattatgtttccatatcccctttaaaggagacattaaaacgtctgatatgattggaccataaatccctaatgaaaggatgaagtaaatactactcagtagcaccacctgcagttaatatcagtgttggaagatgtcttttttagcaccgtcctaaaaagcaaacatttcaaactgtccaaatgagttaacattaaaattcacaattttaataaaaagattaaagtgtcagctcaaaattaaaataaccacttcagactttacagtattaatgaatgtttactagattttatgttgcagcatcttttctttgtggctcatgctttttttttagggttacatgcatggatttttaaattgcctgccatgcctcttttcctccacctggctccatttgcttttttctctcagtactgtagcagttcaaatggctgcatacttatacctggatgggtactttattaactcaatattagatattttgaaatctggttgtcaggccaaagaaaaaatttttagctcacaaataaggtaataataattcatgctttgttaaaacttctttacctatttagtaaacttgttaaacaagaagagagatttgtgcctctgtgatcctcagtctctgccattcagatagcacagataccttagggcatgtttcagcttaacatttgcttggccaaaaggcatggcctgcctgtcttgagctagatactgtgttaggtgctgggagtacagtgaaaggcatcactgcccttcaggaatccaactcagtgaagaagacagaacgaggctgatgggtatgtcagcagataccgcaggagctcaaatagagccgcaagcaaagccctttcgtatggtgttactccatgaaacctaattaaattgttttttattggaaacctataatttgccaagcgctggggattcagtctaaacaaaacaagcagatccttatcctcagggaatagacagcttagtggcagggcagagattttacccagacatgcaggtaaagtacagactttgctaaaggaaaaatataggacttattaaactatgctgtgaggttctagcatttccaatttgtagatgagaaaactgagacttcaagaggcaaaataatttacccatgatcatactggtagaaagtggcagagcgaggactaagcccaagtttttgaactttaaatccaatattctttccattggaaacagttgcttgaagtagcacaggctctcattctgtgctatattaagtttttccatctgtcagttttattagttgtcattgatctgtaatatttctcacacaaaaccattatccaatatttcacacttcattttttagggtttttttaaaactgtatttggaacagtgccatttataatcaagtccaagtttttaacctaccaattaagagcaatacttagattataattatgattagtgtgtatattaacgttatagatttataccaggaaattaggacattttgttctgcttggcagtagttattagcaaaagaaaatttcaattttagaaaccgtaaatttaacttaaggattttctttgttgaaatttcagtgtgggttttcctttgtataataccacggattttacttttatgcggtgtatacaggtgttctacctaagctttcttcctgccaagagacacacagttcttcctgctctgcctttttcatgagcttccatgcttgctttgtttctgaatataaagcagagtgtgaatagcctgtggactgtatgctgacagacaagtacatgaagcgttgaatatcttcaagaaatcgttttatatgatcaagtcactcaactcgtgttgacataagcttaccccaacttgaattactcagccctgttgttgcagagtgagtttagtaacatggctacttttcgttggatccatgtctcctgcgtttcggagagctgcatattcatgtcagtcataacctttgtccctgtaacctgtcagttaactagaaagaattatacattgcatagcacttaaaaatttgcggccgcttttcctttcttgttgcgttggtagctgacgtttagtggtaaacaaagaaaatgcactgggtgaaaaggccttaggctttttttttgtagggtgagagtgggggagagatctcttgctctgttgcccaggctggtctccagctcctggcctccggcagtcctcccacctcagcctcccagagtactaggattatgggcatgagccaccacacctagccaggctttttatattgagttggttatatatgcttcatagccacactttataatattggagtatagtattaaattacagcttgttgtcaagtcagtgtttctgtaagacagtatatccaatattggttagagtaacacctatttggtgatacagatcaacagggtgtctctgattaatttagctcctacatagccagaagcaagttcattatgacttagaatattgtacatggttatgcaggaatcatcccaacctatctgtgtttataggtcagatgatgttcagtttatatctgctgatagtgtatatgcaggaaaacctataaaaccacttcagacttgttaaaacagtgagaaagccgtgattgaaatattaatacaactgtgtggtataaattttcatttacaatggaatgtaaatgctgtcatttgaatcttgtcaaagcctgctactaaaactctgaaataccttgtctagggaataagtcttcagtccagaaacaatatagatgtgatgtgtgtgattatacaagtacaacatatgttggtgtcagaaaccacaggcgaatccataactctgataagccgtacaggtaagtgttatgattctagaattttaatgtttgtattaaaatattttatattaaagaaataaaatgaaataaaaatgtatagcacttactgaaacacaggttaagaagtaagaaattttcactaattggttttatattttgttgttttatatatttacttatttattttttgagtcagtgtcttgctgtattgcccaggctggagtgcagtggtatgatcacagctcactgcagcctcgaactcctggcctcaagggatcctcccacatcagcctcccaaagtgctgggattgcaggcgtgagccactgcacctggctggtattatgtcttgtttgatttgttaagatgtgaactttaagcttgaatcttaggacagtaggcattttgtctagttgatacataggaaattgtctttatctgtcaattttatgttttcatttcatatgggtataaatttcatagcaattttcaatgccttagagttcatttcagtaatttggcagtaaggtactcagtattcagcaaaagatccttaaaacttaaaggcaataaaattttctatgaaagagtccatttttcaaaattaagctagtatgtgtagaataagtcatttaatttcgttacttgatttttcccaaaagcaaattcagatatatatttcagaaaatataggcattctcagtgatagtgctaggcaatgcgcatgaactttcacccccttgtcaaaacttagcaggtttaactctctccccagattctgtagatatgatacaagtgagtgtgggaaagttattgtattaatctcaatgaaaacctgacagattgtgccataaaaggtcattgtttaatcccaaagtgtggtgatctgtgtatggtttcgaatatttaatatgtgcttaatttgcaaaccagcagacttacttataatcactcttcagaaagtacatctgtttgcagagtcttaaaactctgtggaaggtgtttgaccttgcctcagtcctcctcagtgtcttccttccttccttctttccttccttccttcttttcttccttccttcctttccttccttcctttccttcctttccttccttcctttcctttcttcctttccttcctttcctttccttcctttccttttcttccctccctccctctctccctccctccttccttcctttccttccttcgtttccttccttcctttcctttcttcctttcctttcttcctttccttccttcctttccttcctttcctttccctcccctccctccctccctccctccttccttccttccttccttcctttttttctttgacagagtctcgctctgtcatcacccaggctggagtgcagtggagtgatctcacctcacggcaacctccgcctcccgggttcaagtgattctcatgcctcagcctcccaagtagctgggaccacaggcatgtgccatgattagctaattagagacggggtttcgccaggtcttgaactcctggcctcaagtgtccgcccaccttggcctcccaaagtgctgggattacatggttacaccatgtccaatcagtctatttaataggtgggactgagtatatttacattcgtgatttatactgggaaatgtttaggagaatgtgatggaaacagggaacactagtttacctgataggaggagaaagctttgcctttatatttttggtatccttgaatttagacataccgtgccagattcatgtgatttaagtaagaagaaaataacatttctccgggtccagaattagattgttctttcattcatggagaaatatttattgagcaaatattatgcttcaggggccgtgctagattcttggactacagtcataacaaaacagacgtcatctttgctgtcatggaacttgtagacaaacaataagcaagtaaaccctcaaatacttaggaaaaaggttagcgattctagttctgttgaaggttttacatctgctttattagatcagtcttgcagcttaaagattcattttgatagctgtcagtgtctcagggatgttttcttgtgttcttaaaatattcacagattcataggattcattgcagttgtcctagggtcttcctaccaacgggcaacatcccgtgagcatcctctttgtgtaacatcagagaactctcagtctgttattttccaaatttattcacactccactttgtcactgggtttggtgtggttatgccttagatacagttttgtcatatctccctctttgtacttattatcagtttttcctcataagtcttattttctaatgtcatggctctccttttaactttctttaaatactcaccatcctttgccttcatgggatttctggtcgcagagcattacggattaacatgttctattccaggatgtttctaggactttctcctcgttgtcctatactgtgtgctttaagcggagctggtagcgtagcctttataatgtctgacttaattcaaggatcacaggagtttctctggctcatttcatgtctgcttcattcagtttcgttgcctggtgcacttatggtcagagtttgggcttggtttctcagagttcatgccatatcctatgcatttctgattccctacattttgttaagaaacatgctcacaggcagcagtaatgagttcttaaagagctacaaggccttgttgcacaacttctaaactttgcacaagggcacaaaagatttattgtttattttagtgtgcctattacataacaagttttctgtagtggtgaaacctgttcctttctcgtgcttttgctttttatgctgtcattccagtccttcaatgaccccatccttgtggtctgggcagtacggcttcatggatccctggttctgggggcagatagtcctgggattgaatctgagctctcccacttgtgagatttgtgatcttgcgcaaactgtttcacctctctgtgctgcttttgtcgttaatagaatgaggatattaaggttgtgagggtgaaataaaatacctaaggtaccagcacataataaacagccagtaagtggtagctggtagttactgggcccagcttttatcttctcaataattcattatctaaccaaagaaaagtactaaaaggctgatgacctctaaacactagggaaacaaagaagaattaattctgtgccagggtaggcaggcagagctcattttacaaaagagatgctgggcccaggcagagtgctgtccctgctgaggtccccatgctatgtctggctgctctggagtcactctagtatcttgggagcatcacaggcctggaccacacagtttctgtgccccactggggaccttgggaatgttatgccatactaagcctcttttcccatacgaaactcgggagaatacttccccgctcataaggctttgtgaagattaggtgagattatatttatgaagtacccagcatgttacttggtgcattgaaggggcttgttcccattttctgctcatgaagttgtcagattatctcagaagccctgttcttacccagaaaaaaagagagctgttttccattcctgtggaaggacagggaaagattaaaatgacatcattctatcccagtgcctaccaatgcagctattaataactttgttcttactctgtgtaaaccatacaccaattatagttatacctgacatttctttttttttcttttttaaattttatttttccataagttgttgaggtacaggtggtgtttggttacatgagtaagttcttcagtggtaatttgtgagaacctggtgcatccatcacccgagcagtatacacagcaccatatttgttgtcttttatccctcgccctcctcccactctttccccccaagtccccaaagccattttatcattcttatgcctttgcgtcctcatagcttagctcccacgtatcagtgagaacatacgatgtttggttttccattcctgagttacttcacttagaataatagtctctaatctcatccaggtcactgcaaatgctgttaattcattcctttttatggctgagtagtattcaatcatatatatatatctccgagttctttatccactcgttgattgatgggcatttgggttggttccacgattttgctattgtgaattgtgctgctataaacttgcgcgtgcaagcatctttttccaataatgacttcttttcctgggattgctggatcaaatggtagttctacttttagttctttaaggaatctctacactgttccatagtggctgtactagtttgcattcccaccaaccgtgtagaagtgttccttatcgccacatccacaccaacatctactgtttattgattctttgattatggccattcttacaggagtaaggtggtatcacactgtggttttgatttgcatttccctgatcattagtgatgttgcatttgatttgcatttccctgatcgttaatgattttttcatatgtttgttggccatttgcgtatcttcttttgagaattgtctatttatgtccttagcccactttttgatgggattgattgtttttttcctactgatttgtttgagttcattgtagattctggatattagtcctttgtcagatgtatagattgtgaagattttcacccactctgggttgtctgtgtactctgctgactgttccttttgctttgccaaagctctttaattagatacagctatttatctttgtttttattgcaattgcttttggggttttggtcatgaaatccttgcctacgccagtgtctagaagggtttttccaatgttatcttctagaatttttgtagtttcaggtcttaggtttaagtccttaatccatcttgagttgatttttgtataaggtgagagattatacctgacatttataacattggccccaaagttttactgaaaagttccactcaaaatttttcatattagatggtccttggtttagttcaatattgcactgctggacctgccctgatttacatctcccagtaccacttttgtagagaacaagatgggagaacaaaacattgtcctaagagtatcagtttctttttaaccataaggcatggaacccattttcccttagaaatacaactgtactgtgcttaggttctgaaactgtactgtggcagggggacagcatgatgtcaagggaagtacatgggctttgggctcaagtactccacacactgcccgggacatagtaggtgctcggtaaatgttgactgatagttgtccatatccctcagttcttcccatctataaaatgggtctgattctataagctttttgtgtaagtttaatttgtgcttgaaaataaatgtgtagtggtattattacgccttttcttccttaagtagaatagctgcccaaataatataagatgaattttttttaatacccagtccaaaaatacccattttcccctaattgtttcaaaacatacttttggaggtagctttttcatattgagaaccaaacaaggtccagccgctctattaagagagtatcttaagtctctctctccctccctccctctaaattttttaaatagattttataattgatgttaccatgcctcctgaaaattgcataaatcataaaggtacagctgatgaataatcacaaattaaactcatgcttgtaacacaaaccattatgagctcttcagcagcaccccttcgtgggccttccagtcattacccacccctcccctctgtctggtatccactatcttgacttctaacattatcaattagtgttttctgtttctgaacttaataaaaatggaatcatacagtacatattctactttatgttcagatttttttgctcaacgtgtgtgtatgtgtgtgtctgtatagttccacctagcagaattgcatttcattgttacatagtattccactgttaagaccaccgcaatttattcattgttctgtgaatagacatttgagttattgtaaggttttcctccctgatatgatctgataccattttaacattcttttacatgtttttgggcacatatatgaaatgagtccatttccattgggtttatacctaggggtggaatttcttggtaattggacatgtatatgtattcagctttggtagacagtgtcaacagttttccaaaatggttgtacctattcacatcctcaccagcactttgtgttgtcagtctttaatctttattgttttggtagatgtatagcagtgtattactgtgcttttgtttgcatttccctgataatttctgagtttgagcatcttttcatttgtttatgggctattattgcccacttcttttttgcattgtctattgtattagtttggcattgttataagggaatacctgaggctgggtaatttataaagaagaggtttatttggcttatggttctgcaggctgtcctctgcttctggtgagggtctcaggaggcttccagtcatgacagaggtgaagcgggagcagatatgtcacattgtgagacatggagcaagagagaggggaggaggtacaggctcttcttaacagtcagatcttgcagtaacagacagagaactcattattcatgaatggctacaccaagccattcgtaagggatccatccccatgacccagtcgcctctgcccaggctttacctccaacattggggatcaaatttcgacatgagatttgaaaggacaaatatccaaactgtatcatcggctgttttcttactgatttgcaggagctcttcatgtattctgagtacaaggcctttgtggggcgtattgcagatgtcatctaactgtggcttgcctttctactttcttaatgatgtcttttgatgaacagacatttccagtttaatatagtcaaatgtattaatctttttctttgtgtttaggacttttgtgttcttatattctgaaactagttttgattttttgaaatagtctgttgagtaaggtagacgatgatacagaaataaaaatgtgtgctgattttcagggatggcacatcaactatgcgtgcttaggtattactgagcctcatttactaatatggcactaaagctaaaaaaatctaaacagaaaacattccagaaaggctttcagcagggggaatgacagtttggaatggaaatgataaggttgtctctcagtgtagtcagttattgtatgggatttgtataaatagaagtatattagaaatgatgataatagctgatatttttgagaagattgtttgtgggccagacccggtgtgctaagcattcaatacgtgtcagttcagtcctcacagcagcccagtacttaggaatattactaccccaattttgtagacatggaaacagaggctgggctagcttaaataactttccccatgtctcagagccggggcctgaactcttgctcctaataactgtgtcatcctgcctgtctgtgctacaccagggagatctctttatgaagtgtactgctgctgcatgccagcagcccacaccaaatcagggtgtgaaacagaagcaatttcattatgctcagggattctgtgggtcggtcaggaatttggaaaggacgcagtagagatggcttgtcccatacagtctggggtctcatcagggaaggcttgaaggctggaagtgacccagacagctagggtgacagtcctctgaatgctgcctcagcataggctggtggctgtgctggctgttggttgggcatcagctggaacacatacatgatttctccttgtggactttgcaggtctgctagtccccaaaatgagcttcttagataagaagtaggcaaaagctctgttgccttttatgacctaaccttggcagtcacagcccatcacttccaccagagttacaggcttcagtcttttttcatctgtaggcatcgtgattctttagtcaatgtgttggcttagggaaaaacttaagtctttagaaagcttcaatttgtttaaggaaaatagtgaaggagatagttttatcaggaggaaaaaatatatattttgttttgaagagatgaactgaaagagtttgtttttctcagtggcataaagatctctcaggttcatcacaaaatttgaagtggctgttttgtgggggccttagttatttctttaaaagcatagaaaatgaattgaaggtcataagataagctctattgcaaaatttctattgaaatcgttgtttatgtgttcaaaccagactcaggtcaccccaaatcttgtaggacatccatctgcttttttccatctaagccctcaaggcagttgacctggaaactaaccttggtcccaggccaggaaagtggggggttttaaaccaacatccttatctccttggggttctgagaccgaagtaactgacttagtaacagttggagagtctgtagaaaaattcagtctcaggctttttagccaagttataagaagccttgggtttctacattggctttctttgggttgccaaagtagcttctttgcattgggaagaaatcattttttatacagatacaggttgggtgttattggttaacatagaaattgtgctgctttggacattccaaagcctggatctagcaatggccatatttacaggccactctaggagtccagcaatcacactgttagggtgttcacttctttccccatgtcatgtgtatgactttgccttggtagacttgaataattgagtcccaaatggctctgtcatcaggagcatccagcaattccaccaaggaagcaaagcagaatcgtgacaggtggtgtcatgatcagtgtgctcttttgtcatgtggtttcgttttggtttaagactttttttggccaatggatgggttgggataggaaggagcagtttaccctacgtggaaatatgattgttgctggtctgttggtgaggtggttagaaatgatttgttagacatagcctctgtttcaaaacatactttcttttttttttgttttgttttttaatacatgttattgtatatattggaggttaacaatatgatgtataagatgtagatagtaaaatggttactatagtgaagcaaatcagcatatctatcatcttacgtacttttttgtggcaaaagcagttaaaatctacttatttaacaaaaatt

SEQ ID NO: 1541 - DNA, 5546 bp, Homo sapiens
ggatgaggagggggaaaccgggggaaaagagggaaaagagccgggagagaggtgggcaaggacgagggcgagggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaaggtatctatgtattttgttatgcaggctgcagtgacttgcacatgacataaaagtgcccttagttgtcatggttggttattttcagggcaaaagcctatattctcctccatttttgtaccatggatgtgagtgaatctgatctctgtttctgaggaaatgccaagtactgaatgaagcagatgattactaggtcctaggtgagaagccctagatagtaaggattcatcttcagttgaaacttaagagccccttagaaggtgatgtaccagcaagccagaaaagcaagccagaaaagctacaacatggaaaacaggcctcccctccctctctcggcaccagttgacctactgagaacagagcttttgcagatggtaggcccccaccccaaactttaactggggctccccgctgtgatcttattcttacccaagtatgactgccagatttcatctgcattattaaaaaaaaaaaagcacacacacagacacacaagatctttttatgtactagttaagtagcagtcaaccgagtttctggtaataagaatattagaatcaaaagatttaattagagctccatgaaaaggcggatgccacatccggagaattaaggataaagtgtactaagctgtgccgctttggttcagctcacttaaattgatatactttaaatgtctccagtgtggcacataatgtttatgggagataagacatattggggtgactttcccttttagatttgctaagaattaaagttagaaacgactacagagtgaaatgttttaccataatgtttcattaaattataccccagaaagcataactgattctagaatgcttctgaaagaactgattttgacaccactgtagcaccaaaattctcatgtcaaacagatgtcatccctgtaaaactctctgaaacaaaaggagtttatgatatagcatctgtttttgcagtagatggctgagctaaaacagttttgtttcctttttacaaaatagccctaaatgcctccttttattttaattcattatgtttccatatcccctttaaaggagacattaaaacgtctgatatgattggaccataaatccctaatgaaaggatgaagtaaatactactcagtagcaccacctgcagttaatatcagtgttggaagatgtcttttttagcaccgtcctaaaaagcaaacatttcaaactgtccaaatgagttaacattaaaattcacaattttaataaaaagattaaagtgtcagctcaaaattaaaataaccacttcagactttacagtattaatgaatgtttactagattttatgttgcagcatcttttctttgtggctcatgctttttttttagggttacatgcatggatttttaaattgcctgccatgcctcttttcctccacctggctccatttgcttttttctctcagtactgtagcagttcaaatggctgcatacttatacctggatgggtactttattaactcaatattagatattttgaaatctggttgtcaggccaaagaaaaaatttttagctcacaaataaggtaataataattcatgctttgttaaaacttctttacctatttagtaaacttgttaaacaagaagagagatttgtgcctctgtgatcctcagtctctgccattcagatagcacagataccttagggcatgtttcagcttaacatttgcttggccaaaaggcatggcctgcctgtcttgagctagatactgtgttaggtgctgggagtacagtgaaaggcatcactgcccttcaggaatccaactcagtgaagaagacagaacgaggctgatgggtatgtcagcagataccgcaggagctcaaatagagccgcaagcaaagccctttcgtatggtgttactccatgaaacctaattaaattgttttttattggaaacctataatttgccaagcgctggggattcagtctaaacaaaacaagcagatccttatcctcagggaatagacagcttagtggcagggcagagattttacccagacatgcaggtaaagtacagactttgctaaaggaaaaatataggacttattaaactatgctgtgaggttctagcatttccaatttgtagatgagaaaactgagacttcaagaggcaaaataatttacccatgatcatactggtagaaagtggcagagcgaggactaagcccaagtttttgaactttaaatccaatattctttccattggaaacagttgcttgaagtagcacaggctctcattctgtgctatattaagtttttccatctgtcagttttattagttgtcattgatctgtaatatttctcacacaaaaccattatccaatatttcacacttcattttttagggtttttttaaaactgtatttggaacagtgccatttataatcaagtccaagtttttaacctaccaattaagagcaatacttagattataattatgattagtgtgtatattaacgttatagatttataccaggaaattaggacattttgttctgcttggcagtagttattagcaaaagaaaatttcaattttagaaaccgtaaatttaacttaaggattttctttgttgaaatttcagtgtgggttttcctttgtataataccacggattttacttttatgcggtgtatacaggtgttctacctaagctttcttcctgccaagagacacacagttcttcctgctctgcctttttcatgagcttccatgcttgctttgtttctgaatataaagcagagtgtgaatagcctgtggactgtatgctgacagacaagtacatgaagcgttgaatatcttcaagaaatcgttttatatgatcaagtcactcaactcgtgttgacataagcttaccccaacttgaattactcagccctgttgttgcagagtgagtttagtaacatggctacttttcgttggatccatgtctcctgcgtttcggagagctgcatattcatgtcagtcataacctttgtccctgtaacctgtcagttaactagaaagaattatacattgcatagcacttaaaaattt

SEQ ID NO: 1542 - protein, 764 aa, Homo sapiens
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGIYVFCYAGCSDLHMT

SEQ ID NO: 1543 - DNA, 25545 bp, Mus musculus
tcagtctgaagcttagcaattcagctaggcttgctggccaatgaactcaaggaacctgtccatcttcccttcccccactcttgcattgcacacatgctgtcaagtccagcttcatgcttatgtagcaagcacttactaaccgagacttctcagtctgaattttaactattgtgaattttcctctgtgtgtgtgtgtgtgtgtgtgtgacctatctctgtaacatgtgtaagctttctggttttgtctccatttcttttttttttttttttttttgatgctaaagtaatcagttttaattaacatcatttcataaaagagaaaacaagcgaaccacatacactaacaaacagagcctggagaccttcctgaagaaatacatagggatagagacggacagggctcaggaagccccctgaacacagcgaggcagcacccttcgagagtgttccctgacccaggggtgcttcaggacttgggccaggctcagccgctctgaaggatggtacctaagaagcttggagatcaagtcctgggctcctgcaggcactgatgaaggaaacttaaaatccacctggcggatgcgtctgtatgtctcactggaggtgctgctctcaaagggtggcttccccaccagcagctcatagcagagcaccccaatgcaccacagatcaaccatctcattgtacggtttctgcgctatcatttccgggggcaagtagtccagagtcccacacattgtctttctcctgagagagggggtatgcacagaccacccaaagtctgagatcttcacctcaccattgaggcccagcaggagattctctggcttgatgtccctgtgaatcaccttcttctcatggcagtaggtcagggcatctgacaactcctgtattatcgtggctgtacgctgctggtccaacttctgatgtctctgaagctccttatagagctctcctcctggagcatactccagaattaagtatatccgagtgtcatcatagaagtagttgtacaggcgaaggatgttccggtgttgtaggtgtgcctggatctccacttccctgcgaagttggtgctccaatccctccttctctatctcagacttgaagaggaccttcagggccacgatgaaatgattttccttgagccgagccaagtacacacgcccaaatttccccctgcccagaggacgcccgatttcaaagtcattgatggtgaaatgcttcctggttgaggtgctgggctccatctggccagtagctaaggaaagagagaagaaaaacgggtctggtgatgctcaatagcaaccctagtctgtgggacttgtctccatttctttagaagatttatttttatttctctgtgcaggtgtgtgcctgtgtgactgtctgctatgtgtacgcaggcatctgcagaagtcaggagagggcatcaaatcacatggggctgaaattacaggcagctgttacagaactgccaaggggctgctgggaactgaactctggtcctcaggaagaccagtaggcactcacctgctgagccatctcttcagtccccgttctgatttcttgggcttttcactttcgaacaatcctttacttttagacaaggctatctaaacattgtctttaaaaaattttaatgaatattttgctttctgtaggtgttgtgccagttgtaaacatcaaaagacaacattagaacttgtactctcaagtagttttacagcccagcctagctgggatagagctatgagaacagtgagagggaggttcatacaatgggtaggaaatcctataagcccatcctgtgtgtgtgaatgaagtttctctgaaggcttgggattttaacagaagagactaagagaacactggacgggcagagggtacttcgcaggcagagggggttgctatgaagacacagatgtgggagagcatcatgcgttagcagctaactgctcagaattcagcatgttagttaatgacaccccattgctttgagctgatatgggtttactttgcatatatgtgtatacacatgcacgtgtctcaccagaggtcagaggataatctatgggagtcagtcatctccttccaccacttcagtttcagaaatcaaactcaggtggtcaggctcagcaggaagtgacctcacccactgaactatccctcagtcctccaccttttaaggtattttgttggctgcatgagtaacagtgagaggcgaggccacagccattaagggttatgctcattagctttacattctcaagagaaacaaggtaaaggagcagcatatttattctggctcacacctctctctttatccccttctaactctgtctgggtgcttagtttccctggatggtaggtacagctcacatttaggtcctgacctaactccctcactgaaaatatgctcacaggatacccagaagggttcatcagtgcttttcagtttgattaagctgataaactcaagattaagcagtattcactacttctggcagttagaaatctgttcatctgagtcggtttctccttttttgtaaatagaaattaacactaataataaaaataatcactgagcacggtggcacacgcctttagtctcagaagctcagcaggcagatctctgagttcaaggcctgtatggtctgtatagagagttccagaacagccaggactacacagtaaagagatcttgtctcaaacaaccaaacacacataataaaaaaaagttaggtttttaaggttaggttaggttgcaccaacttgcaatcccagtacttgagtttaaggctggactaagctctgtagtaaaacctaaaaaactagcaaaaggggcagcaaaacaatattgttatgaatgggggtacctggtgggtacttagctcatgccaaggcatattcctgagtaattatgccatgcaacagatctggtataaaagaggtttcctgggggaagggagaggactgaggacctgggacagggtaggaaagggtatagaggcaggcaggggccacgagggcaagaggtagggggacctctgaggacagacgggggagagggaactctgaaaacagagaggggggaggggaaaaaagaaaaaggagaggacatatgagattatggaacacacagagagccgggtggccagcagtccttttataggtcctctaatcccttgctcggtccctgggaggagtctagtgaaatcacctgtaagctaacaatatactaagaggagttattatggcccttgattaaaaattcagtcttttaatacacacatacacacacacaaacacacacacagcattcctttggcacatattccctgaactgtccaaacatgtgacctacttctataccactttttctatcccccaaataggtttttcaattttgcctttttatagtgtcttgtccctttctttcctagcacataaccataatgctaatcgaattttgtaattattttcaaactcctaatactgtaacaagaccttaaaattcttctactttatctggactttctagaacagcctgacattttcctgaaactcttcccccaacccccctataatttagtttaagtaaatataagcttagttttctaataacgtagaaggctgacagcttggctctaatatgttcaataaatgttggcaaaaagatttaaaatcaaactcatctatcagggatgttgtcagtacctaattcggtatttgtaaagttgcttagatgaacttatgtttgtttgtgtttgactgtgacaaggtcttaagtagctcaggctatctttgactgctcccacgttgctaaggatgaacttgaattccttattttcctttttccacctcctctgtactaggctgcttatgtggtggaacttaaaaatgaacccagggccttctatgcggtaagcaagcactttaccaactgggttacacgtccaacctcataattaaagtttttttgtttttttgttttttcttaaaggtgtgaccaagggaaccaatgctggaggccgtgaacaccgtctcctagtaccagaaagaacagcatttactccgtgttgcaggagtgcagctcttcacggttcacaaacagttaacaaggcggaagcacctccgagtgcactttacaacctaaggtgagaaaagccgtgcggtcactattcccactagcggaaaaaccaaaacccaaaccagacactctcaaaaatgcctcttcccgcgctggcattatcaaggtccctctccgaagtcacctactaaccctaaatcccctactaactctgacctccacccggaaaaggggccgatttgctctgcgccacgtgttactacgagggcgtcacccagagctagaaaagagacagcccctgccgaccggaccaaggtatcatgggaattgtagttttctttccaacacgggagtaagtgaactcgcacttacttttgcccttcaagtagcttctatttagtataactcataagataaaaatatgcaccataattttttcagccgagatttcttttcgaaaggaaggatgaagaaaaaaagaacaaaaccaaacacaaagtttataggcggagaaaacaaagggttaataagcgttacgcatgcgctcggaggactcgcgggttgggcggaaggacagctcccaagagctctgttttccccggaagtaccttctcctccctggagtccgcgcggacgcggcttccttacctcatttgtcctcgcccctccccgttcctctacgcgtttcggttcctggttggtgcttcctggtcgcggccgcggcagtgagtatgtgtgtgacggaccccgagctgtcccgcggccgggggaccccttcccctctccgcctcgcccgcggagctgtggaactaatgcgtgcccctctctggccttcccctcccggtccttcggggctcagcgcagtgcagcgcagcaaatggcctctcagctccgtgccgccccacgcggctcagtgaccgggctggggtttggcggcccgagaccagggcttgggcaaggctgggcggcgatggccttgacgggcacgtcttctctgtcggcgttactccaccgcctcccacggttcacccgtcctggggaggtgggccagtcccgaaatgtggaggtctcccttcgctgaggggaacctggccctcaaggatgcgtccagtcgggggccaccttaagctggtgctgtcaagtagccgcttcacgagtagacacaaagaatctgggaactatgccccattccttatataaaaccagggtatcctaagatgatcctctgcccccgcgcccgcacaccctaacagcagacagttgtagtcaattttactgtggggaaatcgaggttgggagttggcagcccccagttccagccatcactgattagctgccgacgctcagaatacctttaggtcgagtttactgtgatttcaagtctcagggttgaatgaaggaaactttttttttttttttttttttttttttttgagacagggtttctctgtatagtcttggctgtcctggaactcactttgtagaccaggctggcctcgaactcagaaattcgcctacctctgcctccagagtgctgggattaaaggggtgagccaccacgcccggcagaaggaaacttttaagggccttttttagcccattggataatttttttcctgagcctgtttttcccaagtataaaatcacccttaatttaatgactaggctcccttcaaaagctctcgacttggtgttgaacatttagaccttaaattgcagcgtgtgtatttaagacggtgttgtgctttagggacagttaattattgtcatttagtcagaggatggggaatgatctgagggaagaattggaagtgaaaattgtatgaaaactacacgattaacagtgcatgggacaaataggagaagcactgtttccagcagagtccaaagagtagttagaagttaacatcagtaaatttagcatgcatttctgacatggagacaagcccattgtttctctctttgatggtcccatttggattccttacctcctttgattggaagtgacagtaacatttgaaaaaggggcagacattttaacttttgtaattggttttgtttctgccttcactgaatctcagtagcacactgagattcttgtaagttataaacctaagtggagaataaactattagtcattttatccattgacaactgtggatttaaaaattcagccctcaaggtggggtccagccccaggtagaacactggcttagcatgtccaggcccctggatatagtccccagcaccatcaaatgaataagaccaaatttgggatttaaatctacctcagatgacctatagcacccagaaagaagctctaagctggaaatactttgaaagaaaattaagagcaaagcgtctagaatgactagtaggtaatcttttaagggggaatattggcttttaagtcttggtaaattctggaaacctaattaacctttgttagtttaaagaaattcaatgactgtcccccccccccaaaaaaaaaaaaccacagtgagtggttttatattctttctttagataagcttcttttccacttctgatattttagattttaaaatgtgatcagtcttctgagttgctgtgctttgataacatcttttgtttatttactctttggggatgggttctaggggttaagacaggaacttctgaccaaatgctaggattattgtgtgtccctgtgccctaccacacagaactttgataaagtttaagtaccagttaggttcttaaatagtaaatttgtaagtttaaatgtctactactccttttaattaaaatgtctgtttcaggtttgtattccctgtggaaagttaatgtatatgtcagataaatgtaggtgtttagccagtacacatatagcagtatttgtagtgatgattagcttagatcaggaacatgtaaatcatgctagccgagttcttaaccaagtgtccagccttagggaggcctccttgtgtctttggacctgtttcttcaaatgtttctaaagggagttttgtgaaaacaatccagcaggtactttttagatgtaaatgtttgtcagaaacatgtgttagctggttaagtatgctcagtaaaaagctgagaaagccttctgcgtcaaaaagcgtgtgtgtgcacatgcagatacacatgcagattcatactcatccttgagtatactttttaaaaattaagtgaatttgattgaaattaacgttgtaacaaaccaaaacagcttgaggcaaaccttaactttggcatatatgagctatataaatataaaagcgtatgttatgccagaacacagttttcaagtacagaaggaacaaaatcctcttaactgccataggggttaaattgttaaattcatttttctacctttcatgggaagagataaatccttagacccaaagaagtccgtttttattatggctctgtagtttatttttggcatatattcacaggtgtgcctatggctctattcttaatccctttcctttgggatggctccaagagtggtacaaatttgtaactctgtaatttagctctttcattttttttttttttttcctgtctgccctggaattaggttttatcttaagtccacactggatcctctggatgggtccactgaggattttgaaggaagcataattccttgacttcttttagaattaatttacctattaaataaaaaaaggaaagaattcatctttcatttgaagtcctctgaggctaacatttcaatataaaccgataaatgtcatgagcattattattcagacagccacattcctctggaatgacaataacagcatagaacttgaaaataacttgaaagatcacatggagggagcaagtacattatagcctttaaaggaaaaagaaattaattgtgttttgttctgttttggtttattttgaaatagtatcttctagctcagactgaccttggaatttactgtgtagctaaggatagtctggaactctgtatcttcttgcttccatctggaattacaccagaagtcatttatttctggaaaacaacacccaaactctagcttgagtgtatacttttttggctcttagattcctggagtctgctggttctcttaacaaaacagacaaaacaccttgaagttctggcagaaacgcaaacctaggaaaacaaagattgtttcttaattgtatttgtaaagctgaaagtggaaggaagagtaagttggcactgttacttttgtctagggtgctcctggtgtttagacaagcgtgatttcctttcctcagaactgttattttgatcagcattccattggtagataattgaaacctctactgtgtagatttttggttagtgttttggaataaagacaactgagaaattattctatcacaatgtctatgttctaagcatttgttaggctttttcgggggaggggggccgctaaaaaacaaaggcttaatgatagaagtcatgttttcaaacatttataaacatctccaaatagctgtttggcttggctattgtgatctatttaacaaagtgaacaaggtccctgccttcctggaattgtgatctatacttctgggacgtttacattgaataagtaattagaaatgtggtgagtgttttataaagtaccatggaagcctctgaaatagagcacttaattctttctgatgggaaatactattaagcctgagttgaaagatgcaggggattttatagatgcttagcagaaattttttttttagacatatattcccaaagctgtgatttttgtctcaattttagttatttagaaaaattgtgttttcaaatgcagttttataactagcattggaataaacattaccacagggtaggttattattatagtaaaggcagtaatagttcttgcagcattggggaatgaaccctggggtcatctcacatggaggctcacacattatttctgggcccttgtctgttttaaattgagagtaaacacacacactcacagtaggtgtgaagagagttttctcttgtatgagaaggtgtacctgagaagaagtgatagagaatgaaaggagagatggagggaggaaggtggatggaggcaggtggttcttaggttactgctgtgcccttttttttttttttttgcagtacaatacacttctctctttttttctttaaaaaatgttgatagagctagacaacttggcatactttaattccagcatgcagacggttgaggcaggaggatcacttttagttcaaggttagcctggtgtctgttataacaacactgttttaaaaaaagagaagaggaataaaagatgaatggaatggggagagatacttttaggcgtcttaacattttagagaacaagtgttcactgcctagcactggatctcaacctgtgtcctttcaaggatgcctttaggatatttgaattgatacagttcagtctgttggtagcaattcttgtttgaaaggtctaaggatcggactagtgcatcaatcagttctcaacctgtgtgtcacaatccctttgggggtcgaacaactcgcatatcaggtagcctgcatattagatatttacattaaaattcataactagcaaaattacagttatgaagtagcagcaatagttttatggttggggtcatttcagcatgaggaaccctactaaagggtctcagcattaggaaggttgagaaccactgttctagtgggcaataacagggcttataaatgcgtggaaaagtgtattcttaaggaaaaaacattttagcatgttgggagaagtggtgatcttcaaagtcagctctgggctaataggtacttactgaacaagatttcaacttttaaaactattctcatatgactttctcgtttacagcattaaggcaactgactttccataatgtttggtggctatgagactatagaagcatttgaagatgatctttatcgtgatgattcatctagtgaactgagtgttgatagtgaggtggaatttcagctctacagccaagtccattatgcccagagtatacataatgccaacaaggaggaaggatatgaggaaaagaactgtgagaattcggaaacagtgagtagtcaaccaaatcagaagaacttaatcgtcctttcagatagtgaggtcatccagctatctgatacatcagaggtcatcacattatctgatgaagatagtatttatagatgtaaaagaaaaaatattgaagtccaagcggaagaaaagacccagagccctgctacttctcattctaataaagtggctcagaaatgcaagaggaataataagaagcctaaacctgaagagaggccaggtgtgatccgagaggtcatgatcatagaggtcagttcaaatgaggaggaagaaagtaccacttcagagaacgaaaatgtggaaagctggatgctcctggggtctgaggaagatggtaaagacaatgacatccttctcaacttggtggggtgtgagaccgctggtgctgaaggttagtgtcgtattgactgttttgaaaagtactaacatctttattaaaggaggactacttttcctagataaaagaccagtagggtctcatctatttaatttcattttttggttttatttacatgagactcactagcttagtggttctttttctgaacatgataaagaatatattaaagtgtcgaagaaactgcttctataagcaaatttttagcgtttcttcttatttggctcaagtcattctagatggaaatcttcgttcttttctgtctgcgaacacaggtgagtactctacctacatggctttgtgatcttatttggccaactctttggaatgcctctataatgcctgaataagtgtttgcttattcaggagttagccagataaccagcatgtggaatatctaggtcacagaaggcagaagatacaggattgatatctcaggaactgcagatctagtagcaggagataggacaggcttaaattttgcagtggactgtaggagaaaatataaactttaagcaccacattcttgaaggtgcaacttttggtgttaagttttgtcccctctgttacgtatagccatctaatatcagtgaatagttttaaaagttcccttcattctcttcctttacgccagggctttcacaagcttcctcattggtcttcttttacctgccctgcacactagtagtcttcagatgttttgtgactcctggtactttactggtgtttcaaaaccttattgcctctcttctgttttctgaagaaatgatggcattaaatataaatcattcttggatctccaaaggaatggtaaatttttttttttttttaaggaatcaggtgggcaatattttagaactccaggctataaagtttttttttttaactattcaacctatttgttggaaagttgccttccatactacttaaagaaatgggcaccgaggatgtagctcatttgaatccatgtctagcatgtgtgaaggcctgggtttggtctctgacaccatatcgatcagttgtggtgatgtacacctgtgtccccgtatttgggaggtggtggaagcaggaggaccaggagttaaaggtcagccatggttatatagcaagttagaggccagcctcaaatacatgagatccagtcttagaaagaataggaagatttgggggtggctgttccaacaggatcttacttagaaaacggggctagcacaagctatagtttgatgagccttgggatttgacagccataataataataataataatgataatgataataataataataatatagcagttatacagccaaatcaaattaatttctgcctaaataagggagaaatgatagtttttaggcagaagggaagaaacttttagagactaagctggtttgctaggtcagggaagttttgtaagatgagattggctacatatgttattagtcttaaaagttaactgccaaatctaatatttgtagagatagagaagaaagttatacattctgatggattgaaatggatgagggaacaatataagcttgtacgattttcttggggggagggaaatgagaggtggctgtggaaaggatgcgtgctgtagatactctttggtagtagatcttggtatttgcaagataaaatccttttagaacagttgacaggtctcactatgactatagttctattttttgtatctggtaatggagaaaatgtgtgtttataaagagttgttaatactctcctaaagactttgtattttactatcacaatactgtaccttggttaatgcacatgtatgggaggtggtctttatataatgtatgacgtggcacctaagctgttgctaattgtctatctccccaggagttctgagcttggaattcattaagctaacacatcaacataaaagaataaagattgcttagaagtagtgttcagtcacaattaggataatatgaatgtagtaaactcattttaaagcattctgttgttttggtaatatttgggtctaaagatcccctcaactagtttctattcatgttcctgtgtgtgtgtgtgtgtgcccacaccacaatatacatatatatatattttttttttcttagtatctccatttggtgcctttattgtaaatctgaaaccttgttttagatttagcatactgaagctaaagtttgtttttattttgtaacaggtctctgctggtttaaggatctgcagagatggtaaaagctaactgcagtatttagataatttctgaaaacataaactaggcattgactttatgaaagaacttgaaatgggaaagggtggccctgagaaagagacgttgctgatgctatggacctaaagaggaagtggctggatggacttgatgtggcactggccttggagcatggtgtgggggcaaagctgcctttctcctgttggatggtgaggaaatctggttggagagaaggtttctataagagaggatcaaaggcaagtttgtggctagaaaagatacacacaaggagaaggcttatttatttggtaatttttttattatatattatataaaagtgtttttataaaaacacttttagtttttatttgtatatatatgtgcacatgcaagcatgggtgtgcgtaagtttggacatgtgagtactgtggcacacttgtggagaccagagaacaacttaaaagaattaattctctccttctaccatgtgggtcctcagagtctgtgttgtttcctactaagctgcctcaccagttcactaaaatgtgtaagtgttggggcatgacaaggaaaggtggagctaatggagctaagtctgagaaccctgagaaaaagagatgcttcaaatacagattggcataagaacatagaaatgtacatattttaaactagacaccaattgtttcattgaagagactaatacagtaagaaactgagttaattttatagaagtctcagccattggagttaagtcttagaaaattctgataatgtcactgaaattttgtggtttataaatgagtacaattattgaaattgaactatcacataagtatggaagactatataaatgcatacgtattctgcattttctctctagatatattttcacagatagaggattcatagttgctatggatttttagcaatctcaatatacacattttctatcattaagaacctctacattttcgaaggaaggactttataacattttctctttggtctattccagatgccagtatcactgttgttgaactttgaggctgctgttcaataaaatgaggggtacttaatactacctttgtgatatgatgatttgcctgagaactgagagggctgttgagggactaggaggcagtactgtatgcaacacatatgctagataagggatgattctcgaaagccagtatgggaggatagtgtaagatgttgccaagctactcagaatggggtacagcttgaaatttactgcactggttattcctggaactttccatttaatattttttcagattgtagttgaccatgtgtaacacactctggagaccaaaccatggatagatagagagggcttctgtgttagaaaagcatgtctgttgttgggagagaagaaaccgaaagaaacaagcatgttttcattgctgtagtgagtggcaacctttgtttgcataagacagcgaaataataaagacaataagtgctttaggaattgttttccttggattaaaaagaggacattttaactgtaggaagaatggttaatttttggtctaggtctttattaaggatggaatgttgtaatgaactccagagtcctgtaacccagcttcaacagtgactcacagctgacaccggccttagagcttggaactgatgctttctttctttctatctgcagttacatgcttctatcactattctgaagcagaacgtagatagaatgttatttcactcatatatacagtgtctgtttcactctgtaaatctttctgaaaagaaattcatttaaaaaaatgtaattattatcactcccaaaaaatttgcgaataacttttatcatcaaatgcccagtgagaatcacaggctaactctcagttttttcccttagagttaatttgagtcatttctgatctgtgtgttgcaagttgttgctgattttagtgtcctttcatttataagctaccctttatctcctctcctttctttttaatttttttgtaatgtggtttcactaattggattgctttccatctagaatttcctatatccattttgtttaatatttcttattgtatttcctacttcctatggcttgttttccttttatttacctttgatacataggctcatctgtttcattttgcttttgatatgtttattttcaattaccttttaaaaatgtataattttttttagattatagtataattacattctttctcttctccctttcctcccttcagtccttcccatgtttaccaatcaatcacttgctctctttcaaatatatgccctttcccttaattgttgttatgtatgcgtgttgctgttatgtatatatgttgtatccctaaatataataaatgcaacttacttgcccatataatgttacttttatgtatgtgttaagggtgaacattggagggtcaattgctttgctgtgccttgaagaaaactattatctcccactctcagttgcctgtagttctctttagggttgaggcttcatgctcactcttacactcctacccctccacttaagcatgtcttttgttttccttgttcagctcctgtttaggcagtcatgttggtgagactttatgagtatagcttctaggcattcctaggagacagtctcacagtaaatcccctaatcctctggcggtcacaatctttctacctcctcttccagtgatcctggagccttaggtgcaggagtagatgtactgtagatgtattcattgggactgggctccacagctctgcattttaattgctgatgtaggtttctgtaatggtctctgtctgttgcaaaaagatgcttccttttattgtgggtatgaggataaatatttagagtgtagttagggattatatgggtaaagattatctttttaaaatttaattttaccttaaagttatataaataatttagtttttttttaattaggtatttatttcatttacatttccaatgctatcccaaaagtcccccacccgctcccccacccactcccacttcttggccctggcgttcccttgtactgaggcagataaagtttacacgaccaatgggcctctctttccactgatggccgactaggccatcttctgatacatatgcagctagagacacgagctccggggggtactgggtagttcatattgttgttccacctataggattgcagatccctttagctccttggttactttctctagctcctccattgaggccctgtgatccatccaacagatgactgtgagcatccacttctgtgtttgctaggccccggcatagtctcacaagagacagccatatctgggtcctttcagcaaaatcttgctagtgtatgcaatggtgtcagcgaaataatttagttttatataattataaaatcaataaaataaggtaaagcccattcagataagcctatttttttaagtctccaccttgatcctgctctttccctcatggatacaggttaaggaaaaaaacaaaataagacagtgctttgtccttatgttaaaataaaaacaagcaagacccaggtatatatctttatgatctctctttccctttgttaattaggatatattatcatactattctaccttttttttttttttttttttttggtttttcaagacagggtttctctgtgtagccctggctgtcctggaactcactctgtagaccaggctggccttgaactcagaaatccacctgcctctgcctcccgagtgctgggattaaaggagtgcgccaccaccccctggctgttgtacctttttaatatatgcgatggagctggatttctatactgtgcatgtgtaaaggtgtgcatgacggtgaggtgaatattttagtatctcttatgctgagccgtgctgataattagacagtgttttctgaatgtaagtgaggaatacttaaaatagtcaatgaatgataaattgttacaccattaaaatgaagagcagataaataatagttcagttacaactggagaagcatgctttacttctgttctcactgttaatgcctctttctcgtttcttaattttgaaagctacagatttagcaaaaattaaatagtcacaggatttagaaagaaaatattctttatatcctttcaagaatgaaaactggcatttttaagttgaagccatatttctcatttgtgactggtgttctagaagttttgtgttaagtgcatttctgtctttgccactggtattctttcttttcatagttatttgaagttaaagtgaactcatggcccggttaatgtgaaatcatagacttttgaaattgagatatacttatggctttgaaaacttaagacaataagaattttgataattttttttttttgtgtgccaagtttcatttttccccaaaccatgtacataagtttaggtgtaaattcagaaggtggagaactcacgcagggcccttgctgagttcctgggactttttaggttctcaaccaaagcttgaaactgaaaataattgagtagaatgggtccctatttaaaattcagttttttgcatcttgcctttttatttatttcttgtcatttctcacatgggtgccatgtatattgatcattgagaccaccagcctcacctttctacctcatattttcctagcgtctctctctctctctctctctctctctctctctctctctctcacacacacacaccttcatgtctttttagttgtcaaacatttcaattatttgatttgatttgggtctttacatacacagtctatcttcttggatcagtctctgccttgcctgcctgacatctgttcatcgttcaattaacagtttaaagtttactgaatgaagtaatggttatagtttctcagttattagatatcaaattccacagttgacctgctgtcacataaacaaaaaacccaagttgttttttgaatgtctcaagtataacacttccttaaatacattttattttatttgatggcattttctgatctactagcttatgagatagtcttttgttatgtgttttgttttttgttttttttttttgtttttcgagacagggtttctctgaatagatagccttggctatacaggctggcctcgaactcagaaatccacctgcctctgcctttgcctcccgagtgctgggattaaaggcatgcgccaccacacccggctttatgagatagtcttaattcttaaaccttaaacaaccccccccccccaaaaaaaagcacaaccaaaaaacactttgcaagccacttacttaagtaaggtattgggattcaagagctgtcatatggttcctgcctttagaagccttaaaatgcttgataatatggaaaactcactgatgttaaaaaacatttctacaagtacaaaagatgttccagaaccaaacacaatcatcctagatgaatataatgcactttatgtttttaaaagttccaggtgctgtagagatgtcttggtagttaagagcactgttgctcttgcctaggttcttttaccagaatctacgtgtctgtatctgtagttcacattccagggaattcaaagccttcacctgacttccatgggcaccaggcatgcatgtgcaacacatacaaacatgaaggcaaaatactcacatgtataagataaatctaaaataatttaaaaataaaaagctcagtctgtaaagctcttgcccgaaagcctgaagacgtaattttgatccccagcacctgaataaaaagtctggtacgattgtaggtacttacaattccagcactgaggaggcagaggcaggcagatcatggggcttgctggccagttagctagcataattgacaagcatcagatccctacaagagcccttgtctcaaaaaacaggacaacacccaaggctgatctctagcctccctgcaggtgcacacatatatgcatatcacacatatgttcatgcacaggagcagacacctacatggggggagagagagtgcatggagttgagaaagctcactagctgggtgtggtggcctatgcctgtaccagttcaggatggctaaggcatgatttcaagtttaagatcaaactaggctatactgaaaccttgtctcataaaacagtgcacagctggtttcatgtctttaatcatagcactcaagaggtttgcaggaggattgctgtgaattcaaggccagtttggtttacataataagttctaaggccaaccatggctacctagagagactgtctcaaaagaaacaaaacaaaacaaaaaatgtacaaaacataaaacaaaaaaactcccaaaactcctactttgtaggcaaaacacaagagtcagttggaaagtttaagtaatgtacaagaaagaaacatgagtatatggtatcactaatttttatatatggttagataggatgggacattttaatagcatgtcttttaacatggctgtcttagctgagataagagcagacacgtaggttctttatatgctcagaatgctgtggaagatttcttaggtcatgattttctttgtttctgcctctttcttgtctctatttcttccatctcttcttgaaaatatagttggaaccagacagtggtggcgcacacctttattcccagcacttgggaggcagaggcaggtggatctcttgagttcaaggccagcctggcctacagagtgagatccaggacagccagggctacacagagaaaccctgtcttgaaacccactgtctacacataaaaaagaaaagaaaatatagttggatattttgtttattaaaaaaaaaaccagcctgtgcattgctttatgagacaaggtgtcagtttgtagtccagttggagtgtgtactgtattgcagttggatcaggtgctgtaaatagttaaggaatgtgaccagctattaaggagtatcttatacagctctttaaatttttaaaaattatatttactttgtgtttcgcttgcatgtatgcctgggcaccaggtgtgtgcctggtaaaagatcagatcccttggagctatcatatgggtgctgagaatcaaacttgagtcttctggaagagcagccaattctctgggccatctctccagcctctttatgcagagcttttgaaaatagaacatttaaaaaaattatataatttgggctttttataggttgttgtctttcttaattgtttgaccatagtaaaggaaccaaattgtttagtttgaaaccactaataaagctttatttttcaataatccttcagatttttaaggtaatattttcctccttttatcaacttaattttggtaattacagttcttaggacatcccaggcctaattggttacaaaaatgagttgccatttaacacacttctcgtggatgtatagtttagtatctgtcttataattaaaaagtagccccatgctagagctccagtgaccaagagcaacaaggctccctccctagtgtgatcagcttttgtaagcatggactacacaattcctaaagctgctttgagctgtgtctctcgttgtacatgtcaccttcccactttactgttgtaagggcatctttttttatttaatttctaattagcataatgacttgagctgtgttattcactgtttcatggtgaagttgtcataggaagagaagaaataaaaatgttcagattcaactttacttgtgaatggggtgaagtttaaaagcctcttatggctattgttcagcagactacaaatcttattggaaacccatgaagtccaaggcagctttgggttgaattttaataacattttgaaatgttgatattgtgtgtcacttaattttactgtgatttttctatagatcaccaactttggtacacattctttcaaagtcattttatgactttcagtctaaattcacttatcattgtttaaaaaaaaattccttgtttagtactgaggaagaaaattgaattttgcttttgaaaaagcattaataactagctttgattttttttcatagttacattaaatttaatagaaacttttccaccttgatatatatttattgaactaatgacagtgtagttactatttaaaagttagtttatagatttgcttaccgctttggaatggagaagcataaaattaagtgggcaacattttcattcttgttataggaacttgagtcctgatgtgtttaggtgcagtgttaaatgtaattttcacatagcctcatgctataaacataatctactgtatataaagatcatttgtataaagctattaactataactagtgggatatttttatggttagattataaattttatatgaatggcatgtttagattatgaaacctttttcaaaagaaatacagaactttttttttccatgaacataaaggctattcagatcatttctttatagattttattttgttaagactttgctaaatttatgttcagtttcaagtaatttgttacttccttaaatactccaattgtggttaaaaatgaagtgttgatggaagttgctcagtctaaaagtttcttttgtttccttgcttacctttgtttgattgtatattaaagttactgtggttaatgttttggcgttttcagttacatgcctgatcgttgtcacttatgctaagaatacgagataaacattttagtgagcatccaccatgtaaggacacattttcttttaaagttgtacacattatttgattttcatttgagtcttgatccagtcatattgtctctggtataattctagagatgaaatctactttgtagtgcctgtttggattcaagaaatggatgaaacaaactattttaaggaattcttactatgttaaatgtgtaacttcgatttctgtcataaattcttaaccttagaatttcagcttttgtcatttttgaaagttattcactgttcttatccctgtcttttacaaacacattttaaaagaagacagcaagcctgtgtgatggtgagatgctagccatctgcccccaggtgagagagtagcatttagaagctcagggctagtttttaagggaaagtgtttttattggcaagtcccttgaagggagtaggtcgcatttggttttactttgtagctaaatagcacttgtaacagaattatccacaccaggcagaaagtcctacctctagagaacttttcaacagtctccatactaatactaatgaggaattctaaagactaggaaagcttggttatgctgataaacgtttgctaaagtcattcaaatagtgcttttaaaaatggggaatttaggattatggaagataaatttaactgaagaaaggtggtttttgaagagttgtagaactacattaaccctggaagtttgtctgtacactacactagctgttcttatgtgttaaattgtctgctttaagcatagggatttttttgccagtgacttttagaggcaatattattttatacatttaaggagaatcttcattgtcattaaaatgtctttgttacaataagaacttgaaagattgtgtcagttctatataggcaagtattttgatccttctttttatttctgctcatttggtttgctttagacatgacacagattttgtggtgaatacttacaatttaaatattgttcggtttcagtattgcctaataatcatttaacttgatgccaaatagttgaagaacttcatgatacccagtttaaatgtttctgaagaaattcttggtaaaaatccaccaggtagtagcttgtgaggtatttctgagtgtttttgttgttattgttctatttgtacttaaaattttctgtttaaaatgttttcatttgaaaaaccattattattattatcattattattgggtttaacaaaataaatgtagtagtcaaacctcaaatcatctcattttcaacagtattggttagttaaaaaactgactacaatatagttctgtgtgagtgaaggagctgtgcttgctgttggatcgcgcagctacctaacgctaggttagcaggaccagcaaagagactttatttcattagatgtttttattcctttgattatttaaaccttgaagattataggtttgtgtgcaactttttaaagcaatagtaagcaacgagaatcccttttcttcctttaagtatattacactcatgtgcgtattttagcaaaaaaggaaaaacttaaatcttcttttgagtcttggtagttattcttaaaaatggattaaaccaataaagtttgtttaggaatctcaaaaagatcttcagtagggtacctgcggctcagcagtctatctgtgcagattccctgcctattgtggctgcttgctcatttacatttcccatggctttgggttgcagacttggttttctgcaagagtgcccatgctcatttgctcatatattctgagtgacttttttactttttctttcttcttattttgttgattgctaagaggacagagttttgttttttgtttttgttttttaaacaccgccacacttgttcctttgttatttcttttcctcagtgcatatatttctatgttgttttgtttggcatattgtgaagaattattgtttggtagttagatccatggggactagcagagaaaaagtcattttgatcttggttttgtttccttaataacagtagcaatttaattcccaaactattgagaagcttaaaatatatgttagctttatgaaattgatggaaagttattagtcctgtaaatttctgttcttgatcattttactactgttagaatgaagatattttttgtcgtgagtcaagttttaatagtaaaaatactaattgtcagtaaggagtattgtaaaattttattttaaatattatgtaataaaagcacactcttgagattagttataattgtatatatgatttcatctatattgaaaatttgttgtccataacatatataagtagacatttgaatgttcatatacttgattaggaatattgcatttttatcttgagatctttttataaatttgtctttaaaaaaatagatgatgctatttcttctcagatgtgagtaattttgtttcatgaaatgacagcttgatgctgccaaatgctaagtccttgaaaaaatgtgctgtggcagcttaacaatcaggcaattttgttgtaaataaaaaacagggaatctgcatctaacagctctacaaaatagttttcccatatacaaaggttttaaaagtatatgtttctgttttatgaacatgacataatacagtattgtgtattactctaacataaaataaataaataaaaaatccttggccatttaaaggttgtaatgctgtgacgcctctctgttaacaggctgaaaaaccttgttgttggtaaatagaaggaaggagggagtcagggttaacttatcattttggaatttttaatgtaatacataatagtaattggatatttagtaattttctatatatgggtactctaatagttggagaatggccatcctgtatctaataacggtgttctttttaaatttttgataattttagtgtcttagattacagaattcataattaccaagaaacatcatttttatgttattttgcttttttggtttattctcaatattttgattttacactaatattttgatttgtatgaaatgagttctcaagaaactatttcttttaaaaacagtttcaaaacaagaaaatatatgctgatatctaactagtcgttgactgttctaaataaaatacatttgaactttttgatcatatatttataatctttattagtttataaaattattcagacttctgaatggtatttttaaaaaaaattttacttgacctttgatgtttcaatctaataattgcaaaatacaacaatttgagatagtgcaccaaatcagggcatgttctataatgtgaaagtaacataactataaaagtgtacagctttgaaaatatattttcatggcaagtgtaggtctgactgtctatgagcatactagcacagtattgcagagctaggctggaaatggaccaaggacagaagctgggggagtgctcagtgctgctgaaacctcccaggcagttgtcacacaacctttgtttttaaaggtcatgattgcctggtgcctttgccagtctttatttgcaattcttgttttgtggcgtttcttttttgttctctctctctctttttgctttggcactgggtggaatgttcttttaaaactgagtagctaaacttgtacagtaatattaaggtgtaacggaaatactttcatgtatgctttgttttaggccagaaaatgctgtgacggtaagctaatgagaagagaattaattaattaatgagtgttttgaaaactgattagctttgaaattttctgttcagtttctgttctgagttagaatttaaattggagctgtttacgaaataagtcacattaatgtgtttctgtgttccagttgggtgttggtattttttgaaaaatgatatttggtgatatgagagaaagtaggagatgagcacagaataaaagttgggggagggggcaaggaattgtctgcttcaagtgactccagctgacagaccaatagagagttttaagagacgaaagtgctgaaactccattttaaaatactaaaagggttgaacatgcttgacaaggct

SEQ ID NO: 1544 - DNA, 618 bp, Mus musculus
atgtttggtggctatgagactatagaagcatttgaagatgatctttatcgtgatgattcatctagtgaactgagtgttgatagtgaggtggaatttcagctctacagccaagtccattatgcccagagtatacataatgccaacaaggaggaaggatatgaggaaaagaactgtgagaattcggaaacagtgagtagtcaaccaaatcagaagaacttaatcgtcctttcagatagtgaggtcatccagctatctgatacatcagaggtcatcacattatctgatgaagatagtatttatagatgtaaaagaaaaaatattgaagtccaagcggaagaaaagacccagagccctgctacttctcattctaataaagtggctcagaaatgcaagaggaataataagaagcctaaacctgaagagaggccaggtgtgatccgagaggtcatgatcatagaggtcagttcaaatgaggaggaagaaagtaccacttcagagaacgaaaatgtggaaagctggatgctcctggggtctgaggaagatggtaaagacaatgacatccttctcaacttggtggggtgtgagaccgctggtgctgaagtgatcctggagccttag

SEQ ID NO: 1545 - protein, 205 aa, Mus musculus
MFGGYETIEAFEDDLYRDDSSSELSVDSEVEFQLYSQVHYAQSIHNANKEEGYEEKNCENSETVSSQPNQKNLIVLSDSEVIQLSDTSEVITLSDEDSIYRCKRKNIEVQAEEKTQSPATSHSNKVAQKCKRNNKKPKPEERPGVIREVMIIEVSSNEEEESTTSENENVESWMLLGSEEDGKDNDILLNLVGCETAGAEVILEP

SEQ ID NO: 1546 - DNA, 26444 bp, Homo sapiens
  misc_feature (1)...(26444): n = A,T,C or G
aagtaaaataattcatggtagcattgccgcaaagacatgtcgaaactgaaaactgtagacataattcccgggtccgggacgggcagctgaagagagcagcccctctatagatgacacctaaataagccctgtttgagcatgcgtgatccttcatgtctcataatctgtggatccagggctcatggacatttaaaagaaaggcatgcctttttagacagcttctccacatgttactgatgacatgcttcaagatttcttgtgcagaatctgatgattcttaaattagaatcccaatagttttgccagtcagtattcattatatagtcacttagagctaagccttgaggaataaaattccaactaggaataataataaaaaacgggaatggtgcccttgcaatactagttccttatccctaggattttattataatgagaatagtaagtatatagtttaatttataatacatatttttaaatttcattatttcataaggaaaggcagtctccaagaaaaattaaaagccatctctatgaatgtccacattttcaagaacgatttcatagcctggttgaaaattgtgtgctctctccatcatcttgcaatttgaagaactgcaaaatcatgaataatacaaaaggatgttaaacttttcaacaaatccagatgggtaccaatgtcattgagaattcctgagaatcaccttgattgctgcttcagacctaggagcctgaattgaatatcacttaccagttggaagctattggcttcagtgacgacagtttctacaataacattggtatctatatcgtttacttttaaaattgtatagacactaagtttgtaattttggcaaataaaaaacgtccaaactttaacattcagtcatttcccttgctagccttctatttcttctcccttattatttagactttggtgcaacagaaagaatgatggactgggaactagaggccagttttaacactaacctttgctgggaccttgcaaatctcttcttcattttgcatcttagttgtcccttctgcaaaatgagagagttggactagatgtccctttcagccatgattctcgggtttccattgttccacacagtcactggatgaagagacactgccaatgcaaagactgagccgccatgagaactcatgttatgtcttgcaactcttgaggctgggtataatgtaggcctaaagtctttacttctaatcttaggtagcagggaaatgtgtccatttgtgggttatgctgctcgttatccctctaatccccgtctccccacaccatgctagtcctggatattcagagtcagggcttgtttgtcaacacagaagactcgcacacttgtgatgcttttgcttatcctgttcctttaccagaagatccccctgcttctctacctagcaaactctcattcattcttttaattttgccttttaattttatattttgacataatttcacatttggagaaaaattgcaaaatctgtacaaagaatcctcatatacctttacgcagatccccaaaatgttaactttttaccacactcctctgtctctctctccctctagctcccagaattttttttctgagccacttaagcatcagtttcagacatgatgcccctttactccaggtagttcagtgtgctcgacctgaaaaataaaaccaagacattctcttacataaccataatgtaaatataaaaattggggaaataatgttaatgcagtactgtcctctaacctagatctggatgttgccaattgttcctttaatgcggtacagttcctcggtctttctttgcatttcctgccactgacagttttgaagagataagtgccagtatttttagagtgtacctcatggttatattcaagttacgcacttttgatgtgaatgccatagaagtaatgtgctgtttttctcaatgaatcacatctcactttttaaagtgaaagtcattcttcaatctcctccattcctactcccctcctaagaggtaaataaccactgttaacgattggtattcatctagtattttgtctatgcacttatatacacacatatctatacacaggcacacttgtaccctttaaaaacataataaaatgagaacactatatccttactgctctgcaatttaccttttttcatttaagtgtannnnnnnnnnnnnnnnnnnnatgaagagacactgccaatgcaaagaactgagccgccatgagaactcatgttatgtcttgcaactcttgaggctgggtataatgtaggcctaaagtctttacttctaatcttaggtagcagggaaatgtgtccatttgtgggttatgctgctcgttatccctctaatccccgtctccccacaccatgctagtcctggatattcagagtcagggcttgtttgtcaacacagaagactcgcacacttgtgatgcttttgcttatcctgttcctttaccagaagatccttctgcttctctacctagtaaactctcactcattcttttaattttgccttttaattttatattttgacataatttcagactgggagaaaagttgcaaaatccgtacaaagaatcctcatataccttttacgcagaccccccaaatgataactttttaccacactcctctgtctctctctccctctagctcccagaattttttttctgagccacttaagcatcagtttcagacatgatgcccctttactccaggtagttcagtgtgctcgacctgaaaaataaaaccaagacgttctcctacataatgtaaatataaaaatcgaggaaataacgttaatgcagtgctgtcctctaacctagatctggatgttgccaattgttcctttaatgtggtacagctcctcggtctttctttgcatttcctgccactgacagttttggagagataagtccagtattttgtagaatgtccctcaatatgtgtttgatagttttctcatgtttatattcaagttatgtacttttgatgggaataccacagaagttacatgctgtttttctcaatgaataatgtctcacatttttttgtttagatgaaagtccttcaatctcttactcccactcccctcctaagatgtaaataaccactgttaacaattggcatccatgcagtattttgtctatgtatctatgtacacacatatctacatacagacacacaggtaccctttaaaaacataaaaatgggctgggttcggtggctcctgcctgtaatcccagcactttgggtggctggggtgggtggatcacttgaggccaggagttcaagaccagcctggccaacatggtgaaaccctgtctttactaaaaatacaaaaattaactgggcgtggttgcaggtgcctgtagtacctgctacttgggaagctgaggcaggagaatcacttgagccggggaggtggaggttgcagtgagctgagatcatgccatttcactccagcctgggcaacagagtgagactctgtcacaaaaaataaaaaaataaaaaaaagatttcacaatacacctactgctctgcaatgtgcctttttttcactgaactgtatgtctttgtgaatctttctatatctttttgttgaagctgcgtctacaggcgtgtgccaccgtgcacggctaatttctgtatttttagtagacgggggttttgccatgttggccaggctggtctccacctactgggctcaagtgatcctcccacctcagcctcccgagtagctgggactactgatgcatatcaccattcccagctaatttttgtatttttgttgagacagggtttcgccatgttacccaggctggtctggaacttctgggctcaagaagtctgccttccttagcctaccaaagtgctaggattacaggtgtgagccactgtgccaggccaaaagtggcattttttttaatagtataagtatgtccttgtttagatcgttccctactaatgaatatttgtttccatttttttctatcacaatgtttgtacatacatttaagaacatacctcataatagcgatagatgctattaaatagctctcctaacacacttttccagtttgtattctcatctactgtgcatgagataatttgcatttttctgactgttagtgatgcagagcacctattcacggcctttgggtttcttgttctgtgaattgcctgttagtggtctttgctgtgagaatgctgaattgtccgtctttgtctgactacttatttctccaggcctcactcaattctgttcctctgcagaggcttccccatgtcccctaatcagccaccaccccctcctctgctgtcccataacactgttcacaccatgcccaggccttcatttaccaaccattccatacaaaatctactcattccaaaagtgtccactgtgagccttctctgtgcttggccttgggctaggtgttgggtggagagacatgagccagtcatcatagactccatgctaaagttcaattttgaaatgcagctttgagcatagaaaagagcatgagttttagatctagacataacttgagttgaattccagcttcaccacttcccagctgtgtaattcagagcaagtcacttgattactccaagtctccatttccatactagtgaggtgaggctaatccctccctaagagagtcacttgaagctggacaagagacaataatatctgaaatggctaaaaagggcctgttacacagtaggcttgcagtggatgaatggtagttgaaaggcaactgttaagaggtcaaaatcagttagttctcagaggttctaggagccaccaataaactggaaaataaaaaggaaggaagtagctcctctctttgcaatgcaaaggatatggatgagtgccacttgcccagatcctgctgcagaatatcctttatctttcctgctctctgcagcagatttctgctttgtcttggcccctcatcccaattcagctgtgcactgttgatgtcctactgccactttcgtgggaagaacaggtgcttcccttctcaaataaatgttggtctaggcagggcgtggtggctcacgcccgtaatgccagcactttgggaggcagaggcgggtggatcacgaggtcaggagatcgagaccatcctggctaacacagtgaaaccctgtctctactaaaaatacaaaaaaataagctgggcgttgtggcgggtgcctgtagtcctagctactcaggaggctgaggcaggagaatggcgtgaacccgggaggcggaggagtttgcagtgagccgagatcgcgccactgctctccagcctgggtgatagagtgagactccatctcaaataaataaataaataaataaataaataaataaataaataaaataaacgttggtctctttagaagatactctgtaagaaagacttcaggatatttgtgcatgctgtcacccatgatttcaagaagtaggggctgagcactgtggttcacactgaggcgggaggactgcttgagacagttcaagaccagcctggtcaacatggcgagatcccatctctacaaaatgtatatagttttaaattagccaggtgcagtgtggtgatgcacgcctgtagtcccagcttcttgggaggctcaggtgggaggatctcttgagcccaggaggttgaggctccagtgagctgtgtttacaccactgcactccagcctgagtgacagagtgagaccctgcgtcaaaaaaaaaataaaataaaataaaaaggagaaatggggagtagagacagcttcaattagaaagagaaatgctgtgtatgtggagagaggctaaggtggaaagtttccctgaagacccaaaacttcagcagagtagggtgagtgggtatatgttagaaggacagggagaagggctttacaggcagtggagtgttctctgcaaaggcacaggtgtgggagggcatggtgtgttctggcaactgcccaggattcagcgtcaacagtaggcagatgtcagctcatgaagtgccttttatgccatccaaaggactctaggtttgaagacataaactaaaggggtaggctgaagcattctgagcatgggaaagcagtaaatctttgttgaatgcatgtgtgacagtgggaagatgggacatggtaattaggagtacagtcgtgtcatttaatgatggggataagttttgagaagtgcattgttaggtgattttttcattgtgcaaacttcatcgagcatatttacacaaacctagatggtatagtcaagtaaacacctaggccacatgatgtagcctattgctcccagattacaaactgctacatgttactgtactgaatactgtaggtgactataacacaataagtatttgtgcatctaaacatggaagaggtacagtaaaaatatgataaaataatcatcatatatgcagtctggttttgagtggaatgtcattatgaagcacataactattatttcctatacttgtggccttctataagttttacttagcctttctacgcctcttttctttttttgtgtgtgtgaaattggaacttaaaacatcaacttgaaagtattggtggggctgagtgtctcatgcctgtaatcctaggactttgggaggctgaggtggggggatcacttgaggcctggagcccagaagctggagaccagcctgggcaatacggggagaccctatctctacaaaaaagttttaaaaatttaaaaaataattaactcagcatggtggtgtgtgcctttagtcccagctacttgggaggttaatgcgggagcatcatttgggagataggtttcagtgagctgtgattacaccactgcactccagcctgggtgacagagcaagaccctttctcaaaaaaaaaaaaaaatccacaaagtgttgtcgaaatttaaaatattataatagatggacaggagtaatcctggcaatatatttttaaatttttaaaaaggtgacatttgttttacacaatacatattaccaaaacaaacaatctagtcatctgtgatgtgcttctatgcctgttttcttttctggaaagtggttctccaattttaccttttcatagtaccttgtccttctccttcccagcacttaccccataatgttaattaaatgttctaattcttttctggccaaactcctagactataactgttttcctagctagatgcctatctctatgagatcagtgacttaaaaatttacaacttttctgcactttctaacaccgtcttttaacagatagatgttcaataaacgttggtgaaaacaatcaaactcacacttgtcttgaggagaattgaaataggccaatgaattggcagtgtgtcattatgagaggagaaaaatagttcagagcagtctaagttacgttaaaggtatgcaaaaataatttttttaaaaattaaagatatggggtctctcatccaggctggagtgcagtggtgtgatcacagctcactatgaccttgaactctcaggctcaagcaatcttctcaccttggcctccttagtagctaggaatacagttgtgtgccaccacgcctggctaatttttactatttaaaatttcttatttatttttatttttataaaaagatttgtttttttaaatttatttttatataattttttaattaagaaaaggatcttattttaaatatagatggggtcttcttatgttgcccaggctggtctccaactcctgagctcaagcgatccacctgcctcaacctcccaaagtgctgggattacagccatgaggcaccttgcttgagctttaaacatttttgttcagacggtctcattctggagtgcaatggtgcgatctcggctcactgcagcctagacctccgcagttcaaacctcagccaggaacagctgggactccaggtgtgggccaccacgccctgttattattattatttttttgacacggagtttctctcttgctgcccagggtggagtgcaatggcgcaatctcggctcactgcaacctccgcctgccgggttaaagcgattctcctgccttaacctcaggagtggctaggattacaggcatgcgccatcacgcccggctaattttgtatttttactagagacggggtttcgccatgttggtcaggctggtctccaactcctgacctcaggtgatccgcccgcctcggcctcccaaagtgctgggattacaggcgtgagccactgcgcccagtcgcccagttaatttttaaatttttaaatttttttgtagagacagcgtcttgctatattaccccggctggtttcgaattctcggccttaagctatcctcccacttcgggctcccaaacaggtgagagctaccccattagccaggcaggcattcaaactttatcaggcccagagggacttgagtatggtacttcagttagcaccatcccatgtaggtggtggtgggggtgggggtggggggtaggggtgtgtggcaattgtttaaaggcattttgttcttttcttcccagtacctgcatcaccctttatcttcgtgttcctaaaatttgtgatagaaagaacaatgtgtagccaatggatagcttatgttattttagtgtcaattcttggtatgtagtttagcaaaagcctcttcttttttcctttaaaaattcactcgtggccgggcgcggtggctcacgcctctaatcccagcactttggcaggtcgaggccaggagttcgagaccagcctggccaacatggtgaaaccccgactctactaaaaatacaaaaattagctgggcgtggtggcaggcgcctgtaatcccagctacttcggaggctgaggcaggaggatggcttgaatctgggaggcggaggttgcagtgagccgagaccgcgccattgcactccagcctgggcaacaactgcgaaactccgtctcaggaaaaaaaaaaaaaaaaaaaaaaaaaaccccttaaggaaggaaaaaatttcactcgtagctgctacaagaagtgtaatggctcatgcctgtgatcccagtgctttgggagacagaggtgggaggatcgatacctttaagcctggagcttcacaagacaaagaactcagttgaaactgctgcttatcggatcacatattaagggcaacttgaattgatgatcccaggttgccctcatcaaacttggcccaaataaattctccacttatattaactttgcctcagtttttcctttaggtcgacagttatttctaaagttctacagatgggtttaccttgtattaaaataaggtgtgagaagggcaaatgaagccagaggctcccagcacaatcttgcaaccttcagagacttccaaaggatcagcattaactccaatatttagcaggagtgcagctcttcgagattcacaaagtgttaatctgttgcctagaattccagagagttggaggcgcccagtgtgaactgtgttccgcctaaaagaaaaagcgaccagcctaagatcatgagcgcaagggagaagcttgaagccatgcgctctcaagtacgcgtttcccgctgcccaggtctgcgggccaagcagccagccacgctggccctcgtcatgcacgcgatcagctaggctcccgcgccacgtggcactgagaaggcgtccaccgagcgccagggagaaggaggcggagcccggcctcaacctcgcccgtgtcctcatgggggttgtagttttcctcgcgggggtagagggcacgaactccccggcttttgcccggtaaatagcatctccttcgtacgagtcattcaaataatagatgcagcctaggtagcttcaagagaagttgggaaggggaagggggaaagcaaggaaggcaaacctaataattatgggcggggcagagaacggttcgcacccactacgcatgcgcacatcaggcgcggcaggtgggcggggacggaaaggcggtgactagagctgtgttgtccccggaagtgccttccctcccgggtctgcgcggacgcggcctccttacctcatttgtcctcgcccctccccgtccctctacgcgttttggttcccggttggtgcttcctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctggtccgtcacctgcgcgccgccccacgcggccgggctgcgggtctagggggtccgcgtctccctggctttccaagggctaatgccgtgattctagagcggctgggcgtctagggcctcggtgagggtggcgtgtctgccctttttatttccccgcaaggcccccagtcttctagggaagccagtcagtgaagcgcggaggtcccggcgcgccgagagagagtccagtctttgaggaccgagtagtcctgggccacctcccgcctctgctgtcagaagcagcagctgcagcagtagaatccaaaatttcgggagctgtgaccctttcctcatgtaaaacgagtagacttggactgtgtttactaaggcgccctttatccctcccatcctgtgagcggacagttgccttcaacttttgggaagagctgctggttcggtggaaaagctgtggctgggaatcaggaggcctgggttctagccgtggctcccccacggattcgctggcgattccagaaagctcttattgaagctgaatttaagattatttcagattgcacagttgaattacgggctgcattagtagggcctttttagctcagtgaataagtttctctgagctcctttctccaactataaaacgagagcgttcaatttgatgacttttcaggtcccctcagaagctcttgactttgtggttttctttttctttttaaaattttttctaggaccgttagagaaatgacttcgtgtttgaatagttaggctgtcgcatacaaagacttttaaatggattgtgtgtatacttaggaaagcgttatgctttcaggagaatctgagcatggggaataaagtcaggaaggatcgcaagtgaggattatattaatatgataattagcacggtaagagactgcatgaccgaaggaaaagggctaagggaaaggtgaaggaaatgtttccggataggattagttctcgtaaaaatcatatatatatcccaagaagagctgggacttaagtgactaaatttagcttattttttttcccccactgaaatactgtgctctgtttgtcttttgtgacttttgttttacacatttggattctccatcccaatcagatttgattcagagtggccatcgcatttgaaaaatggacagacattttaaccctttagacaattgtgtttcaactgtcctgtcagggcagcttactaagagtaagaaaaattttactttgaaagtaaagtgtattcatcacattccaatgaaaattggactgaaaatgaggctgtggatttgatttaaatcggccggagatggatgcgtgtgtcatcaagaaggaacatctagggaggctaaagatatttggaagtaaataagagcaaaaggtcagaatgaccagtaggtagactgtgagagcagaaggattgattaaagactgtgttaagtaaatgctgaaagcttaaataagccttaagttgtctagtttaaaacaattcagtcaatgaatactgctccctcttttgaatggtaatagcctttgcagttattctatagctgttttatatttgttaaggtattttaattcttagataagtttcatttgcatgatattttaagatgttatataggaaacatcttttctggtcatgggattgatagtttttgagtaccaacttgggagattcttaaatggcaaactgacaaacgtgtgttttccttacacctaaaatgtctcatttagtttttaaactctgctgggacataaaatggatatttgtgaggtaaatttaggtgttagaaccaatgcaaatattgcaatgaaggaaggtttttcttcaaaaaatcttaatttgaagttaacttatttgaaaattttattttgggccatgtgcggtggctcacgcctgtaatccaggcactttgggagtccgagtggggcggatcacgaggtcaggagttcgagaccagcctggccaacatggtgaaacccgtctctgctaagaatacaaaaattacccaggcgtggtggcgcgtgcctgtaatcccagctacttgggaggcggaggcaggagaatttcttgaacccaggaggaggaggttgcagtgagccgagattgcgccactgcactctcacctgggggacagaacgagactccgtctcaagggggaaaaaaagaaatttgtttaaaaattttagtaaacagttggctgagaatcacagaaatgtgaatcacttctagccgtgttcttaaccagctgcataaccttgaataggcttcctatctctttgtatttcagtttcctgatgggaagattgaggagtctgtatgagataatctgattttgttacctagttagtatacttgggaatcatgtacagggataaaaaagctgagaaagccttctgagtcaagggtgtgtgtgtgtgtgtgtgtgtgtgcgtgtgcgtgtgtgtgtaaaaaacatatattgtcttccaagacactttttaaaagggtaaattaaattcatttgaacgtaattaaagcagtaacattaacgaaaacaaccttaggcagaccttaaccctggcatacataaactacctaaataagagagcacgttatgcccagcacaattttcaagtacagacggtacaaaatcctcttaaaggccataggggctaaattgttaaattcatttttctacatttcagggaaagagataaatcctttgacccaaggaagtcagtttttattatggttctgtagtttatttttggcatacattcacaggtgtgcctatggctctattcttaatccctttcctttgggatggctgcaagagtagtacaaacttgtaactttgtaatttggctttttaattttttctgtgctgcactggaattatgttttgtcttaagtccacactggatcctcaggatggatccagtgaggattttgaaagaagcataattcctttgacttcttttagaattaatttacctattaaataaaaaggaaaggattcatcttttattcgaattcctctgaggctaacaattcaatataaactgatgaatgctgtgagcattattcagacaatcacattcaatttgtgtgacagtaacagcatagccacctgaaggacagtgcaacaagggcacaggtatatgataccctttagaagaaaagcattacaggtgggtttatttgtttctggaaaacaaacaactccagtaggaatgtagtacatttttggctcttgtccatttggtttttgggattaaggtggttctattaccagaactaccaccacaacaccctggtatttttgggcagaaatttgggacactaagaaaacaactattttttattttatgtgtatagctgttagtggaagaaagaataaataggcatcattattgctctttaggctgtccctgattttggacacacacttattttttcagggctctcattttaatcagtagtccatcagtacctaatggaaacatctactgtgtagagttttggttgctgatgctagaatttaagactttggagtagtcgaaagacaacagagaaattcatctcataatttttgtattttaagcacatactagatttatcagggctgaagaacaaatgcccgatggtgtagttcatttattcatttatgaattcagcaaacgtttgtagctgaccccgaaaataccagttaccctgtttggctttggtgattcattgtttagcagagtgcatatagttcctgccctcctgggatttgtgatctgcgtttcttggaaatttatattgaataagtaattataaatgtgatgagtgttttgacatgtaaagtacttatggaagcccataaaaggggctcttaatttagcctggttgcaagtgattttgagctgagtttaaaagatgaaggctgaggaggatttaatatgctcacagtagaaagtaaagtgtttcactttacacatttattcccaaagctgggagttttgtctcaatattgggtcattattaagtttgtatttatacattataaatatacattgtaaaaatatacatttttgtaactagtacagagtttttagacagtctgctctgttgcccagggtgaagtgcagtggcatgatctcgactcactgcagcctgtgcctcccaggttcaagctattcttgtgcctccacctcctgagtagctgggattataggcgcacaccaccacacccagctgatttctttatttttagcagatatgtagtttcaccatcttggctaggctggtctcgaactcctgactaaagtgatccacccgccttggcctcccaaagtcctgggattacaggcgtgagccactgcactggcccacccttgttttatttttgagttgggttcttgctttgtcacccaggctggagtacaatggtatgagcatagctcactgtaactttgaactcctgagctcaagcggttctcccacctcaacctcctgagtagtagctgggactacaggtttgcactgccatgcctggctaagtttttagttttaatttttatggagatggggtcttactgtgttgcccaggctgttctcaaacttctaacctcaacgtgatcctcctgccttggcctcccaaagtgttgggattacaggcatgagccactgccagctcaggcatttttatttattcttttggccaatgatcagagggccgtgcgattaatttgttaattgagaatatacatttacacccaaacagtaaacaaaattgtttcctgttatagattttagtcataattgaagtaatattcctgtatatgcttgaaaatatgagctatagaaccagaaccaaggaaaagatgaagaatggataggatagtgagagctgctttaagttttgttttaacattttggaaagcaagggttttgtatcctgcggtagatctcaatttgtttttcgtttacaatatacctgtgaaatcttacatatcatgtgctgcataatagcattttggttaaagacagacagtgtgactgtggtcccataggatttgtatacgtttttgctatatcttttgtatgtttagatacccaaataccattgtgttacagttacttacagtatttggcaccgttacatgctgtattggtttgtatcctaggagcaatagaccataccatgtagcctagttgtgtagttgactacaccatctagtttgtgaaaatcatcctatgaagtttgcacgatgaaatcacagaacaaagcatttcttagagtgttgactgtgtttccatcaataactataactcaatttgtcagtagtaattctcgttggggagtggtgggacttacaggagtgggtcctaacaggacttagaaatccttggaaaaaaaggtattttaatatgtctgagaatagtgatggccttcatattagcagttgtcactgacaggtgatattgttacttaaactggcatgatctgaacttttaaagtatattctgtgtacaactttctcttttgcagcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggttagtatcatattggccattttgaaagtagtatcatctttcataaggaggactgcttttcctagagaaaagaccaatagggtctactccgtttaattcctcactttttggtcttgttttttggtttgtttctcatgcgactctcttaccagtggctactctaatggtggtttgtctgaacgtcagaaagagtatgtcagaataccaaagacactctgcttctgctgtaagcagattcatagctgcttcttcctgtttggctagagccagttctggacctgaaatcttacttcccccctctctctctgcttggtaccacaggtgagtactccatccacctctggcattagccctgtgcactcattcagccaactctgttgggactgtctcttcctatgggatttgcttacccaggagttagatggcaagcatagggaatgtctggcacacagaatatatggaattagtgttaggattaggattttaggtactccacagtcagaaagacaggaaaatatgaagagctgtaagtctagggcaggttataggggagaatgcaaattttgatagctacatcatcaaggattaaaattttggtgttagttttgtctctgtgacatgtagtcatctagtcttaatgcttatgccttcaagaagttccttttcatttccctccctttatgcctaatgctcagtctcttgcactagtttcctaagtagtcttcttttatatctaccttgtacactgttgttaaaactggtattgaaatgctcttttactcatagtactttattgctgctccaaaatttttaatggcagcctgcttccctagaaatgatgacattgaatgtagattgtgcttggagcccctgggattggcaaatgtttttttaagaagccagatagaaaatattttaggattccaagccatgtgatatcttaactactcaacttggcccttgtgggaaagcagccttaaataatacctatagaaatgggggtggctgttctcagtaaagccctacttacaaaaacaggtggccggctcaggctgtagtttgcaaaccctgagaacttgacagcaaaacgaaaagagagaatagtagttaggacagaacagaatcgcgtaaagttttttccatataggtgagctctgataatgtttgtaggtagaaagaaagaaacttgtgaaggagagactaaacctgtttgatggattgggttgggggccaggttagagataggatcaggtgtatgtgttgttgaattattcctaaaaaggaagagagacactagtaattgctaaatcatcaaatatttgtagaggtagaggagaaagaataaattcagatggattgaggcagatgagagaacatatggggatgtgtttgattttcttaggaaaatgaaagcagaagtgggagagggcgggggataattggaagcttagaatgtggaagggatgtttaagtgctgtggggaatactttgaggcagtggttaccagtattttgaagatgacaacctgtgtaactttgaaacaatttgtggaccacccatggttgtagttatgattttagtattcaattgagaaaatgcatattagaaagaagctactactcttacatgactttgtgttttattaatcacaacattgatatgtgagaaatagtgtttataatgcgttgctctaggtacccattaaggtaactaattctgcagtttcccaggaggctgaaggctcttaagttggaaatcattgcacttgagtgaatcaacagtaagagaataaaggattgtttagaagtagtattcagtcaaaattaaaatgatgtgaacttgtagtgaactcactttgaaggattccataactttatccagtaatacttgtcagcttggagcaagatgacagaaacaaaatgatcttgggttaggcgtaacactatagaaggccaaaataagcatttagcttattctttctctaaattaccttttcctgagatcacacctagtttcattaatcacttctgtatttatggtcatcaaattgtcatctccttaaccattttgttgatttcaaattctctgtgtacatctacagaatatttccatttgggtatcttactgtctcacatttgacatactgaaaagaaagcttgataacttgaaaaaaaagcttattatctttcctttgaaacaactccctgctgctttctgtttgcactagagaatctacagacatgctaaagttgatggcacaatgtggataggttgggaaaaacatgaattaggtgctggatttagtgaagaaatcgaactgtgccatatttggcaaatgatggtgatgagaaagtagagagaaccttggatttgttttctgttttagccaaatagaattaaattctgaatttttgaaaattaatttacttgactcttataaactcttacaaatactcaaatatatattctccattttatttccttgatccactaatgctgtaatcctatttccaattaataaacaacatatttagtactgatgcccatttaagtgtggtgttactctgtaatcactatccctctcataaaactatctggggatagattggttcatataatctttagagagaagatttttctcatttctgtaaaagtgtagagaaaatctcaagtactttagaaatgcctattgttaaacagtatccataattattttgtgttctgtttccttgacctcactcaagaaaaaaacaaaatatctcccagaattatggcatactgaaaactgcagtatgacataaaagaaaagactacaggctccttgaggttgggtcttttccatactcataaacctgcttataataatatttagagtaatttcttggcacatacattacctgctttctcatcaattgctaaatcatcaaacatttattgagcatctcctctatgtagggtataagtaatgctgaggtagtactcgtgacttacagtggtaaaagacttaagttttaggccgagagcagtggctcacgcctgtaatcccaacactttgagaggccgaggcgggtggatcacctgaggtcaggagttcgagaccagcctggccaacatggcgaaaccccatctctactaaaaataaataaattagctgggagtggtggcaggcacctgtaatcccagctacttgggaggctaaggcaggagaattgcttgacccaggaggtggaggttgcagtgagctgagattgcaccattgcactccagcctgggtgatggagtgagactgtctcaaaaaaaaaaaaaaaaagataagttttagccttgaatgacatagtgtttcnnnnnnnnnnnnnnnnnnnngattagtgaatttgagataattcataagtctgtgaaagacaataaatacatacatattttacatttactattactaaatttgtagtaaatttgagtacagcactacctctttatctgtgaaaacttcagactctcccctattactttaatttcagtgagacattattatattaaaaaaatggccaggcctggtggctcacgcctgtaatcccagcactttgggaggccgaggcaggtggatcacgaggtcgggagatcgagaccagcctggctaacacggtgaaaccccgtctctactaaaaatacaaaaaattagccgggtgtggtggcggacgcctgtagtcccagctactcaggaggctgaggcaggagaatggtgtgaacctgggaggcagagtttgcagtgagccgagatagcgccactgcactccagcctgggtgatagagcgagactctgtcaaaaaaaaaaagaaaaaaaaaatacaggccgggcatggtggctcacacctgtaatcccagcactttgggaggctgaggtgggtggatcacttgaggtcaggagttcgagaccagcctggccaacatggtgaaaccccgtctctactaaaaatgcaaaattagccgggcattctggcaagcatctgtaatcccagctacttgggaggctgaggaaggagaattgcttcaacctgggaggcggaggttgcagtgagccgagattgtgcaactgcactcaagcctaggcgacagagtgagactcttgtctcaaaaagaaaaagaaaaaaaagaaaatgggcgtacacatttgttttgctctactgacagttaataccacaactcagaggcatttttttttcctttctattcttcttctaaatgttcaacacttttctgattttgtgatttgaggttgttgattagcttcctgaggctccattgagactgtatatacgtgacacttaacagtctagccttcctcggtgcatatagatatatgatggtggttttgcctgtagtaaattcatgtcaaaacataggctttcagtgcctattacatatgactttcagctctctctactgagggatgtaggagtttatttctgaggtctgagcctcttttcctttacttcctttattctttcctaagccttctttataaaaactatgcatgttctatcgtttgttttccttcttgattcccgccccttcctttttttttaattatccccagcaggagtgacttgtaattctcatatattagaaaggcagatctcctggtggaagaaaagatgcaccgaaggaagtcagcatatttagtaatttgtgagggggatctcaagtttggaaaggattgttatgtaagacaaccaaatgatgacatgtgacaataaagccataatagctacttattttcctggttagggaagggatattactagttctaggagtaactgctagctctttcttgtactttttttattgtggaaatataaaaatatacaaaaataaaatgttataattgacttcagtgtcccataaaccagcttcaacagttaccaatttatgtctaatctttcctatctatagctctgtgcccctctgttattttgaagctcatcagacatcaagtcattcatatatgtatgtatgtgtatgtgtgtgtatacacatcatgtgtgcacatgtgtgtatgcatgtatacacatttgtatacaagtgtgcactcatgtttgtccctcagtgtctgtgggggattggttctaggacttcccatggataccaaaatctatggatgctcaagtccctgatataaaattgtggaatatttgcatataacctatttacatcctctcgtatacttttaagtccggggtgtccaatcttttggcttccatgggccacattggaagaattgtcttgggccacacataaaaaacactaatactgacagtagccgatgagctaaaaaaaaattaccagctggacatggtggctcacgcctgtaatcccggcactttgggaggccgaggcgggcggatcacgaggtctggagttcgagactagcctgaccaacatggtgaaaccccgtctcttctaaaaatacaaaaattagcccagtgtggtggtgtgcacctgtaatcccagcctcagaggctgaggcaggagaatcgcttgaacctgggagacggaggttgcagtgagccgagatcgtgccactgcattctagcctgggcgacagagtgagagagactctgtctcagaaaaaaattaacaaaacaatctcatattgttttaagaaagtttacgaatttgtgttgggccacattcaaaagccttcatggctgtgagttggacaagtcatctctggattacttaacatacccatacaatgtaaataccatgtaaataactgttatattgtatttaaggagtcataatgagaagaaaaatatacacgttaagtagacatgcaattttttttggtctggaatattttcttttttttttttttttgagacacagtcttgctcttgtcacccagggtggattgcagtggtgcagtcttggctcactgcaacctctgccacctgggttcaagcagttcttccacctcagcttcctgaatagctgcgaatgcaggtacctgccaccatgcttggctaatttttgtatttttattttttatttttttaaaatttaaaaattttaaaatttttatttattttctgagacggagtctcgctgtgtcacccagcctggagtgcggtggcgttatcttggctcactgcaacctccgcctcccaggttcaagtgattcttccacctcagccttccgagtagctgggattacaggcacgagccaccacgcccagctaatttttgtatttttagtagaaacggggtttcaccatgttggccaggctggtcttgaactcctgacctcaggtgatctgcccaccttggcctcccaaagtgccagaattataggcgtgagccaccgtgcctggccagttattgtatttttagtagagttggggtttcagcatgttggctagactggtcttgaactcctggcctcaagtgatccaccggccttggcctcccaaagtggtaggattacaggtgtgagccaccgtgcccgactgaaacgtactatatatatatatgtatatatttaatcatattaccataggtaaacaaattcccggtaattctttcatcatcacatacccagctagtgttcagatttcctacactggctcctaatttttttttcttacagattatttgaattcgatccaatccaggtattgtaattggctgttaaacttaagtatcctttaatgtataggttccccttaatctcttcctttttttaatttcttgtaatttgttgtaatacctagattctttgtcttctagaatttccaatggtctgaattttatagtattgcttaacatgttctactgtcctctgtctttcctgtgaattggtagttagatctagaagcttgattaaattcagattttctctctgttgttacatcatcagtttgacacacaggttcatttgtttcactttgcttttgatatgttattttttggaattatcttttaaaaatttggttttcttttataatcatgtaaaatgtgtataaggttccagattcaaatcagcaaaacatgataaaatctatccagagaaggcaaaccttctgtccagtcgccatcctgttcctgcccttccccttatgagtaatcattaagagaaaattgttggtttgtccttacatgtgtatatctttgtacactcttgcccttgttttttgttggttgttttttgttgttgttgttttattttttgagacggaatttcgctcttgttgcccaggctggagtgcaacagtgcagtctcagctcaccgcaacttccgcctcccgggttcaagtgattcttctgcctcagcctcccgagtagctaggattacaggcatgtgccaccatgcccagctaatttttgtatttttagtagagatgggggtttctccatgctggtcaggctggcctcaaactcccgacctcaggtgatccacccacctcggcctcccaaagtgctaggattacaggcatgagccaccacacccggccctctttcttaataaatagtggcatactatctactcttttctctaaccttatttttttctcttagccgtatatcctggcgatcaatccatagtcctatgtaaagatatttaatatttcttatttctaggactatgaactatttttgtatcttctacactaatctgagctgggcacattaggcatgtaataaatactttttgaaagtgaatgaatagtaatttaaaatagttgatgactaatgcacttgttacagtcttaaaatatattttaaacaaataaataattgtctaattccactttcagaagaaataagaagttcttattcctgtttgtaattttttttatcatttggtaattttgaaatatttaggtttagcaaaaaattaataggctcaggttttaaaaagaaaaatgccttctgcaaaaggaacaatatggtatttttaagagttgaagaaaccatattagttcctggtttatgactgttatggtatagaattttgtgtcaatgtagagctccttcagtatgtgtaatttggcacacaacccctttagttcgtcagcatttggcacatcggggatacctaacaaattgtaggtaaatttgtttatttatttattttttcccttaggtaaatttatttgcagttctgcctttgtgtatagagtagagctctttacatagtattatttaaagtgaaataattgcttgactaaggtaaatggcttttgaaactgaagtaaaattatggcttcaacacttatggcagaaagtgttttaactattttgtgttaaatccctttttctcccaaaactatacacacagaagttttggatataatttcaaaggatgaagaactcatctagaggccattgttgaattcctggcattcattaggcactcaaccaagactggatatctaattaaaatttgaatagagtgggttacctatttgaattttaggttttctagtaaatcattttgtttgatctaggtctttacatatgtgtttttttgtttgtttttcttttcctgtgtggattagtttctaccttgcctggctgatatatctacttatctctcagttcttagtttgaaaggtcacttctgaatgaggtgtaatggtcataggttctcaattagtggttgttattgggtctgttacagctgtgcagttggccaactttgactttgggtaacttaatttctttattggtaaaaaatactttttattttattaaagtcataaagaaaaatgagatattgggtaggcttaatgtcacaggaaaatattttgataaaagtcttcatagttacacgataggttcatgatgattgtggcaaacatgagcttatagcttccacttttttgttgttgtttgttgttgttgttgtttttcagacagggtgtctctctcccaccccacccctgccccacctgcaatctctctctctctgtcttgctctcacccaggcaggagtacagtattgcagtcatggctcactgtagccttgacctcccgggctgaagtgatcctcctacctcaacctcccaggtagctgagactgcagatgtgggccaccatgccctgctaattttttgtatggagttagatggagtttcaccattttgcccatgttcaccatgttgctcatgttgctggtcttgaactcttggctcaagcgagctgcccacctcagcctcccaaagtgctgggatttacaggtgtgagtcaccgccctggccccacttgatttttttgttttgtgttgttttgttttgtagagacagtgtctcaccatgttgcctacccttgtcttgaactcctgagctcaagctcccaccttggcctcccaaagtgttgtgcttacaggcatgagccaccgagcctggccccaagttgcttttgaacaacatgtctctagtatggtgctatccttaaagaaatttaatttggtgacattttatgatctgctagtttatgacattgaacttaattctgaaatcttaaaatctttccaaatattatttactgggtgctgacaacgtacaagccactgtaccattaaggtattgggattcaaaaattgccatgtactttttgcctttagaaatcctaaaatgcatgacagtatggaaagttcactgtaaaaccagagttaaatgcatttctacaaatatatgagatgctccagcagaatacgtaatcattccaggtgaatgcagtagattttttaaaaagattaaaaagtagataggcaaagtacaagactgaattgaaaaggaaccctttgaatttgagtttcgaaaaatgggtaggacttgaagttcaggttaaatgcagctaaaaatagaaggtgaagcccttagtagaaactgaagactgtatgtgccattcatgtttatatgtggctggatgtgatgaaatgttttaatagtatatctttttagaagccacctctgcctaaacaagaaaggattatttat

SEQ ID NO: 1547 - DNA, 1037 bp, Homo sapiens
tgtgttgtccccggaagtgccttccctcccgggtctgcgcggacgcggcctccttacctcatttgtcctcgcccctccccgtccctctacgcgttttggttcccggttggtgcttcctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctggtccgtcacctgcgcgccgccccacgcggccgggctgcgggtctagggggtccgcgtctccctggctttccaagggctaatgccgtgattctagagcggctgggcgtctagggcctcgcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaagg

SEQ ID NO: 1548 - protein, 206 aa, Homo sapiens
  VARIANT (1)...(206): Xaa = Any Amino Acid
LFMMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEX

SEQ ID NO: 1549 - DNA, 25469 bp, Mus musculus
  misc_feature (1)...(25469): n = A,T,C or G
gcctggtggcactgttttatttattactgtagcctacagtactcatatcctgtttccttgcttcagttgaaagataatatggcactatctagaatagtgttaaactcttaattccttgcttacagtttagatatgttgtctgtgtgttggtgaacaaagttttgttctcctgcctacatcttttgggagacttcctggcacagtgagttctctgctggggctgtttttgctctgtgtgtgtgtgtgtgtgtgtgtgtgtgtgtctcacagattgagaccacagaatggagactgacgggagtgaggctcgcacaggagtggaagctgccattcccgagaggtgctttctttagtgagagggagacagaaaatccttttccttctatggaacagtagagcctgaaggggcaagttcatcactcaagccaggaaaacatctccgcttcactgaccggcgccaggcctcacagcttgggagaagcgacctacggtaaggaaatagcattgctctgcatgcttatgggaactgttagaaaggacaagaagtgcagaaccctgctggagcccgatccagccagctgctgaattctccatccgcaagtctccatcctcactcctctgaactggcgctgccagaggcaccttgggaatcccagcaggttcctgttgcaaatggccctcaccaccaactcattgtctctgcatgcacggctcctcccaggggctggcgttaaatctgtactcacttaaggtgttagattggtgtcctaatccctttattttgggaaggggccaagttactaaacaccttgacgtttgggcctgtgctgttgatacctcatgcagtatcaagtaactgttacatcctgagtacatttgcatttggggaggtggagaagggaatgttctggggccagagtcggggttgacatatgtgaaatcagttggcagtgaaaaatgctgagaactctggtcacctgacccatggcgtttggagtgagttttaacaaagtgaacattaaacgattttacatacaaaattcgactttatgactcctctttcctcagccactgctgtcagcttcagatactgaacacacgtggagccattttggacacagttgttactgtgcaatagcttgtgtttagaacagcacataatactgatggcatgaattctaggttcgtttgttttgttttgttttgttttgttttgtttttcaagacagtcttcaagacaagactctgcctctgcctctgcccagcctgtgctggaattaaaggcttgcaccaccaccacctggctaaggaatttttttttttttaaagatttatcccttttaattctttttatgtatatgggtgttttacctgcgtgtgtgtgtgtgtgtgtgtgtgtgtgtgtgtgtgtgtgtgtgtgtgtacactacaccacgtagtgcccttggaggccagaaaagggagcggttgtgagccatcatgagggcaatggaagcagaacctggggtctcatacgagcagcaagtagggctttgtttcttttgttcttttttttgttttgttttgttttacgagacagggtttctctgtgtagtcctggctgtcctggtgttttgttcttttaaacactttatagtttatatatctaattttagcaagaaacaatttaaaatgataacactcttacattaacaataaaaacaaaatagaattctatttattttcttatttatttacttattggtttcttgagacagggtttctctgtgtaggctgacctcagaattcaagaagatccacctgcctctgccttttgagagctgggattataggtgtgagccactatgcactattttaaataattgttactgactgtttataaatgtttgttatggtttttcttaacccagatagctcccaaataattgagtctggactatttattttaagctttaagggcacaacaactgagcagtattactccatcttaatcctctaaactaatctggctgcctcctaggcaaacactagtgatgcttgtgttttagtgttcatgggctccctggctccaggggttttctcctgtctcctggaccctcttcctgaggtgaatccccatttcctcttcctttccccctcccctggctaggaggaagtccaaccctatttattcccctgctcagtcactggctgatcagcttctttattgaccaattggaataattggggagcaatgttttgcaaccagataggggtgcatagaaatcagcatttgaacacaaggataatctttacacagagcacaataacattatgcctacaggtaattcttttttgttattttttttaaatttttttttaaagatttatttatttattatatgtaagtacactgtagctgtcttcagacattccagaagagggagtcagatctcattacagatggttgtgagccaccatgtggttgctgggatttgaactctggaccttcggaagagcagtcgggtgctcttacccactgagccatctcaccagccccacccccccttttttttttttgaaggagggttcctctgtgtagccttggctatcctggaactcatagatcatactggccttgaattcagagatccccttgcctctgccctcttgagtactgaaattaaatgcatttgccaacttacattatagcaattctgttttttaaaagatttatttaatattttatgtatatgagtacactgtagctgtactcaggaccttctgaagaggagtcagtgctcttaaccgctgagccatctctccagcccatagcaattctttaagaggtttgggagtgttagagaaatggttcagctgttaaaagtatatactgttcttgcaaagatcctaatttgggttcctaacactcaaaatgagtggctcacagtcacctgtaactgagattgaaggtgtgtgccaccatcacccagcaaaagctcaaattttaaaaagaaaaaaaaaaaaaccataatccagcaacaatgaaaaattcacacacaatgtaaattgtaactcgtaagaaatcaatcgggggtggggggaggctggagagatggctcagagattgagagcactgactgctcttccagaggtcctgagttcaattcccagcaaccacattcttgtgcgcgtccgacttgccagcaggaacgatgctgcaacaggatccttctgcacacgtttatggggagagcttgattgcagaggcgaagagaccccaagcccagaactggtgctgcttatataggcctaggagaggcgagtctcacacccggattggttatgcattctacctcatttgcatgttcctcatctgattggttattctctcagtacctcaaataacctcattatcatgccggggccaggcagtatcttggcaaaaaactttactgcatatgtacatattgattgtttgcccaaacttatgcgtggtggccagtggtagccagtgccactctgaaacagcacatgtggcttcccacaccacatggtggctcaccgccatctgtaatgggattcaatgccctcttctggtatgtctgaagacagctacaatgtactcatatgcataaaataaatctttaaaaaaataaatctgatcttaagaaaatattagtttataaaaatttaagccggaccatctagagactgtcatatccagggatccatcccataattagcctccaaacgatgacaccattgcatacactagcaagcatttgctgaaaggaccctaatatagctgtctcttgtgagactagaccggggcctagcaaacacataagtggatgctcacagtcagctattggatggatcacagggcccccaatggaggagctagagaaagtatctaaggagctaaagagatctgcaaccctgcaggtgcaacaacattatgaactaaccagtactccggagctcttgactgtagctgcatatgtatcaaaagatggcctagtcagccatcactggaaagagaggcccattggacacacaaactttatatgccccagtacaggggaatgccagggccaaaaagtgggaatgggtgggtaggggagtgggagggagggcatggggcacttttgggatagcattggaaatgtaattgaggaaaatacgtaataaaaaaaaaactttaagccaggcatggtgatgcacgcctttaatcccagcactcgagaggcagaggcaggcggatttctgagttgtaggccagcctgatctacaaagtgagttccaggacagccagggctacacagagaaaccttgtcttgaaaaaccaaaaaaaaaaaaaaaaaacaacaaaaaaacctgttgataagatcagttcctatcctgaaaaacaacatgacatcccgaagcccaatagctttaggagcaacctaatccttatttctcttttttgaaggggacagtgtggagatggtgtgtgtgtgtgggggggggggggacgggacagcagagaagaatgaacccgcagtgtgtgcctgtaggtgatggatgtggctttaactgaagcagtcccttctgttaaggatcctgtcagcactggcagcataccacagtcaatctagatcaagactagaattagctctttcctggcttcattccatacggcccatatttagcaaagttttggctttaaaatattcctggtatttaatatttacatagtctaactggttacatgtccttcttggaccaacatgcatgtgaaattcagttcagcagagtctgtgaacgttcctgtgttccaggggggttgggtcagggaacaaatgtcccagaactcctagagcaagtacctcatgcagtgactctcatcctacaggtcacaacccctttgggagacatgtatcagatatcctgcatatcagatatattatgattcataacagcaaaattacagttatgaagtagcaatgaaagtagttttattttggggctcactacactataaggaggtctcatttattaaggggtctcagcattaggaaggttgagagcccctgtcttgattagttttcactttgccttggcattggtattttcaggatcacaggtgtgtgtgaccctgccttgaaaattttagtttttacctccaaaacatcccaacgctctcttctgataccattagatgcgcactcccatattcccatccacttacactgcagtagcttcaccctcttgcctaggttatttcagtagcttgctttggtccccagtactaaaatcatcaaagttctaatcacagctgtcttagggttttactgctgtgaacagacataacgaccaaggcagctcttaattggggctggcttacaagttcagaggttcagtccattatcatcaaggcaggatcatggcagcaccaggcaggcatggtgcaggaggaacgctcagttcaacatcttgtctgaaggcaaacaggagaagactggtttccagatagctaagatgagggtcttaaagtccacgcctacagtgacacactccctttgacaaggccatacatacctcctaatagtaccactccctggaccaagcatgttcaaaccaccacaatagccaacattttgttttgaagatatttttgttttgttttttgagataggatttctctgtgtagccttggctgtcctggaactcactctgtagaccaggctcagaatcattgataactgtagattgttgctggcagcaggaagctcaggctgaggaccctcagtcccagtttctccacaggggctgcctgaggtgggtcgatgagagaaatcgcctagagtgacagtaacaggagctgccagtgtctgaaggccttttgtgtgggtggggggatgtggcatgtatatgtatatgtgtgtccagtgcatatatatatatatatatatatatatatatatatatatatatatgtttgattgctttggggttttttttttttttttggattatgaaagatgatctcactatgtagttctactggtcgggaacttgatatgtagaccgagctcaaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggactgtgctcccaaactgggtcagagtaaaccctcccttcctgtcttcctgccttctctccttcctttctttcctccctccctccctccctctctcccttcttaagcactttgtcacagcagcaagacatatgactaaaggaaggtgtcctttcccatgcaggagctcaaaactaaggtgtcacaccacaccgagtctcactgagcccagaatgcctactgacagagacactgtgatggtgtctgacaagggtgaccagccttcatgtccatgttggatccaaggttctctccttgtgacctccccctaaccccagggactggttactagagcctcctacccttctgggtgttgtcccaaatacatgtgaggaagccgagtcagacttattaggtgagcactgagcggcaaggacacgaagcaacagctcacgaaaaatctgagggatgaaacagactatgttcatggaggaatactaaggatcactgccctgggggactctgcagccttctctggagtaactcaggtgagcatcctcattcactagacaaggtctgtacaagaagcgctgtgttgaggccataaacttcagggtcccataggcacatgctatccatcgcagtaaccaccggttacgtggagcccttgaaaatgtggactgagggtgaagcacagaagtagaccactttcctaaaatgaaaattataactgaagtttatttaaaataaattcaataaaaatcgtaggcagagggctgaagagacgattcagtggtcacagaatacattactcttctagaggaccagagttcaattcccagtggcttacctgtaactccagctgtcttccttgagtggtgcaccacaaaagctgctgcaccaagaacgctgttaaaaaagcaggggcaggcccctccccctccttaccaccccagcctacagttgctgcaataaaatgtcctacaggaactgtccaaaatggctgctcctgtcaaaatggtggcactatggtatctcctcagcctacagctatcacaggagctgtgggagctgtccacagtgatggtccctttcctgcctcagcctacagcttttgtgaaaactgcccccagaggagctgtctacagtggcagcagctcctctctagccccgcccccccatatacgtatacaccagcagccatacagagctgacacctcagcaaaagccagctgcagctgggaaggacttcccaccctgacccttgggcagcatgtggggaagaagagttgaaaaacaagaaaacctaccaatccctgagcttcccacaaaacaaaacaaaacaaacaaacaaacaaaaataccaatccctgagtccccaagctcaggacttgaaatctcaccaatccccactctggaagtctctgccccgagaagctctgccccctcagaaatcctatatcagcactgtcccttcgacagttccctgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctcctcctgaattcttcccttcaataaacctcctttatgagatttgctgcctggagtttctgaagaagctgagaagaaaggaagcaaagaaaagaagagttagcagggctgaggctcctcagctcctcagctcccctgggagctgtgctgcctctcctgaagatgcaacctcagacctgtgaggttcctgagctgtatctcaagatacccttcctttggaactctgtcccacctcagagctgtgaggttcctgtgctgtatctcaagatacccttcctttggaactctgtcccacctcagagctgtgaggttcctgggcattggggtcccaggatatcctttcatccgagcagaaaccagttgcaggggatccaactcctctggcctccatgggcacctacacacataatgcacacgccaacaacacacatatacacacaacacacacacaattaaaaataaaaaaaaaatccttaggcacagagttggagagagagctcatcgtttaagagcacccccccccccccgctctagcagaagccccagattccgttctcagcacccacaaagtggttcacaatcacccataacttcagttcccgggaataagaggccccacttctgactcagtaggcactaggtgataagttatcttggctgataaaatgagccaagccaagccaaattaaattataaaggcaggtttgttggggagagttcttgggtgaattcatgggccacacaacacacagcagggggtcagtgaagtgcagagggagacagaggagaacaaagaaaaaacataagcacagagagggggggagagagggagagggggacaggaagagagggagagagggagagagtggggnnnnnnnnnnnnnnnnnnnnnnnnnnnnnnnnnnnnnnnnnnnnnnnnnnnnnnnnnnnnnnnnnnnnnnnnnnnagagagacccaaaagtctgtgttatatagttaaaagccactgagtgaggggaaacccagcccctgggctagaaagttcagcatagagggcaaggtatgccagccatgccccgtaacaggcagggactgagggctgctgggagatcctgaaggccagattcactgttatttacttcagctacttgtcccagatctgaaacccaacaccccagccttttgttgatagtaaacgaataagggacaacataatcttatatggctactctgctgacattgaggcgccattattgggacatcctaaagctgaactgttggccaggtctgggaagagagcagcgtgctgcccagcctctgcaggacctctgggactagggatgtgaaggcccagctgaagcagtttggacctgtactggatgcaggtattgaataaacacctgcatctggcaggatgctgagagacacacgtgtttggggcaaaagataaagttaagaagtttagagaggatttttttcttggctgtacatttgaaaactttaggcccatggttttggtactttgagggggggggtggatgacccagaaccagggaaaggggactagatcccaccctcaggggtctaaatttaaatttttgtttgtttgtttttttttgagacagggtttctttgtgtagccctggttgtcctggaacttactctgtggaccaggctggcctcaaactcagaaatccggaggtagggcttttatatgtaggccaggatggccttgaactcacaatcctccagcctcctgaacgctgaagttaccagtttaagctatcacaccctgtcatttgttgctgcagtgttgggggatgaaatccagtctggctctactcattgaaccacaagcccggctctcaaggggcgtggagccgggcctcggccttgcgaacagaggaagtccccgccccggttgccagggtgctctgtggcgtcgcattctcattggccggcgacggatgaggcgcgcagcaggaggccatttccaacgagccagcgggggcaaaagatggcgacgccccttgggtggtcgcaggggggctctggatcagtgtgtctcgccttcgatcaactgcgggacgtgattgaatctcaggaggaacttatccaccagctgaggaatgtggtaggcagccagggcttggggaaaggccgcgctggacgcctcaccggtgggggcagggccaggcgctcgtggatgtaggggccgtggctagtatacaccgtgaagggggtcatcccagaggctgggctcacctagccaggggcagaaccaagaagacggctgctttcctgaacgttaccaaatcgggcaatattccccactctgcctggttggtgaagggactgacagataaccagtgaacttcagtgtctccacgtttagcggtagagacctcaccgactccccaaggcaacctgcgcaccgaaaccagatcattccttaagccgcacacctttccagtgtcaaaagcagtgcgaatacaagcttggcctttcacggtgcagatttaagggcctccaaactttcctgtgcctttgtttctaacctcagttagttagtgggtgccacgctaatggcgtcatagttacatcagtgccgggtccgctggaggtcatgggctttgtggttgttgtttctcttttggtaacaatgttggaatgcatctctctctctcaaaacaaacaaaaacaaaacaaaacaaaaaattggtttcacatctattttccactctaatgatttttagacagtgtcatcccttctgagcagttagattcgagggggattattactatatgtcaacaaagtgtatgccaacatgggcgctgaattgccttcaagtcccagaggatccccagatctttctcttggcagctcactcctactatctggaacggtttttttctctctcctcatcctatttagcagtccgatctcaggattaatgttattttctcagagagcagtcctgatccttactaatgctgggcccaggggtccctctgtgtaccacagccccctttgtccttttgcctaggacatacagtgtaaagagaggactggttttgtgtagtctccatgaggctagttggtctttgtaggcagcactttgagccaggcctcagtagatctgtgagactaaattctcctgtcctaaggcctgtcaggacctgtgtgcctttgacatggctccattacccatcctttattctggtccttagagggcgtccccctcccaccccagcccctgtcccttcctgagccaggctctgttgcagatggttctccaggatgagaattttgtcagtaaagaagaattccatgaaatagagaagaaactggtggtgagtagcctcctctgctcactcctcccacttcccgagttccctgtggctgggcagaatccttgagtcttggcctttcagaacttcagccctcctagcgaggctgcatcttcctgcatcctagctgcagcatgcacctctgaaaagggggttagttaagagatcctaagagacccagggtggcttgggataaagcgagccatcacctccctggcaggaggagaaagctgctcatgccaaaaccaaagccctcctggccaaggaagaagagaagttacagtttgctctgggagaggtggaggtgctgtccaagcagctggagaaagagaagatggcctttgaaaaagcgtgagagagtgggcctcaggagggggcttggagcttggggggctcacctgcctgctgcctgcccaccctttcggtctaactttcccctaggctctccagtgtcaagagcagagtcctgcaggagtccagcaagaaggaccagctcatcaccaagtgcaatggtaggcgggaggcccgtgctgccccccaagttaacatacacgggctctttaccaacagcccaatgacggtgccaaaagcagggctctaccccaacttctgcccccggctgaggatacaggcaagtccagtccttcgaaagtgccttcagggaccaggcaggtcacggaaatgatggacatgatcagatcagcgtgcggtattcttcacagccataaaggaacgggctcgctcccatttttcttgaaacatacaaccttcttagtccaccttttgttttatcccatttttgataagtgttagaaatagtatattctatttgtaaccttgcttcaagaggagccgtagagcaaacacaatcctacaaggggtcttaagactcagaatcaaaggactctctcgggttcgagactggggttaccagagccatgcccctcctctgggaatagagcctaggattgtcagatctttttttttttttttttaaagatttatttatttattatatgtaagtacactgtagctgtcttcagacactccagaagagggagtcagatctcgttacggatggttgtgagccaccatgtggttgctgggatttgaactccggaccttcggaagaatagtcgggtgctcttacccactgagccatctcaccagccccgtcagatctttaaaaaaaaaaaaaataataatctagaggccagatgttgtggcacatgcttttaattccagcattcaggagatagaggcagaaagattgggagtttgaggccattgtgggctgtgtaagaccttgtctcaaaagcaaaacaaaacaaaagaatctagaagtcaattttaatggaaacttctgaattgttagtgtaggcaactaacttaggcagtttaaaagcagtgtattcactgagtgaactatgtctgggccactgaatttcaactctgctaaaggcatgctcatggcagagttgaaaccaacctgagcccaagagagtgacgatccctcctcataaggctcccacttggggctctgggcagctttcacccacccacagccttctgtcactcctggtgaacattccctgagaattgccatcaggctagtctcttgatgagggcaagcaggctgacaggcatcatggctgtttgagcaaggcttcctgaagcctaatcggtagtcgctgtctcatacccagtgtccctacacctctcggtcctatctgcctttgcacttcccctctctggaaaacccagagaactggagttatatcctggtatagccagagacaccttaccttagggtatctccttctaccagaatcagcccaggctggtgagaagccgggtctgaaaaggcagctagcccagcttgctaacactgccgcaacgcgagccttcctccagtgcagccttatccttccttctctgatcatttcctcttctgtctgtcttttgtttttattttcctctcttcttgctttggtgcaggaaatcaaattcaagaccctcactaggcaagagttttagtaacaagccacatcatcagccttcaactcttcagcatttatttatttatttgttcactcactcattccttccttcatttactcattctgctgagatgggggtctcaggtagcccagactgtccttaacttggtaaggtgaccttggacttcccatactcttcccagtgctgggattagtagcatgtgcctccactctcagttcagtttaagttttgtttttaaggtttatgagtgtgactgttttgcttgcatatatgtgtgtccaccatgtgtgtgcctagagcctgtggagatgagaagagggtgccagatccccaggagctagagttagcatgtttacaaactaccataggatactgggaaccaattcagggttccctggaagagcagtgtgagccgtcttaactgctgagccatctgtccagcctctagttcctgagtccgactcctccttttgaaaagttaggcacatgtctggcataatcaaggacctcccaccagaggccctgtataacacaagcctgggcatccgtctgctcttgataggtctggcttaaccgaaatggccaaacttgcttttttgttttgtttttcaaacttggtactttgaagcccaaagctcttagggacatcttgttcacagtatacagatctatgagctaggctctgttaggtgtaaaggttaacagtgacaaaggcaatagtccctgaccccgtggaccttatgtcctaattgtagaaaaggccaacaattgatggatgagacactttggacattggcacaaggaaaacagggacaggagatgggaatagaacatactgggaagggctgcagtttctagaccaagggtctaaccatggaagtgtaaagtcctgagggccagccagagctatgacagggttctctgcttctctccagggagttttgcccaccctcacctgggtgaggttcataatacagtggtaaagttactgacagaatcgttttccctactcaggagacccccaaacatttgctgatgtggcagggtcttgtggtgaacaccaaagcctagctactcaggaagctgaggtaacagaaccaaaaatttaaggcctgacagtattacagagtgagtttaaggctagtccggtcaacttaatgagcctctgtttcaaaaccaagcagaaagtggagatgggtgtggtggtggtgttgggaaggaggctgaggcaggtggatctcttacagttggggccagcctgttctacatggcgagatccagaacagccagagctagtataatagaccctgtctcaaaaagaaagagagaaaggaaggaaggaaggaagaaagaagaaagagggttgagtatgggttgggaggtggcatggtagcacacctttaatcctagtacttgggaggcagagacaggagttatctctgagttcaaggccagcatggtctacatagtgagttctaggacagccagggctatatagaagatccccccccccccccctggagctccgtggtggagctcttactgatcatgcatgaggccttgggttcagtctccaatacagaaagccaggctccttcatactaaggtacaggcatccgttgaagaagaactcgtgggcagggagagccagacaaaggaagacctcaactcagaagcctgagggtgggaaccacccctcctccctgcctctctcccccacagaaattgaatcccacattataaagcaagaagatatacttaatggcaaagagaatgagattaaagagttgcagcaggttatcagccagcagaaacagaatttcaggtgaggggctgggccaggctgggggttgttgatggaagccgggagcctgactcctggcccctacgtagggctgtgcagcctacgaccagctggctccattgcaggaatcacatatctgacttccggatccaaaagcagcaggagacctacatggcccaggtgctggatcagaagcgtaagaaagccacaggaatgcgtcgggcccgtagccgtcagtgttccagggagaaataaactgctggttatcttcctgttctctagctgtaatgcccaacctctctaccttctctgtcctggggagaccagctctctcccattccatccctgtgggtccctcacccctccatgagcagtggcactgtctgtctgcctcctatagcaaatcaaggcaccgagggctacctgggagtcagctctggagacccccacccctgcacccgcctctactgagcttaagagggaacactgcccatgtcctcagcccctactgctgccctcctttgggatggggtagagccagtgagagtgagtgggaactgcgcctctgtgggtcttgctgggaccgtggcccagaaggcactgctgcttgctttgggtggttaggtttgttcctacatacacagccccagttagcccagtcaccccctacctggactggtaatgagaatatgtgtatactgtcggtacatatcacatctgcaccttcttacactgctgaacaagaaccttcaaacacatgaggaaactttctaaagcagggaaaggacagcctgttcaagttgctcaagcagatcagagaggatgaaaggttagctctgttcagaaggggtcactgagtgtccctcgggagtcgtaagtaggggagaataagacccacaaaactcatattggttaagtctagcctgtgctgtgtcactgtgaggctgtgtgcaaaggaggggcgggtgcatcaaggccagctggggcctgagtcacagcaggacggtcaagccagaagttaaggacagttctgtcctattgtctgtcataagacaaagacagctggtgactgcttctctatgagggaaggaatgaatttttttttgggggggggactggagtaagaaccttgtgggcctaggactttagagggaaccctacaaagactggtttgtctgccaggtttgttgggggtgctaagctgcttgtgaaagctagttagggaagaccctccagccttttcttcctatgagcctaaaagtctagccagcacttacctgagttaggagagccctctgatgatccttaaccctatcaaaggtggtgtggggtgtgtgagggaagtcgaagcataagggaggcatggaggagagtttgtgatgtaaaagagttggggggctgaggatatggacgatcctcacgctctgaacctcatctcggatgagccccttgcaaggcaggagttttctagaattggacctagctgctgcctccttactaaataaagcctgccttcctctcacatgcctgtcggccggagtccggagccccacctccacgctgcacctgtgttggagaaagttcggcatgggggcttcacccctaaaagcccacagcttaggtttctctgctgccaaggccgctagctcaggcgttgacgctggcgctttaagacgctttgaccccgcggcatccaggcggggcggggatagtgcaggagccaccagcggaggcactgcgcgggaggtagtgctaggtgtcctgcccaccatgctgactgcgctcgccccgctagcccttcctgggctctcaaggcggctgcctgccccagcggggcgtcaggactcgtccggttcgtccggctcctaccacacagctccgggttctccggagcccccggacgttgggccggacacagaaggccgggggacttggctctgggtggctcctgggcggggggcgggcgcgcagcctgtcctgtccgtcagcgcccagaatagccgccagcagcacggctccggctcgggtttcccgcgaggcccgggctccggcccgctgccgccccggccccagctgcgcatgctgccgtcgggggagatggaagtcatcttcggcgcggggcctctgttcaaccgctccgacgcggaggatctgcaggagcaacagctcatggcgcctaccttcagcagtccccagctgcccgggccagcgtctcctgcctctgtctcatcgcagccgcaggtccccgacggaggctctcgctgggccacctacctggagctgccgccccgcgagccgagtcctgccgtctcaggccagtacgagtgtgtggaggtggccctggaggagcgcagcgcgcccgttagaccccgcactgtgccgaaacgtcagatcgagctgcgtccgcggcctcggagtccctcgcaggacagtcgcgcgccgcgtccccgactgctcctgcgcacgggctccctggacgagtctctgagccgcttgcaggccgccgcgggcatcgtgcagacggcgctggctagaaaactaggctctgcggtcccagcccccagcaacgtcacttttaagtctaccgccaagccagaatccacgacgaactctcaggagacgacagacagcactcgtgtgctcctggaagaggctaagtctcggccaccccgcgcgcacgataattcctcctctgccagagtcccgcggccttggcctagcctccgagagcgagcgattcggcgggacaagccggcgcccgggaccgagcctctgggtccagttagttccagcatctttctgcagtcagaggagaaacctcatcaggcttacaaacaggaatccaagacccagtttccccgtgagactcctgatagaaccgtgccgagagcacggagtcctccttttcattctagaggttcccgggtggttcccagtagggttgtgaggcccaggagcccctctcctccgcagcaggctccaaacgggtctccccacaaccccccacaaccttctaagattgtttggagacggagcagcccggccttccctggcggcacatcctctgcgtgggaaaatcggaatgcttccgtcgaggaagtcgtcagcagaaggaccccttccccaccaccacttccccaatggactcagggtgtcgctagagttgggaacccatgtcctgaagctcctcttgtgtggaaggttccgaattcgagaggcggagatgcagtagggctgagtagggactcgtcgctgccagccctgctcccgcgggaagcacctcatcctattgaaacgcgtaccccatctcccggagagacttggagtcctgttgtgcagggtgcatcgacggcactgcatcaggaagctatgaacggtctaacccaggagctggagccgcctacaccatcagcacccgcgactccagagctcacagaggctctgtgtctgctctcactggaaaatgcgggtatcgccgtcagaggcggtcaacggtctccagatgtggatacaccggaacagccccgaagtcacctcacaagcactctggacgacgatgtgtgcccagaagccgtgggctcgggagaagcggcttctgaacgcccgcgcgtgaccattccgcggccgcgagacgtgcgcaagatggttaagactacttatgcaccaagcttccctgcagggaccccaggctccgggcttcccgcgcctcctgcggacacctgcggggaggacggtgatgcatccaaaactcacaagctccccgcacttgagtcgcccgccccggctcattacacttccatttttctcaaggactttctgcctgtggtacctcatccctacgagtcaccagagccttcactccatgcaacccctaaggatgcctcccagtccagcggggtcccgaggcggcgggcagagaacagcaccgcgaaagcctttcgctcgaagtgagatccgcttgcctggcgctctagctttcggccagcggcgggagaaaaccccgagtgtccaaagacgcggtcctggaggagaaaacccggatgctgaggcccagcgcctggtccgggaccctgagggtcggaccagccctttaggaggcgctcgcacctcaacccaatgttcccctttagagtcgacagggacgcgaccacctcgccccggctccccgcaggcgtgtccaaactcgagccttagggcagcgccggaattggagacaccgcttgtggctcctgcaactgcggtccaggcgcccctacttcccgatcatccggcgacggcagccagggccgctgcacccttcccgcgagctgcttctgcgcctcccaccgaccggctcccccctgcatcttccctggggcggaggcctccgggagccgcccccgcggggaaggtccttgtagacccggagagcggccggtactactttgtggaggcgccgaggcagccgaggctgcgactacttttcgatcccgagagcgggcagtacgtggaagtactgctgccaccctcgccctctccctcccggcagccacgccagccctatgccccactggccctagggcccggcctctacccgcccgcctatgggcctatctctggtccatcactgtcgccgctgtcccccaacctgtcggcccttggtagtctccagctaccttgggctcctgaggctggacccctggagggaatgtattacatgcccttgagcgggacccctagtcccgcaccaccaatgctcttctgtgccccaccctccagttctggtcccatccagtccagcaagggttctgtgtttcctttgtgaagcctcagcccttattcccatggagttgggttccctagaaggcattggaagttccagatcccagtctctttaactttttttctcccatcaattctttggccagttccagccagtcaccacaccagaagtggccttaagagagtgtatctgctacctgggctaatagtgacagagtatcgttagcaaatggctgtctgcctacccctcagccccaacaaaaatatgtatccttttcccagaccttcccagggtgtggtgtatttgtgtatttgtttatgtaggcaagcaagtctgtcaaagtgagaagccagtctaggaggtgttggggtttcccagaatagcaggtgtgggagcagcaggacccgggctgcctgggtcaactgtttgtatctccctaacactgggcccagttgagtggagcccgacagtgggtgctgctgagatggaagggataggtgacagccatcacatctggatgtgtgctttatcctgggagcctatgggagaacccagtgtggccctagggcagcttggggcagccaatgagagctacgaggatagtagctggagttgtggtatggatgtcgtttaaggagatgtggaggatcagcctggattggaggtgagagaagaggatgaaatggcccagggttgctgtagagacagccaatgggacaagcagctcctggacagagaggcagcaggaggcactaggaaatgaggaggggggaggaagattacttgtctttgggttttctgtggctaggggtgactagggacaagtagtgaattaaagaatctcaagtggtcagcaagtgtttctcttgtttgcccatttctggagttgagagggcagggagagcaagaatctagaaaaacaagttactttagttttgggaattgttgtttaaccaaaatggaggagcttcataaaatggtgtgacagctggccagtcctttgatcccagcactctggaggcagcgacaggtggatctctgtgagttcaaggccagcctacagagtgagttccaggactacccagagaaatcctgtctcaaaaacaacaaacaaataaacaaagacactgactaaaactaacagcccacagcagggaacccagctctttcctcaagccccaggcctgtcttctgtagaccctaggagctgagctggcttatcttgaagccttcattgaccccaagtaagttaaatcaacaggaagacaatagagaggaaggctgtcatcacactagtgagttagaactggcaagaggaagggcgttcctatatggagtaggccaagggtccctgaccctttagctggttccattctccatgttcctccaggagcagaggcaacagagcccacacagggactggccctcccggctgctcacagcacaggaaagaccctaaacctgtgctctgtctgctctgagcctggggtaaactgagggccagagaccaatctctgtgaggtgggaggtgatctctgtcatttggagccttgctggaggagtgtttgataggaggtgtttgggaaggataatccctatgagaagcaatgccgagtaggcatttgatagctttctggttccgagcctgtgtagctaaaatcccttggagcttctgtcaagctccttgccctagactggaaatcggctaaagtgcaccgtcaaaataacctcaacatctctaccagagacactggtcctagtgacatggagagaccaggcccacccctagagtgtatcatctcaccttcgtgtgcaataaatggctgaccatggagagccatggtggccgaaatgacaaccaagtgtgtagtcctaatttcctgctgccacctttttaaaacaaaacaagacaaaatttaaaaaaaatcacttataccttgcatgatggtatacaccgttaatcccagcacctgagaggcagaagcaggtggatctctttgagttcaaggacagtcgaggctgtctcaaaaagtcaagtaaataacatttaaaatatttatttttattttatgagtgtttacctgcatgtatgtatgtgtaccacgtgtatgcttgaggcccatggaggccagaaaagggcattgaatagctctggaaatcccctggaattggagttacagatggttgtgaaccattgtgcgagtgatgggaactgaacccaggtccttagcaaaccaagcaattgttcctaacaactgggctttcttcagcttgctgcttcttaaacatcctctgcagagagccctcatgtctggctctggcctagggaaagggcaccctaggattggaggaaaagaccacgtatgctctcatacactgtggtctccagtaactctgttttactacagttagagccctaagccagccaccacggccatgaccacagtcctcctggagactgtgacctgtgggcactgggaccactttcaacatggcttctccagctggaggagctggctttctctcttgagctttcacatcctctgaagtagaataaagatgactgcaaccggccacctcaccccacaggatgttcggtcaggttcctaccgctggctcaggtcacactatgtgctcttcatcagcggccttggccagccttggcctctctccttgcatctttatcctctatgtgtgaaacggagctgagtcattagaagccaggtcccctgcatgcgtggcgtctccagggcctcgcggaaagggaagagggtcagtgaggtgtctgttccctattggcctacaccacagataattcgaatgcacatctgcgccccgaccacagcctgtgctccaagaagtaagttcagaggccatgagactgcctctgccactgttgctactgttcgggtgcagggctatcctggggagcgccggggatagggtttccctctcggcttcggctcccacactggatgatgaagagaagtactcggctcatatgccggctcacctgcgctgcgatgcctgccgggctgtggccttccaggtaagctctgcctgtcccccagcaggcctggctcaggccacttcatctgtcgtagacctcaccattgagccttcaatccccagccctcagcccgaatcagcaatctttccaggatattaccagcccccttctcttgaattgccatgcctcagtttactgttttgcctggtcaccaaagagcagacaatctgagatggccccatcttgtcaccccagggaaatcattcttcctcttataattctcccgtctgtatcctttctcgtctggacaccctccccaggtccctgagatgcctttattttacacgtgttgagtacgtatgtatctatgtgaacccaccatgtttgttcacctcaagcatgcctgtgtgaccatgtttctgtgtgtatgtggggtgagtgggtacatgagttattaaagactggttaatttatttgcgtatcatcatcatcatcatcatcatcgttattgactttccttgttctcatggtttaaaaatagcatgtgctactgggcaggtgggccctgaaggagggccaggtctttcactcagcattttttcccctagcccctgagagcaggtcatgcctgagctggcccagcccagctgtggggcctagagaggggcccctgcagcctgccttgcaggtgcttcctgatcaacagctcccctgccacctcattctccccagagacttgggtgtctgtcctcctctcctccccccaattgaccagcagtccccaagtccagcctctcagcatcccctcattccagatggggcaacgtctggcgaaagcagaggctaaatctcacactccagacgccagtggattgcaggagctgagtgaatccacgtacacagatgtcctggaccagacctgctctcagaactggcagtcgtgagttgttgatcctgccatcttcctaaggggaagggctggtgggtacagccctccttcctcccattgatgcctcatgctaattccatgaaggctctggtctgagggaggaggtcagctgggctgaaatctgggctacggctgctgctgagaacatctgggtgagcagatggccacagaaagatcactgtgagatcttgagacttaaacttaactctgtctgagctcagcaaatgtccagtatacttagcctagaataggagcaagttcttccctgagctgatccgcactgatcctacatcccttgcttcccattaccatcagctatggagttcatgaagtgaaccagatgaagcgtctcacgggcccaggacttagcaaggggccagagccaagaatcagcgtgatgatttctgggggtccctggcccaataggtaatagcatgtgggagaaagagcccctggagtcccgctttgctcctcgacttccccaagggcgggttagagctcaaggtgcctaatgctcccctaggctctccaagacgtgtttccactacctgggtgagtttggagaggaccagatctatgaagcctaccgccaaggccaagcgaatctggaggcgctgctctgtgggggcacccatgggccctgctcacaggagatcctggcccagagagaagagctttagtccaacctgctgcacttctggatcttctctaattttattattattaatggctgattagaggcaggctctcatcatgtaggccaggctggccttaaacttgtcatcctgctcagcctcgaaagtgctgcatttaagtcctgagcctttttgtgcttgaccctcctatataattttttcaactgtggtggtggggaggggacagggaagcctgactctagctgtcaatcttctccctccacctctcgatggggtactgggactgaggctgcctttctactttcaaataaagctttgaaagactttgagtagtgttggctgttgaaggaatcaggtgtctcaagcaagcctgaactcttagatactgagaactgccctggtacccggattagttcatgaaagaattgttagggtctgaaaatccaaaacaatccaagcagacacaagagttcacacaaagcaagatctttatttgaatgaggcagcaaaaactgaccagtcagggacgacagcagcacagactcgggagctgactgcatcttttaatgttcatcgtggtagctctttaagcagatgacaaaaatgtactgtacttgggatgaaactgatcgatcagggtcatagaaccaggctccagagctgacccccaagccagaatgttagcttcaaattcataaatatctatgccaagttacagttacaactttccatcaaccagaataatttgttctttcacagttaggaacaattgttatgttttgggaatagaaggtggaggagaagcaggaagaggaagaggaggaggaagaggagaaggagtaggaggaagagaaggaagaagaagaggaggaagaggagaaggaggagaaggaggagg

SEQ ID NO: 1550 - DNA, 672 bp, Mus musculus
gaggccatttccaacgagccagcgggggcaaaagatggcgacgccccttgggtggtcgcaggggggctctggatcagtgtgtctcgccttcgatcaactgcgggacgtgattgaatctcaggaggaacttatccaccagctgaggaatgtgatggttctccaggatgagaattttgtcagtaaagaagaattccatgaaatagagaagaaactggtggaggagaaagctgctcatgccaaaaccaaagccctcctggccaaggaagaagagaagttacagtttgctctgggagaggtggaggtgctgtccaagcagctggagaaagagaagatggcctttgaaaaagcgctctccagtgtcaagagcagagtcctgcaggagtccagcaagaaggaccagctcatcaccaagtgcaatgaaattgaatcccacattataaagcaagaagatatacttaatggcaaagagaatgagattaaagagttgcagcaggttatcagccagcagaaacagaatttcaggaatcacatatctgacttccggatccaaaagcagcaggagacctacatggcccaggtgctggatcagaagcgtaagaaagccacaggaatgcgtcgggcccgtagccgtcagtgttccagggagaaataaactgctggttatcttcctgt

SEQ ID NO: 1551 - protein, 216 aa, Mus musculus
RPFPTSQRGQKMATPLGWSQGGSGSVCLAFDQLRDVIESQEELIHQLRNVMVLQDENFVSKEEFHEIEKKLVEEKAAHAKTKALLAKEEEKLQFALGEVEVLSKQLEKEKMAFEKALSSVKSRVLQESSKKDQLITKCNEIESHIIKQEDILNGKENEIKELQQVISQQKQNFRNHISDFRIQKQQETYMAQVLDQKRKKATGMRRARSRQCSREK

SEQ ID NO: 1552 - DNA, 22589 bp, Homo sapiens
  misc_feature (1)...(22589): n = A,T,C or G
cgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtgggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctannnnnnnnnnnnnnnnnnnnnnnnnnnnnnnnnnnnnnnnnnnnnnnnnnnnnnntaaacagattcccaaagtaaagtttcttcatccccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgataagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaaaagaaagaaaaaagaaaatacagtgaactccagtatgccactggaacatgggttccagcagcctggccaagctatgtgtcattctttttcctcatgatacccaggatgggctttgtgaggaggcactgtgcggttccagtggctttctgttacagctggccacaccatacaagcaagtacatcatctgcatgcactgctcctcacaggagcttgcacttcattcatatttattctgccctcatttaaggtataagcttagtgtcctaatatatttatttttggaaagggccaagttacaaaacatcttttttttgaggctgcactgttgatatgtcatgcagtggccaccaagaaagtatatactcgtgttagatactgattacatcatttacatcacgctcagtatttggaattaaagatgtgaatgttctgtgaccagagtagggatgacacaaatggaatcagctcctggtggactaagaatcttgaaaaaatctggccacctcatccactacatctggattgagtgtactgcaacaaagaaaaacattaaacaattttatattaaaagaatggctacttttccttggttcttttacctttgcccatggcatccttggccactgcacatcgcctgactcccttggagccacttccgactaaagaagcttttgacgcctgctccagtcttccctcacccgtcagtgggattatttgcatttagaatagtagatagcattgttggcatcagttccacattttctatcagataacagcagctgcagtacctcacagccaatatacagatcaaaactacacttagcatcagaaattcaggtgttatcccagttccttgctggctttggtcctagtggcccatatttaggaaagttttggtttaaaaatatagtaaatgatatttacatgatcctaactggtcatgatagctttcatttgaaaaagaaagtgagatgagattcaattcagcaatgattgagaacttactctgagccaggtgggctgggtttttggaatgggggtcagggaacaggtgaggcccagcaccaagactcctggagctcacatctaatggggaggccaggctttccacagcactccccagtgcaatgaatagctaaagggagaccaaggtgaccacagactgtataacaaagggatttaacccagtctgaggggtcagtgaaagcaactctgaggaagaaatatgtgaaatataatcacccttcctacagagatgagtagatttttatttagtgaaggagaacggaagcaagacttccagtgctcccattaccatcactagcacttccacccatccaagtgccaaagtcagcaacccaagccaggcacggttttgcacacctgtatcccagctacctccagaggctgaggtgggaggatcacttgaggccaggaccttgagaccagcctgagtgatatagcaagaccccgtctctaacaataaaattaaaaagttggccaggcacagtggctcacacctgtaaccccagcactttgggaggctgaggtgggtggatcacctgaggtcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatctttttcttttatgccatgctaccctttaattactacactctaccagccccttttgccccagggactttgtatacacaaagtatacactgcttcctctttctggtatccctacctactcatctgcccctaccctctttgctaagtgcttcctagttaccttaataggcttcagctcaaacatcacttcctcacagaagctttcccttgcacagaatcttagccccacctggctaagtttctctttagatttatctggttgtttgattattgtctgactcttcccactagactaagttcctgactggttttacctgaaatgaaccttgaagggagtggtgccccatctgtcataaggatttgctctagaagtgcagcccaaattatttgacactactcccattgaaaggtggtggggtagggggaggaatctgtgtgtcctcctctggaatctagactctgactccttgaccaatagaatacagcaaaaatgacactatgccaggtatcaggcccaggccttaagaaactggcatcttccattttctgtcactttgaatgattatctttaacccagtcttcatgctatcagaaagtccaggcagcctatggagaggaaccaagacctttggtcctcagccctagcagagctcccagctgacagcaccaacttgccagtcacgtgagtgagccatgttggaactggaacttctaactccccgttgaaccatcccagttcacactgcatggagcagagataagctttcaccattgagccttgccaaattccagattcatgaacaaaatgatttttttcaatgacttaaaaaaattggggggtggtttattatgcaccaatagataaccagaacatcagccaaaatgacaagcctgtgcagaaaggcaacccttccctggcaggatcacagagctgtttgtgatgtcatgtcatcctgagtctcactgagtcctggttgaccaggagcccaaagtgcctttcaacatatagaggagtctgtggcagtgcccaaccagggtgaccacccctcatgtccatgccaggaagcaggtgcagacctggatccagggttctctcttgttcataagcttccacccccaggtggctgctggagcctactgctctccagggttttgccccaagtacgcagagagcagcctgttccagctggtgaaggtggatgttggatatcaagggacatcaagcagtgcctcatgaaagatcctagggaggaagtgcagttcttggggaaggctcaggaatcactgccccagaagaatgtgcagctttgtgaagggtgattcaggtgaacattcacatttggtacaccaagttctgagagggtctgtgctgaggcacacaacctacacagtgccctctaggcacacactttccagtacagtagccagtagccacacatggccatttaaactaaaaatttaaaaattttaaagagccatgattaaggtgatcttcagaaaataataaaaaatttaaagcaatttctcagtcacatgagctacgtttcaactgctgaagagccacatgtggctagtggctattgaatagtgcagctgtagaacattttcatcactagaagttctattgaactgtattgttctaggccctttaacagaggtcggccgggcacagtggctcacgcctataatcccagcactgtgggaggctaaggttggccgatcacctgaggtcaggagttcgagaccagcctagccaacatggtgaagccccgtctctacaaaaatacaaaaaaatcacctgggtatgatagcagctgcctgtaatcccagctactggggaggctgagttgggagaatcgctcaaacctgggaggcagaggttgcagtgagccaagattgctccactgcactccagcctgggcgacagagcaagactccatctcaaaaaaaaaagaaaagaaaaaaagaaaaaaaaaagagaacatggtgaaaccctatctctactaaaaatacaaaaaattagccgggcatggtggcgggcgcctgtagtcccagctgttcgggaagctgaagcaggagaatggtgtgaaccccggttggggcagagcttgcagtgagccaagatcgcaccactgcactccaccctgggcatcagagcaagactccgtctcaaaaaaaaaaaaaaaaaaaagagagagaggtcagcagagatggccttgtctccaagtccatgaaaataaacgcaagaaacaaaacaagggctcccgctgagagaaccacagggatggccaagtttgtcaggccccccggggggttttggggagcggcttgaatgacttaccctgagctttctgcctcctttcatagtcactggtaactttttttccaaactccttgttagtatagtcatttcctacttgggggtatcaaattccataacttccacccatgacgtgcaacacaaatgcagcacaacatcctggttaagaacatgaactccaggcccagcgcggtggctcatgcctgtaatcccagcactttgggaggccgaggcaggcggatcacctgaggtcaggagttcgagaccagcctggccaacatggtgaaaccccgtatctactaaaaataagaaaattagccaggcgtggtggcgggcgcctgtaatcccagctacttgggaggctgaggcagaagaatcccttaaacccggaaggtgaagtttgcagtgagccgagatcacgtccctgcactccagcctgggcgacagagcgagactacatctcaaaaaacaaacaaacaaaaacacggaccctggaaccaaactgcccatagcagaactccgttccacaacttactagagtgaccttgggcaagttattcattctcattctcatagagcctaggtaaaaaggggctgataggagttccatgagggtcacatgaaataatataaacataacggtgccacgaaatagtgaacacaatatatattcgctctgatgttctccaaacctaatcttatttgggtttccaagaaaaaaaaaaaagccttcaatagagacttggtgagtgtgcgtaatcaccgtatccttccctgacttcattttactaaactctcctccttcaagccctcttcagtcctcctaatctcttcagggtcctcctcctcgggtggtggcacatgactctagtgcagactctagtgcccagagcctggtatcagagtatgaagactttgatctcaggtgtagccattctcattttttatcttcgtctatcttccgtgcttaggcttaggacccctaagtactaagtgtgttccaggaggctggaatctcatacaatggaggaaatttggagattaggataaagatttggagaaagaggcatgagaagctaaagatgcaggagttgcctatgctggctcttgcttcgtggtcatgcagtttaacaggccctgggtgaaggctgagggctgctgttttgagtgttgcctgctcgcaggcaaggaaagtacaagccgggccctgccggcttctcaggactgcgtgagaaacagaagacgcaataaaagcgcaatttcctgtaaacttaaatgccttaagggttgtcagcagtttccccgctccaggcggctcctttaagaggcggcccctcgccccgctaacataggaagtccccgccccccgttgccagggtgctctgtggcgtcgcattctcattggtgggcgacggcgaggatcacccccgaggcagccatttccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtggtatgcagccagaggagtttggggagaggcggggccggatgcctcactggtgggggcggggccagaacctgttccgatgcgggggccgtggctagaacgcatggcccatggcgtcatcaggaggaggccgggctcagtcggtaggggtggagccaaaaaggggcggaccttcctgaaccagggaattttaactaaaatcaagccatattctcccttccgtttgcctggttgctgcaagagctggtagagagtccctgagcctcagtttccccattttcagtggagatgacgtcactgagttcccatggccctcctgtgcaggcagagaaactgtcatcccttctattatggacaccattcccgagagtcaaaggcagtgccgtgttgaatgcagtaagcgcagatttggcccttgccagcgctaacttaggggcctccaagaactttacatgccttagcttttgccttctcaatcaaaccccagctaatgggtgcaaagcattgcagtcacagattacctgggtaggcatgatagaatcctggccatctggagttcatggtttttctggttttgttttcctgtcttgataagaaggttaggatgtatctccatctcagaaataaaactggcttcacatctacttctcattctaagttgttcttagacaatttcttcccttctgggaagttgaatgtgggggaaaggggagagagacctgtcctatttgctaccctaatgctctcattcaacaaaatatatggagctctaggcactgaattgcctttgattccctgaaggtacccaggtcttcctcttggcagctgaccttggcatgtgtgtccccaccatccagagtgcttttctctctatccctcttctggcccaccctatatagcagtcagatctcaggtctaacatccccttctccggaagtgattctgacccttccccaggctgggttggggcctcctctgagccccggatccccttatgtctccccatcaaggcacacaacatgttagaagtgctaactgtggactgcctcctccatgagactggctgctccttgagggcagcacttagagctgagtctcagtttatctgtggaactgaattctcccttcccaaggcctcagtctcatcctaggtaccacgagcatcatcctgttatccgcttttggtcctggtccctagagggcgccccttctactccagccccaggccctccctcagccaggctctgttgcagatggttctccaggacgaaaattttgtcagtaaagaagagttccaggcagtggagaagaagctggtggtaagtaatggcctctgcggtctcctaatcttcccccgtttcccaggatccctgtggttaggcaggctcattaagtattagcctctgatgggtgcagtggctcacaactgtagtcccagctctttgggaggccaaggcgggcaaatcacttgaggtcaggagttcgagaccagcctggccaacatggtgaaaccctgtctctactaaaaatacaaaaaaatatatatatacatatatatatattagccaagcatgcgtggtggcaggcgcctgtaatcccagctacttgggaggctgagacaggagaattggcttgaacccaggaggtggaggttgcactgagctgagatcatgccactgcactccagcctgtgcaacagagtgagactctgtctaaaaaaaaaaagaaaaaagaaaaaagaaaggtcggcctctgagaacctccagcccctgtagcaaggtggccagaatctccctgtgctctggcttctgtgtgtccctctgagaaggggggctggttaagggagtctaggagacccaaggcggcctagggtaatgaggtgactgctgctgcccctgcaggaagagaaagctgcccatgccaaaaccaaggtcctcctggccaaggaagaggagaagttacagtttgccctcggagaggtagaggtgctatccaagcagctggagaaagagaagctggcctttgaaaaagcgtgagtgggcctcagtacggggtgtggggtttgggggatgcatctgcttgctagcctgcccaccctcccatcttatcttccccacccaggctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaacatacaaccttcttagtccaccttttgttttcccacttttgatgggttactcctaactgatacaagaggaacacagggcaagcactgtcctatttgggacctgatccttagtctcagggtcaggactcaatagggaaggatgcatgtggtgacagggggctaggattgccagatctttaaaatggaaactaagagttatttttatttttctaagactgggtgtcactatgctgcccaggctggtctcaaatgcctgggctcaagtgattcacccacctcagcctctcaagtagctgggactacaggtgtgagccaccatgcccagtgaaaccaagttgttttattttttttgagatggagtcttgctctgttgcctaggttggagtgcggtggcacacggctcactgcaacctccatctcctgggttcaagtgattcttctgccgcagcctcccgagtagctaggattacaggtgtgcaccaccatgcccggctaatttttgtatttttagtagagatgaggtttcaccatgttggtcaggctggtctcgaactcctgacctcaggtgatcccccacctcagcctcccaaagtgctgggattataggcgtgagccaccgcacccagccaaaaccaagttttaatggaagcttttctgactttttagtgttggcagttgattttgaaattttaaaactatcgtgtaggccaagtaaaatatctgtgggctgccagttttcaactctgctctgtgcagatgcctgggggccacttttttggctcagttggtgccataagttgtggggcaccttctgagtcagctacacatgcccgtacacctcaggagcccctttcatttcccggaatgctaaactccccttacccagtttaagtatgggctgggcgcggtggctcatgcctgtaatcccaacactttgggaggccaaggcaagcggatcacatgaggtcaggagttcgagaccagcctggccaacatggtgaaaccccatctctactaaaaataccaaaaattacccgggcatagtggcgggcacctgtaataccagctactcaggaggctgagacaggagaactgcttgaacccaggaggcagaggttgcagtgagccaggatcatgccattgcgctccagcctgggcaacaaaagtgaaactctgtctcaaaaaaaaaaaaaaaaaaaaagtaggtatgaattccaggcacaacatctgctttgttcactgcagcagatctccagtaggccagagcccaagcgcaagaggttcaaggtccttactgatggggctcccatgtggagccttgagtaccctgcctttcacctgttcagccttctctctcccctagtgagtgctctcactgggaagatggcagcaggctgacatcttgatctggccaggcaggctgacaggtctcatagtagtttggtcactggctcctgccatggcagggcgcaacaggcagtcactgcccccatgctcgagaccattggtcccctcagtcttgccctctccctgggcatccccttacttcccaaaaaagaacctggggttctttcctggtagggccaaagacctccttcccctaggtcatttccttccaacagagatcagtcaagctcacggggctttggatctgcttgttggaaggtgtgtgtgtcatggggacaggtcctggctgcctcccccagaatattctaaacccctcctgtgggacacaagccctcctgagccagtctggtgatgtgaacctcaccctggccagtgcctcccacccctacaaactccccttgtgtggtttcagtttggtttttacacttacatagttctttactctcaaagggattttctaaccattctctcaccatcgggtgccacaggcttttattttcaaagagtcacacaaatttctaattctttttcccaaacgaacttcacaagtaattaattccacttagctggacgcctgggaaggaggttcaacagtcctcgtcccatgacccggtgaactcatgtcttcattctctcccttcacctgtctcctcttttccatgctgtgccttcactttttaccaggtcttctcttttgaaatcttaaatgcttagacatttctgtattttcagagtttgtgttctagttaattcttgtccaacctttttttttttttttttgagatggagtcttgctctgccgcccaggctggagtgcggtgtcgagatctcggctcactgcaagctccgcctctcaggttcacgtcatcttcctgcctcagcctcccaggtagctgggactataggtgcccgccaccacacctggctaattttttgtatttttagtagagacaaggtttcaccgtgttggccaggatggtctccatctcctgactttgtgatccacccaccttggcctcccaaagtgctgggattacaggcatgagccactgtgcctggccccttgtccaacctttgaagacagtaggattttctttctgtaggaatcagaatttttccaaggtgccatgtggggcagttatgtaaatgaagcacccccagatccctacagcctccttggattttgatccaacacagaaaaattatcatttatttatttatttattatttagagacagggtcttgctctgtcacccaggctggagtgcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttgggaagtcagtttccatcacatgacaataatgtttatacctgcaaattgcatttgcacctgctgacacctcccccaaacgggagcttcacaatgggaggaagagaaaagacaatgctgtgtgtggttttaaggtggagaaacaatctgggaagggacctcgatttgcacaagttgcacaggcagggctggatgggatggagcagcaacattttttcagaagccatcaccgagtgccccctaggtgatcatggggacacacccaggcagaggacccacttcaggggtcagattagcccagtgtagcctgtcctgggtcggtttgaggccaagtgcacaggagggggcagtgctcttgctccagggccagctggggcctgagtcatagcaggaccttgaagccagaagtttaagggcaagtggtgcccacagttgtaagacaatgacaggtggtggttgcctccccaccagcgcctgtccccagggcaggtcctaaggctgtgggggctgaagttagggccttgtgaatacctgggggagcacagggctgttctggccgcaggggcctttggagctgggaccacaagctacttcgaagcttcctgtaggaccccacatcggtatccagggcctgttctaggtgctgaggcagactgaaagctagagctgtccactccagctccttccaataggtcccaccgagggcagtgggtccagccagtggtagtaccttcctgaggccctgaggagtcagggaagcctctagcggtgctcctcactctactgaaggggatcaggaagagtgtaactggggtcaagaaaggtggtgtgtgcacccttaagagctctagctgaggccagcaatggcaatgggggtcccctgcagtgatgctaaggcacccggggctgaggggaagatgaaattgctggccctacctgagtctcctggcctgaaggtctggttcacccgctcacagcctgaactgcacacagcagtgcctgacttcaggcggatccctgctgggcttcagtttcctcacctgtgataggtggagttgggcctaactcctggctccaaggctttgaaagttgggcctgccattccctcacctgcctgtcagccaaagcttggagcccaccccaggtactccggcttgtgcctgagaagggggttagttgggcatgggggctggacagggaagggtgcagggcccaggtcttttctgctgccggcgccgctggctcaggagtggacgcggccgctttaaggcgcggtgacccccacggcatcctcgggcggggcggggacagtgccggcgccaccagcggaggcgaatgcgagggagatagtgcacggcgtccggccccaccatgctgaccgcgctcgccccgccagccctgcctgggatcccgaggcagctgcccacggcccccgcgcggcgccaggactcctccggttcgtcaggctcctactacacggctccaggttctccggagcccccggacgttgggccggacgcgaaaggcccagcgaattggccctgggtggctcctgggcggggggcgggcgcgcagcctcgcctgtccgtcagcgcccagaatagccgccagcggcacgggcccggctcgggtttcccgcgaggcccaggttccggcccacggccaccccagccccagctgcgcacgctgccgtcgggggagatggaagtcatcttcggcgtcggacccctgttcggctgctccggcgcagacgatcgcgaggcgcaacaacagttcacggagccggccttcatcagccccttgccgccggggccagcgtctcccgccgcggtcccacgccagtcccaggtccccgatggtggctcccgctgggccacctacctagagctgcggccccgtgggccaagtcctgccgccccagcgcagttcgagtgtgtggaggtggctctggaggagggcgccgcgcccgccaggccccggacagtgcccaagcgtcagatcgagctgcgcccccggccccagagtcccccaagggcggccggcgcgccgcgcccccggctgctcctgcgcaccggttccctggacgagtcgctgggccccctgcgggccgccgcgggcttcgtgcagacggcgttggccagaaaactgagccccgaggccccggccccgagcagcgccaccttcgggtccacggggcggtcggaacctgagacccgggaaacggcccgcagcacccacgtggtcctggagaaggctaagtctcggccacttcgcgtacgagataattcggcccccgccaaggccccgaggccgtggcccagcctccgcgagcgcgcgattcggcgcgacaagcctgcgcccgggacggagccgctgggtcctgttagttccagcatcttccttcagtcagaggagaagatccaggaggcgcggaagactcggttcccgcgagaggcgccggatcgaactgttcagagggcacggagtccgccttttgagtgtaggatcccctcggaggttccgagtagggctgtgaggccaaggagcccgtccccgccacggcagactccaaatggggctgtacggggtcctcgctgcccgtcgccccagaacctgtccccgtgggatcggactactcggagggtgagtagcccattgttccctgaagcctcctccgagtgggaaaatcaaaatcctgccgtcgaggaaactgtcagcaggagaagcccttcccctccgatcctttcccagtggaatcagtgtgttgctggggaaaggagcccgtccctcgaagccccttccctgtgggagattccacattcggcagtcgcggatgcggtggagccacgtagcagcccgtccccgccggccttcttcccgtgggaggctccagatcgtcctattggaacttggggcccatctccccaagagacatgggatcccatggggccgggctcatcgatagcatttactcaggaagctcagaatgggttaactcaggaggagttggcaccgcctacaccgtccgcacccggcactccagaaccaacagagatgcagagtccatccacgcgggaaatttcagatcttgcctttggagggagtcagcagtccccagaggtagcagcacccgagccgcccggcagccaccctgtgggcaccctggacgcggataagtgcccggaagtcttgggtcctggagaggcggcctcgggacgcccgcgcatggccattccgcggcctcgagacgtgcgcaagttggtgaagaccacgtacgcgccaggcttcccggcaggagcacaaggctctgggctgcctgcgcctcctgccgacccctgcggggaggagggcggcgaatccaagacgcaagagccgccagcactggggccccccgccccggctcactacacttccgttttcatcaaggattttctaccggtggtgccgcacccctacgagcctcctgaaccgtccttcgacacggtcgcccgggacgcctcacagcccaacggggtcctgcggcggagggcagagaacagcacggcgaagcccttcaagcgcacagagatccgcctgcctggggccctggccttgggtcgccggcccgaagtaacctcgcgagtgcgagcgcgcggccctggaggagagaacagggatgcagaggcccagcgcctggtccccgacggcgacggtcggaccagccctctaggcggcgcccgcagctcatcccagcgctcccccgtagggccagcaggggtccgatcgccccgccccggctcccctcagatgcaagccagcccgagccctgggatagcacccaaaccgaagacaccacctacggcccccgagcccgcggctgccgtccaggcgccactcccgcgggagcccctggcgttggcgggcaggacggccccagcccagccccgcgctgcctcggcgcctcccacggaccggtccccgcaaagcccctcccagggagcgcgcaggcagcccggggccgcgcccctggggaaggtcttggtggaccccgagagcggccgctactactttgtggaggcgccgcggcagcctcggnnnnnnnnnnnnnnnnnnnnnnnnnnnnnnnnnnnnnnnnnnnnnnnnnnnnnnnnnnnnnnnnnnnaccctgagagtgggcagtacgtggaggtgttgctgccgccctcgtctcccgggccgccccaccgcgtctacacccctctggccctggggctcggcctctacccgcccgcctatgggcctatacccagcctctctctgccaccgtccccgggcccgcaggccctcggcagcccccagctaccctgggtctctgaggcagggcccctggacgggacctactacctgccggtgagcgggacccccaaccccgcacctcctctgctcctctgtgcgccgccctccagctcaggtcccacccagcccggcaagggttcattgttcccgctgtgaggccccgggccgatccccatggagttggagcccttggatgcctgggaggttctggcatccaagcccctaccctcctctccttccgtcgcctctgtctttaacccatcccagtcagtcgtcggacaggaagtgatcttcagagaatgaatctgagccccgaggctggtggagctggagtcacccaggaagtggctgcctacttcctcccccaacaaaattatgtatccctttcccaggcattcccagggcgtggtgtggtgtggtgtgtgggtgtgtgtatatgtgtatatgcgggcaagcaaatagggaaagtgaggcatccctgggcttgtccccaggagccgatcagaggaggtgctgtggctgccgtggggcagcaggaacgggagcagcaggagacagggcggggaactgtctgccctccctgatggtgggcccagctgaggtgaggctggccagtgcccctggtgaggtggcaggaaggactctggctgtcgagtctgctcttaggaagaggagc

SEQ ID NO: 1553 - DNA, 668 bp, Homo sapiens
tccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaacatacaa

SEQ ID NO: 1554 - protein, 196 aa, Homo sapiens
PTSWRGRKMATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNGRREARALHHGYINGLFPNHPVPVSKAGFHSNTCPQLRIQAGPGGPHLRKGLKGPGRPRK

SEQ ID NO: 1555 - DNA, 21883 bp, Mus musculus
  misc_feature (1)...(21883): n = A,T,C or G
agtattgtcatcgtgtgcaccggcccctgacctccagcctcagcagtgcattaagagaagaaaggaaaaaaccaaagttctttataggaaatagaccgagatgatatgcttgccttctgtgtagcaaattatgtttcagtcagtgaaaatttgttagctgctgtacttggaacctagtgtggcaagtgtgtggagtctgcagagggtttcaggtactgtccagccatggatggctcacttttaatactattggtgagatttggatggtaacatgctttcaagcccacatgctaacccgatcttctagaatactttattatgttattacttgccctacaaactagaatgtgttatgatagagacaatgtgaagtagcctatttagccatatattatatgttttgtggtcctggggggtcaaacgcagtacttagtactttttaggcaagtgctatacctctgcactacactcccagccccacccccacgtttattccattttctttctaatttcttttttaaaaattgtattgtatgtgaatgggtgtgtttgcctgtatgtatgtgcatgcaaggctggaagatactggatcctctggagttggagttacaggcagtttttaggtgggactatccctgtctagataccatgtgagtgctgggaacagaacccagctaggtcctctgcaagatcagcaagtgctcttaacctctaagtcatctcttcagctccctgtaattattcttgtaaaaacattatttttacatgtctgagtgtgcttgtgagttctagaagatgaactgaaatcatcaggcctgtcctgcaaatgccctcacctgctgagacatctccctagcctaataacttcttattcattctttgcttttctgacaaaggttttgctagttaattcaatatgcccttgaacttgcaatcttcctctttagccttccaagtgtttggcttataggcttgtgtgnnnnnnnnnnnnnnnnnnnnnnnnnnnnnnnnnnnnnnnnnnnnnnnnnnnnnnnnnnnnnnnnctctatgagcactggctgatcttgaggacttgggttcaattcccagcatccacatggtggtttacaagtacctgtaactctagctccagaaagcctgtctttttctagcttctgtgatgcataggcattactcctattgaaaaaataaaaataattgaaaaagaaaagggcatcccctgctggtcaggagagaagagtcgcttcacaactggcagtgctttccagggtggttcccattagcatcgcccagggcttggataagctcagactctcagacgctgtgacacggaagtgtatgagaaaggtgaaatggctggagcagaactgagccagatagcactggagacagccctcctgtggggagatgctttatgcagtgtgacgtgctgctgctcaggtggagccacatctgctgctctggtacttagtaatggtccatttgagtgctgactgcttctctggaagagtcttgagagtggacgacagttggctagcacgtgtgggttatttggagcatgctcagattagagccctaactttgctcgagggaggaggatctggctgggcccagcagaggatggtgcttggaaggcctgaagaaagctgctccgatagctcagttcactcccggattgtgtcctgtgggtctgattatcttttgggattacttgcacagggtagtgtttacatactttgttttgtaacagttaacacggaaactctgatgtcaattgtctgcacggtatactgcttttagaaggaatgtgtatcatgagggaagttggtaaaaccggtatacagatctgaaatgccatgtctttgtgtgatggtgccctcataacataaaagaaggctacaaaatcattcaagccaggtagtggtagtggtgcatgtctttaatcccagctcttgagaggcagaggcgggcgaatttttgagttcaaggccagcctggtccacagagtgagttccaagacagccagggctacacaaaaaacaaaaccaaaatcaaaaacaactcaaaaagcggggcgtggtggcgcatgcctttaatccgaacactcaggaggcagaggcaggcggatttctgagttcgaggccagcctggtctacaaagtgagttctaggacagccagggctacatcgagaaaccctgtctcgaaaaaagccaaaaaaaaaaaaaaaaaaaaaaaaaacccaaaacaaaaaaccaagcaaacaggataattaaaaaagaggacctgggaatcaaagggaaattttagagatatagacacaggagcagaaaatatcagtggttacattagtaaaaattgttaatcaggtgctaaagaactggctcagtagttaagagcatgtactgctgttacagagaacatctaccacccatgttgggaacatacaagtacctgtagctccagctccctgggacccgacagcctttcctggcctccttgaacactcacactcacctgtgcacaggacacccccccccccacacacacacatcacatagctaaaaataaaatgtaaagacaaatagcagtaacagtggctaactgttgattgacaaaagctaaaaagttttctaacactgccgaggctgtgggaagtgagttcccttatcccatgagtggcaagcatcgccttttcaaaatgtcaagtgcacatgttaggctttccccttgtgtttccaggaggctgctccagtttacaaagaacctgcccatgtccttgtcctgcacagctgccagccaatctcaggctttttgttaatattatctctctgtatactaaaatacctcattgtcacatgtaaatgttagtttccactcttctttttgcctacctatttttgtcacaggtgaggccattttaaaactagatggacatttaaatttgtgtattcaaatttcacttccttcttgattttcccctagcttctaggtatagaagttttgtgaattctgtcacccttctgtctctcttgaaagtgtttaagttgtaccaggtgtggtgtggacatctgtcatcccatcatgtgggagactgagttaggactgtaggccagcttgagttacatagtgtgacaaattgaaaactgtcctcttattaaaaaagaaaagctggctgtggtggtgtacacattggtcccagcagaggcagggtgtccctgagttcatgaattatgtgtctatgtgtttgtctatgcacgagtgcaggcgcccggagtggagtggaaagcatcagatcccctgcaactggggtcaggtggttatgagcgtctgtgtgggtgctgggaatcaaatccaggatctctgcaggagcagccactgagtcacctctccgtcctcttaactggtttttccagttattttgagagatgtcagatcgctgactggttatttacaactgtttacttaaaacattcctttctcctccttcccttaatattatgtgttatggtatattagaattcatttgggggttttgtattttttctctttttggatttttttcgagacagggtttctctgtgtagccctggctgtcctggaactcactctgtagaccaggctggcctggaactcagtaatccgcctgcctctgtctcccaagtgctggaattaaaggcgtgcaccaccactaccaggccggttttgtatttttttagtgatttgtctaagtttagactgtttaactagtatgcaggaaaaaattcagaaaatgaatttagaaagttaaacactgtgctatttattgttgctgaatcattttcctgagttccaaaaagtcttgagaattctgttatctgtagtaaatgtacagagtttggaacctatgttattttactaatgctttatgtgtattttattcagtgatactgtatgtattactaagtacagccttaccattaaagctttctttatttctattttttgtcttttgtagttaaggctgatcttgcacatggaaccttcctgcctcagcttcccaagttctagtaatataggtgtatctatgatcattgctttttatatcagtgtttttacattggccacataattttccaattaaaatattttctagatgtttttacatattgatagtactgtgaggtattttatacatcttattatcaaagtagttgttagagttccatagatttcatgtacacatacagggcttgtttcttaaacatgggttgttggtgtaagcaggatggtggtggtgcatctcagagcgtgggaggcagaggcaggcggatctctgaattcatgtacagagagagctcctgggcagcctgggagaatcagagaaaccctttctcaaaaaacaaagcaaagaaagagtagttagtcaatatgaatagtgtttcttcctttgggtcttggctgtatcctgcccatgtgaaacattaagatccacagagcttttgtttattgtagtggcccacatgactgtcagtatgtgaatgttgaatccacgagtaagaactctaaaggtatgttgggttgtggctcccacttataatgccagcactcagggctcttgaggcaagaggattgctatgagtttgatatcagtatggacttcagattcggaccttctcagaaaacccaaacaacgaaaaaaagaagctatttaaagtcagctggactatttacaccccctcaggatgaaggggaatgccattgtcagcgttaatgtcgtttatgataggtgtgggtaatgctccatgctggtggagttgttgtttgtttttgttttgacagtgctgggtcttgaatccagagcttgagtaatttaggcaagtgctttatcactgagctgtacccctagccccatccgatggcttcttgttttgctttaatggctggaggtgtgaatggcttcctgggtactgcttcctggaaatattaaggacagtgaaggactggaacttttgctctgcttagaagtagcaagtgagcacgccaaagtcgatgggtacaggcagaagacctgagactcctgtaacgggagcaaagggacccgcgcttcaggatgtcagcagaataggctctgttacagccagtgcatttgccccacaagtcccgtgcaggcagtcacagctaagagtccaaggtgaaggaacccagatttcatgagcgtattagtctgttgactggtacagggaggggcatggtgcactcatttgactgcacggtgaacactctcccactgctctgggaaaagcccttttctctcttcttttttccttttatttgctttatgtgtatatttgtggatgtaccttatatagaggtcagaaggcaacttgctggagtctgttctctcctttcaccacttcagaccctgggattgtcaggctggcagcaggctcctttatctgctgagttatcttgccagcccagcccattcagggtcacagaatgtagctctaaatggcacaagctcactatgtataccagtctggcctgcctgttcctcccaagtgctccaaggtgtgtgctaccacatctggcaaatacatttttacaaaataaggtggatagcaattgaagaaagcattctatctgacttcaacctctggcttccacacacgggcacacatatgtgtacctatttacacactcatataaagacatacatatatcatacatacataaaatagatccctaccagtggatctgtatatgtgccaaagaatgcactgagaccagaccctccgatgttttctggggccacttcatgttgcctttgtatacacaggttctgcccccttaaaaccaatgccccactgaccagagagatttgagcacactttggctgaatattaaggtatgcagatacaaggtaaaccttagaaggaagtcagacaacacaaagccaaaagcagatctcagcttcatagctgcactcatgtgggtgcagagaaaaagacctgagactttgagctcacattttggctagcccaactgactagcaaattccagggatcgccctgtctctgtgcccagcactagacttacaggtattcattgccattcccagctcttaggcgatgccggggattggactgaggtccttatgctcgtgcaacagttactgtatctattgagccatttccgcaggaccggttttaatcactctttactgttgatttggatagtgccttcattgtgctatgataattttccatcattgtaacaaaacacatgaactaagaattcataagaataaagggaggtgtcatgacgggcagcaaaacgatccttgaagaggtaggaatgtaaacttggctcagcctgacttagtcatccaggctgggtcaaactttgggagtctgatacttggtggcttattgccttgaatacttggacatagtacaatttggaaaactgtttcctggtgtaatacaatccctggtgcacaaggagacataattataatgaaactcatctaaaagtacatgtcatttcttttaagaagataggttctagagatggctacctgcgttagctaggacctaggggtgatctagcatggtctccgtcacacatttagcatagtggtcatttgggctattagcctcctctggtcctggttgtgggagcttggtatggcctggtcctacagataatacagattaccaggctattcacctccaatttgcagtcttctgaatggaaaaaaggctatatataatggataggtgtcttagtcagggtttctattcatgaccaagaagcaagttggggaggaaagggtttatttggcttacacttccatactgatgttcatcaacaaggaagtcaggactggaactcaaacaggtcaggaagcaggagctgatgcagaagccgtggagggatgttctttactggcttgcctcccctggcttgctcagcctgctctcttatagaaccaagactaccagcccagagatggtcccacccacaaggggcctttcccccttgatcactaattgagaaaatgccttacagttgtatctcatggaggcatttcctcaactgaagctcctttctctgtgataactccagctgtgtcaagttgacacaaaactagccagtgcaataggtgttcctataaacactttaaggtggcttcctcagctctgtgaaatgctgtctcattatggttttgattaattccaatactttcatgtgttttctgacaattaaatgtttatttctagataaacactctataagctaggtgggcctagaacttgcagtcttcctgcttcagactggtggaattacaggcatgtgccaacattcttgctctttattagtcatgtttgcttgttgagacagggtgacctagaactcagagatacacctgcttttgtcttctgagtgataggaggcatgcactgccatacccagcttgttggccattataagaagtattttattaatcttgcttgtgtatttatatgccactgcacaccacaacatttggaaagttgctttccaatgcttttaccatgtaggtcccagggttcaaactcagcttatcaaccttggtgacagaaatctttagctgccaaaccatctcagctctaccccctttctggtgtgtttattgagacaaggtcttattgtctgttggacacttttgtgtattctatcttgttgctttgtcagtgtcctttagatattttggatttaaccttttctatggaggttggaaaggtcttctcccattctgtaggcggcctctttactcagttgattgctttgtttgttgtgcagaagtttgctgttgtgccctttgtctgtttttgttgcttctgttacctgtgcttttggcgtattgaagaagtccttgccagtgttaggaggcttttcttctaggagtttaaagcttcatgcttaggtctttaatccagtattagtctcttaaggtgctctgtgaatttcagacctcagatgaagtcgttctttactatgactctacttgaatttgcgtgtttaactttggtttttctactttcttctctccttctgttctttctcccctatggcttgaagatctcagactcatttgtattttgctttataaatgttgtattttaatagtatggaagtaaattaattttcagtgctttttcactccttggttatcaggaagaagatgagcctgaagtccgaacgcaggggaattcatgtggatcaatctgagctcctgtgcaagaaaggatgcggttactacggcaaccctgcctggcagggtttctgctccaagtgctggagggaggagtaccacaaggcccggcagaggcagatccaagaggactgggaactggcagaacggtaaatgacctcacaagctatgtggaggtggggtgtggtcaccaagacacatccgggtacacagcctgccatgcccaggcatgcttatctagagttctagtcatcctatagaacttctgaacaccactgaaagatttgtttgtatgtgtgtcacatgtgtgtggggacctgcagaggttagaagtgggagtcacattctctagagctggagttacaggtgaatttggatcttttgatatgggccttgggaactaaactctgctctctgactgtctctctagcctggtgtgtgtgtgtatgaattgaacttggttccttgttgcaggatatttgatcacactgtgaacctcaagattgtgttatttactgaaaataactgttgggctggcaagatggctcagcctgtaagagtactgatcgctctttctgaacatcctgagttcaaagcccttgcaaccacccgtaatgagatctgacgccctcttctggagtgtcagaaaacagctgtagtgtacttatgtataataataaataaatcttaaaaaaaaaaaaagggctggagagatggctcagtagttaagagcactgactgcttgctcttccagaggtcctgagttcaaatcttagcaaccacatggtggctcaatctgtaatgggatctgaagcccccttctggtgtgtctgaagaaaataataaataaatctttttttaaaaaagtactgtttctagttaaggtgtgcgttcagcctttagcaaacacctttaatccctctataatacagacacacccttagtatacacctttagcaggtcaccggccacggcggcctgcggggcctcctacgggttttcttcagggcaaatgatataaggattggtacactggtgggagaagacaaatatgggaataaatactacgaagacaacaagcaattttttggccgccaccgatgggtcatctacaccaccgagatgaacggcaaaaacacattctgggatgtggatggaagcatggtgcctcctgagtggcaccgctggcttcactgcatgactgacgaccctccgacgactaatccaccgactgctcgtaaattcatctggacaaaccataaattcaatgtgtctgccactccagagcaatacgttccttattccaccactagaaagaagattcatgaatgggtcccaccttcgacaccttacaagtgaccgcagtgaagactgttcctgcactttcaggctagttagtgcaggaccatcctagcagctggccatgaacttgattaaaattgtttgacctaaaaaaaaaaaaagaaagtgatatctaattgagaggcagacagtgatgagtcagagaaagatttgacagaataggatgtgcccaactctcacgagacgagtgaggaaagggaagctatttaagggagagacagacagtaaaggaagaggagagtacagtacaggaatacagtagagttcctagaggacagtgcagcagagtggagagggagaaggagagcagcagtattactgggacaattgaacaaagacaggttggagagagagagagagagagagagagagagagagagagagagaggagagattgaatgagtcagcttggagaggagtttgagcctgaacagctgagtccagaaagaactaggaaaaggtaagcttattcaaaagcaagtctcagagactggaaacattctaggcctagataagattgtacaaaggctagaagcttacaggactcgggctaggttagcagtaagcctgccagacaacaattataacaggcaaataaaagttccttttacaggtcctctgcaaaacagtatgtgctcttaactgctgagccatctctccagccccataacatgcacatgttcatatagtacatgatgtttatgtttttaaaattatctagttttgttgaaggagttgtatagaggccagaggctttttccttctgccaaatgggttttgggaattgaatttaggtcatcaggcttggcgccttttatcttacctactgagccaccttgctggccctgtaatgatattctgaggcaggatctttctctgtctcccaagctgacctcaaactcactgtgttttcaggggtgaccttggactttgtttcttttacgttttgttgtgagtatgtataaacaggtctcagtgtggacatgtgcaaatgaggccaggtcctgtggaggtcggaagcatcagctcgctctgatctggagttccagggtgtgagacactgggtagggtggggggaaccaaactcaggtcctctacgagagcagtgtgcaccctcgactgctgagcagcctctccagcctcatcatttagatatgttgaggcatgtgacttggactttggatattcttgcctttaccttccaaatggtgggagtacagggtgtgccaccatgtgtgcagtggtggggactgaactcagggatttgagagtgctaggcaacatagctgcatcctaagccttaaatgcgctaggttacatttctttctgcacctttaaagacttatttgtgtgtgtgtgtgtggtaccagcatgtatgtaagtgcaccacacatgttcagtacctgaggagaccagaagagtgtgttagatttctagagctggagttagaggaggttgtgagctgccatgtgtgtgctgggaaccaaaccaggtcctctacaggggcagcaagtgcttttgaaccctgagccatctgtccagctcctgcattgatttatggtatgtgtgcgtgtatacaaatgctgcagccttgtatggaggaaagaggacaagtgcagtggtcacttctctcttcctaccctttgagctcccagactaaactcaggagggcagactggtgacaagagtctttacacactgagccatcccactagcacttataagccctgtttcttaatatgggaatttatgacagggtttaacccaggttgccctcaaacttagtgatatttcttcctgggcctcccaactgctgtgactataggtgtaaaacatgtttggttgttgttttgttttgttttgcggggtactggggattaaagctatatattgaaatcttcaccaggtatagaatttcatcttaaaatagctatgtacctgagatctcagacccacttggtatatttagtttctgtttataaagtcagatctttcttagtaatttgaacaagatcttctagaccctgggaaaacctggagaggacccagatcattcacagtctttcccctgaatttcagacttcagcgggaggaggaagaggccttcgcgagcagccagagcagccaaggagcccagtccctcaccttctccaagttcgaggagaagaagaccaatgagaaaacccgaaaagtcaccacagtgaagaagttcttcagcgcctcttccagagctggatccaagaagggtaatttcctctctccttcttccatgcctgagtaagctgcagactagatccagaacgcaggtggctcagcctctcacttctgtaagcccaagagagctctagtccagagttcacatggaagtcaggtttgatggccaggcatttgatttgaaggcactgtttccttgttttttaaagaagcattttattccgcaggagaactaaagagaattgaaatgtgtaattctgttagtaacgctctccattctcatccaaactgcttatcactggctacttaatggttttgttttgtatttttcatgcctttattttttttctcatccttgtttgtttatcttgtgtaatacccactctgtcaataacttaggagaagtggctgtttctaaacttgaaagtcacctgagagactttctctctcaaagcttatttcctatgctgttaggaaacagacaggaaaaggctcatttggggctcttaaataactcatgttaaacattttcttgtggatggatttgtgtttgttcatctaatttaagaaaataaccttccagcctggcgtggtggcgcatgcctttaatcccagcactcgggaggcagaggcaggtggatttctgagtttgaggccagcctggtctacagagtgagttccaggacagccagggctatgcagagaaaccctgtcttgagaaaccaaaagacaaaaacaaaaaaaaggtttggctagcacagtgccccaggggataaaggtccttccttcgaagcgtgatgactggagtttgaatggtccccagaacccaagagctagaaggaagaagctgaattcctagagtgtcttctgacctccatatgtgcacttcaacatgtgcacacccaaacaccattgcacacatgtacatttacgcactaaccaatcagctaagtaaacgttaacttaaacattaaagaagatgcttgacctcgtctgcagctctgggtgttggaaggccgttctgttaacacctaggaattccggagcatttacagcactgctagtacaaatctccaaaggttggcagctggtgattcacattctaggaccgtattgccatagggagtgctgcctttccctttggcttgtatcttttacccacctgcctagaagtggggattaaacccaggttctcctgagtgctaggtaagggctttcttggtaccagttgtgttctcagtccttgagttctccagaccgggtcatgcttagagcctcatgctggctttgaactcactgtatagctcacttcaaacttggaatcttcctgccctcatttcctgctggggcaggaggctgtgtttgtaaaaaaaaatcttctgagggtgaggagctccaactatgtaaaaaatgtttcatttctaagtgctggccttgttggctgtgagtttacagatgacctccccacttctgcctgggtgccttgttaagtccttaataagcacactcagctgatccccagtacaggtcaccttagagtctaacagtggccagctttggtttctgggactttattttacttccttaatgtgtagagcctttgcccttgtcagtttatttatattagcagcacaaaagaaagctcttgagcccagtgagcttgactgcaaacaaagcacagccttctaagggatttgaagaatgtgtgtgagtgtgtgtgtgagtgtgtgtgtgagtgtgtgtgtgtgtgtgtgtttggtgcgtgtgggtctgtatgtgcatttgtgtgatagtgggtatcttatttgattgttctccaccttattatttgagacaggctctctcagtgaaccctgggctcaccaatttggataggctgattgccagggagtgccagagtctgccgccccagtgatggcattacagacacatgatagcctacctggcttttttagtgggtgctgggaatcaaattcagccgccccccctgcttatgctgaaaataattgacactctgcacctcctcatgttgtctttattcttcataaccatgcagattaaaaaggtttatctcttcatatatcaaaggggaaatctgatgtaatatttggtctgtttgatataccaaatattagttgactagttgatactcactgacttttaattgattgactgaggtcagactcactgtattcccatgctggcttcagtctcctgggcttaagtgagtctgttgtcgtgcatcctcctctttggcttttttattgttgttattatcattgctattatttatgtgtatgagcgtgtgcatgtgagtgccatctccacagaggtcagaagaggacattgggttcactggagctggagttacggatggctgtgaaccattcagcatgggtgcttctggaagaggagtgtgtgctcttagccattagcccatcttttgacacccttctggggatttaggtagaaggaaacagatgctgcagtaataaaaagatggttgccgggcagtagtgacgcacatctttaatccctgcacttgggaggcagaggcaggcggatttctgagttcgaggccagcctggtctacagagtgagttccaggatagccagagctaaacagaaaaaccctgtctcgaaacaaaacaaaacaaaacaaaacaaaaagatggtccagggtagttataaagaactggcctgggctccagagtcaaatctgttttcaaatcccagctctttcttttactcacatgtggctttggacaggaaagtgacaaattttctaagattcatatataataccatccagctcattaactgttaagttaatgagggatttaatccatactgcatgtgctccttgaatgatagttgatatactggttcaagctggctgggcagcagaggtctttaaacatttgagctggtgacagatgacagctggagaaccctgtttgactgggtgaacttgagctgtaaattgtctttatttgagaaacacaagatggctgtaagctgatgtacaagctctggttgtttggcccctggcaaacactgcaggtgtaacgtgggtaggttgttctcttccgtcttcttcttggttggttggtttgttttgtggtctgtgtgaacactcgtagaaccagccctgtcttctagcactgagcactactccagccccctttgcttacattttaaaaggggatttgaggcagactacattttttagacaaggtctcactttgtagcccaagatgtcctcgaactcttcctttagccttgagatgtgggtatgaaccagtgtgctcagctgaggactttccccttggtttattgatgtatgcaagtgaaaccatgagggaggtgactggctttcctctgcctttggccctgaagctttcattctccacatagtctaaggacttggcattctttgaaggctttgtttggtgctctgccataagggagtataggaaggctcaggagtcaaacacattggcttgagttcagttctgtccttaaccttgggcaactgaatcattgaggtttctaaccatcttcaaggctcagttgcttcatttgtcagttttgtcccatggaagatatgttctgcttctgtttttgagcagtctatacatttcagttgagttatattgatccatggtattgctcaaatattgtgattttgtttttgtttttgttttttgagacagggtttttctgtatagccctggctgtcttggaactcactttgtagaccagactggcctcgaactcagaaatctgcctgcctctgcctcccgagtactgggattaaagggatgcaccaccatgcctggtgtgattttttttttttaaaggtattttattacacacacagagagaaagagtgaatgaatgaatgaatgtatacgtgtggggaggccatgctgggcatgtgagggttagaggacagtgttgccttcttggcacaattgctgggtgctactgtctcccacctggaaaagcatgtccttttcaatactcttagcttcatgcctcccacctactctaaacttcagtggctagtccaatctagcccctgccaaacatccctgataaacctatctatagtagtggccacagtagtggctcctcctgagacctcacatggctgctgggttcttctccctccaaagcatgacaaaactccttctctccttccttgcttgcatcctcctttctttcctctaggactcagaagtccagcctgtgccatccgcccagcaattggcccatggctttctttactgacaaatcaagaaccaattggggaacaggaccttagcatcagaatttgtttcttccttacatttctgtctttgctctttgcattttgaagctgtgttgttagatatgtgttcaggattgctgtgccttgaagagttaactttccattatgggatgctcttctttgtgggtgggagtagctcttttagattatttgactgcatctttttcctacccttagtgtcctgatacacatgttgtgacatggggtcttactttgtagcccaggctggcctagaatccacattcctcttgcctgagcctcctaagcactgggattaccctgcagcttctgtgcccagctgggaatgtgggttttaaatttgttggttattgctgaattgtccccttttaaagttctgatacttgggctctggcctgcacagtgtaagaagcttttgtgttcttgtcaagatcaaatttcagattttattttagagtttcttgttgtgaagagacaccatgcccaagacaactttttatggttttgttgattattacctaaacttcgaacttaacttttgaatggcatcttcttgtgccattcgtgtagacgcacatgcaaacaaagcacccatatacataaaacatagaagtaattccataatctgtctgtctgtctgtctatctagtgtgaggtgtaggatatgtttccatatgtagaaatcagagttttgttttttttttccctaaatagcatggtgttaggcttggtggcctatgcctttactcccagagactaggaggtagaattaggaggtagaaacaggcagatctctgtgagtttgagaccatcctctattgtacatagtgaggccctgtctcaaaacagacaaataaaattaaagtgtgaggttggtaggctttaataccttttggtttctttttcctgtggggttggtggtgcacacttgctgaggaagctgaggtgggaggatcctgtctggaaaggaaaaaccagacaaaatatctctatctctctgtctctgtctcccccacccccatgtgtgtgtgtgggatagactcttgctatatatagctaaagctggtgtcagatgcactgtgtaatccaggctgacctagaacttgatcctcctgcctcaacctctttagtgctagaattacaggcatgtgccaatgcacccagcttggatgcatttttactgagagcagtgtgacttgcaaactgaatggtgggggaaataaactggccttttgtctctttgtagtgctgtgtgtcacctgctgccttcctgcttccattggtggttacggtgactttttgactcagcaagaaagttgttcaagaaagggttctgtttcactatcagtattagtgactaaaaaatgctaataagctgtttctatttgctttctgttagtttagaaaaaataaaaaaattattagttgggtgtgtgtctgtggagataacattaaacactgtggaggtttttttcttctacctttctgtgggttctacgggtaaaattcacatctctgggcctgtatggcaagcatttcccctgttgagccatcttactacccatggttagttggggtttatttatttattttttatttgaggcgttggcactggtacttttccacagcactcagtagtcatctctgaggaactgtgacttcagggagtaccaggccccttcacgtgctgcctgacagtgaattatcctgccttcttacatcgttaactacctaatgcagctgttgggttggtagcacagatgtgagagtctttgttagtacttgacttgctctttctttttttaaattgtttttattggttattttatttatttacatttcagatgttatcccccttcccagtttcccctctgaaaaccccctatcccatccaccctcccagccttttctgtttgttaacgtattttctgggtctcctttgtagctctttggtctggaactcgctgagagatcttcgtgcttctgcctctgctaggattagaggttgttgacatcacaccctgccttgtatttgtgttttaagaattgttatgctgtagttcagttcttgagcagagaacatggcagaactccattctgtgtttcctcccggtggatcttagggattaaagtcagctctccaggcttgtataagaagctcttttacctgtggatccactggtcattctgtagataaggtttctgagacagggtcttgtgtagccctcaaactcactgggcaactgagaatgaatgacctttaactgacctggatcttcctgctcctacttcccaagtgctgcgattagagctgtgcacagcctgccttgttgactccttgctggggatagaacccagggatccctacaggccagcaagcactactctaccaaccgagccacagttcagctctgctgagcatgttttagaacgtgcagttttatttacttacacttcctatttttccttgctttaaggaaactcatccaaatgtttcaatataaagtgctattactttaattttgattaaacataatttcagtaatcttgttagctacatagagtaattccatacatcagtcttctgggtaacaaaacttactgtgtttaattttctcagcagaaattcaggaagccaaagctcccagtccctccataaaccggcaaaccagcattgagacggaccgagtgactaaggagttcatagactttctcaagaccttccacaagacaggccaagaagtctataaacagacgaagatgtttttggaagcaatgccttataaaagggtaggctgacgctaccacttggaaataggagctgtggtttagggagggttagggagagctgtaatcttgtcattttacatctgagaggaacaagtgatagttacctaagaccggccttttagctcagctaacacctgactccaagctagtacttttccactgtgccctggtcatctctgtgaaacttctgcagctagagggacaggctgcctcactcgttacctgtgctagtgcagcctgcctgcatagacctttagctcaactgtttggccaggagcaggaactagacttggttcctcattgcttggatttctttttgtgtttggatcttccttctgttccttattcctcagttaaggcaaggtctcactgttatagagttggctggcctggaactcactatatataccgggctgacctgaactcacagagatccaccttcgagctaaaggtgtggccaccaagcctgttgtcaatgcagagttttagtatgcttctctgtgtttgtttagagaaggaaagagagtgtagaggtgaaaggaaccttggtggctacagtttcagtcccgttgttttgtagatgaaggatggtgaaaggcaaacaaaacagtggtctggttagcttgctagagttttcaaagtgaaccagagctgtggcttccacatgcctctcactgtagcccaggctagtcttcagctccctggttcctgcctcagctggcacagtgctaggattgtggaaacacaccatcatgcctgtagggggttattttgtgaggttttgaggtggggtcccggtcatgcttgccatatggctgagactggccttcgacttgagaccccccccccctccctgccccctccatagcctctgggatgctgctgccatttaggggtgtcatttgccacaatgctccatcacacctgtgtctttagtccaaagtttcttatctgtaattttagttctcataattcataaaactatttgtgaaaggaatcattttgtaagaaaaactgaagttttttcacttctaccatattaaactcaactagctctaccagtgccttctgtgaggggaagagagcttacagagaggggagggaacggcgatcaacaagcagctgctgtggccatgcccccaaatgttctaagattcggtgctccaagaaagggctttccttcttgctcttcgggggtgttgtgaccccgtgttagaaagactgtatcttttactttaagtgtttatgaagaaacagtgacatttggagttgaagcaagctgccactgaggtgtggtgtgtgtgtgtgtgtgtgtgtgtgtgtgtgtgtgtaatgacactgaggtgtgtgaggggagggataggcttgaatgtgtgaaaagtcaagtttgaggttgtttttgcagtgtcaagaggacacctctgataaagttgtattacactgtagtatgtacagaatatatactactgtgtttatattgtatctacagaaacactgatcagcttgggtttttcttcttctgagaagcataaactacccttattctttaagcacttaattgactttttagtgagtctgaaaataaagaagcaagtctagcatagtgatgcacacctttagtaacagcagtttagaggcagagacaggcggatctctgtgtttaagtttagtggtctacatagtaagttctaggctagccagggctgcacagtgcaacactgtctctttctttcttttttttgggggggggagggggtttgtttttttttttgagacagggtttctctgtgtagccctggctatcctggaactcactctgtagaccaggctggcctggaactcagaaatccacctgcctctgcctcccaagtgctgggattaaaggcgtgcgccaccacgcccggcgcaacactgtctcaaataaaaaggaaatagaaaaaaaaaaaacaaacaggaacactatgctgtgtgttcagagcatcactaattggtgctggagacctgataagcttcaaattcctcctgacttaagaactactgtgcagctaattttcttttatactagcgccaagtgttttgtggtaaggggtccagttgttcatgtgtcttgtgtatctttggtgtctagcatgatgggcaacatccagatacagctcaggtggatttttaaaattgcattgattggttgattgtgtgtgtgtgtgcttgtaggtaggcatgggtatttagaggtcagaggatgactgtcaggagtctgctctcacctctaccatgtggggctcagggatcaaatttgagtcaccaggcttggcagcaagtgcctttatccatcgggctacctctccaggtgtttgaaggaatctctactggcctttgactccaggttataaaacttactatttatgtctgaagtcacatactctagctttacgacaatactcagataaatttattaaatacaacgtagggaacggttcttggagatttgaaatgcacttagattaaggtgcactttgaattcttcaaatgtgtttgcaaacctttaccccacttagactttgtctatcactctagtgcctcttcagcatgctacgtaagccctgcttgtaggggccaccccactgacccggctgcactgggctgtgtaggagccgccccactgacccggctgcactgggctgtgttcctgggcattgcacagattgttttctcccacgttgctgaggcctagaacagtgacacactcctgcttctgtcccatgtggatcgttcctgttgtttccagtcctagttaatgccagagttgaacaacctgttctgtgtgagggccaagacaagagagttgttttcagaactgtgttaaatgccttccccagctatttgttctctgttaggaaacactttatttgcatttaggtttttaaaaaaattcctgaacattattacttctggctgaaatttc

SEQ ID NO: 1556 - DNA, 264 bp, Mus musculus
atgagtcagcttggagaggagtttgagcctgaacagctgagtccagaaagaactaggaaaagacttcagcgggaggaggaagaggccttcgcgagcagccagagcagccaaggagcccagtccctcaccttctccaagttcgaggagaagaagaccaatgagaaaacccgaaaagtcaccacagtgaagaagttcttcagcgcctcttccagagctggatccaagaagggtaatttcctctctccttcttccatgcctgagtaa

SEQ ID NO: 1557 - protein, 87 aa, Mus musculus
MSQLGEEFEPEQLSPERTRKRLQREEEEAFASSQSSQGAQSLTFSKFEEKKTNEKTRKVTTVKKFFSASSRAGSKKGNFLSPSSMPE

SEQ ID NO: 1558 - DNA, 26332 bp, Homo sapiens
agctgctggcaggaagcactctagcagggactctggccttgtgagtgtctcggattcccccttttcttccttttcacctaataaaaccctgtcttacccaccattcaaaccgcctgcgagcctaaatttttgtggctgtgagacggacaaggatcccgtctttagctgaactaaggaaaagtccggcaacaatggatattggaaataatattaatggataggttttactctcctgcaggattaatataacctgtgagtacttttaggcttactaccagtacaaggaatggcttttggaaagttcttagaatgtagagctgtgcttctgcactttgttcagctacaagcagcctctttgtctctctgtttcaggatctaagcattgaagaacagtcagagtgtgctcaggatttctaccacaatgtggccgaaaggatgcaaactcgtgggaaaggtaacactgttagccattgagagattgcgggtattgcacagggatgactgctcagtctcttagcaatttctttctttctctgatggtctggctggtttgtagacttcatcctgtaacctcatggacattctgggaactggtcttatacttagcagtgcctttgaactgtaccatgcgtatctttccaggagcaattggataatttattgagtaacatttaataactccattggggcagggctggagctgacgaaaacatcttagggcctggctcagtagctcatgcctgtaatcccagcactttgggaggctaaagcaggcggatcacgttaggccaggagttcgagaccagcctggccaacatggtgaaaccccgcctctattaaaaatacaaaaagtagccgggtgttgtggtgcacctcttatcccagctactcgggaggccgaggcacaagaattgcttgaacccggaaggcggaggttgcagtgagctgagactgtgccactgcactccagcctgggcaacagatcgagactctgtcttcaaaaaagagagagagaaagagaaaaacttattggaaggctttgctaaatgaattttccatcttggaatcaccattttggtgagttattgtattaatagtttaaaaaaaaaagagcttcaagtttttagggattctttatggattcaaccttcactgatactagactttaggatatacttagcacatgtgtgtgtcagagaaatctccatttgtatacctcagagagctctacgatgttatggtaaacctcagaaaaatgaaaggataagtttcatcagcattcatcagtcttgggagttgcaaatgcctttgtaatgtaggacagggagtgaccttgctgaagtctccccatttggcagggtgtacactgttaggtcctgtcagacaacttcagttagaactgaggttgctgtggaaggcagcccaacagttggaagaagatttttttgtttgtttgtttgtttgtttttgtcgagacagaatatcactctgtcgtccaagctggagtacagtggtgtgacctcggctcactgcaactctgcctcccaggttcaagtgattctcctgtctcagcccccgagtggctgggattacaggtgcgtgccaccacacccagctaatttttgtatttttattagagaggagatttcaccatgttggccaggctggtcttgaactcctgacctcaggcgatccacctgcctcagcctcccaaagtgctgggaatacaggagtagagccaccgcacccagctggtaagttttttttttaagcgtatttttaaatataacattcttatacttttgttctgagtgtgtttaatttatttctagtaaattagttttttgctgtgtagacagtgctatgaaaatatactcttggccgggcattctggctcacacctataaacctagtactttgggaggctgaggcaggtagattgcttgagcccaggagttcgagaccagcctgggcaacatggtaaaaccccatctccacagaaaaaacctacaaaaattattcaggcatggtggcgtgtgcctgtgatcccagctacttgggaggctgaggtaggagaatggctcgagcccaggaggtggaggtttcagtgagccaaggtcatgctgctgcactccaacctgggcgacagagccagactctttgtttgcaaaaaaaaaaaaaaaaagagagaaaaaatatatatatcttgatcttttctctgtctggttatttcagtgcctccagaaagagtcgagaagataatggatcagattgaaaagtacatcatgactcgtctctataaatatgtattctgtccagaaactactgatgatgagaagaaagatcttgccattcaaaagagaatcaggtagttgcttattttgttttgctttgtagttactaccttctaatggaagaacacactggggggaaaataatgcacctgtgtttcaaaccttaagggaaagcaatagctcatgttcctgcttccttagagtggaagcagctctgttgtgtaagaaagacgaggaatgtggtgacctcacctatccatctccctcaaggcagcttttggtaagagttgtgtttggtgtttgagattgttttcaatccctgaaatctccaaggaatagggggactgtgttcttggtccattaccatctcctcaagtgggaagctgtgaatatcggtatcaaggcaggggatgtcggctgggcccggtggctcatacctgtaatcccagcactttgggaggatcacttgaggccaggagttcaagagtagcccaggcaacgtggtaaaaccccgtctctactaaaaatacaaaaattagccaggcatggtggcgcacgcctgtgatcccagctacttgggaggctaaggcacgagaatggcttgaatccaggtggcagaggttgcagtgagctgagatcatgctaccacactccagcctgggcaacagagcaagactccttctcaaaaaaataacaagtcagtagatgtcctctttcctcattcctcccaggggtgtgcatttttcagcattccctagtcacatctttcactggcattggattgatgacatttcccacagcacccagtcttccaggctcactggggtgagccccagcactgtgtactccagttgcggtggacactgaggaagagaccacccaagtgtgggaacagggccaaggctgagctgatgaggtgttttaaggggagaagggactcggagtcccaggttccagacaaggggctggtacttgctagatctgtattggaagtttcatagctgaagtgaggagttgatactgggcaggctgaagatgtggagcccaaggtcaggagccagaagtaactagaggggccctggaccaagatgcagaacagaagcagtaaccaagcaagagggcaggcctgctgcagggtagttggagtgcagttagggtgggaccaggaaacacacagtgattcaggcatggtggtcctgcccgtggcctcctatacaagctccagtgtgcctcagaagttgagggttgaggccaggtgtggtggctcgcacctgtaatcccagcactttgggaggccaaggcaggcagatcacctgaggtcaggagtttgagaccagcctggccagcagggtgaaaccctgtctcgtaaaagtacagaaattagctgggcatggaggtgggcgcctgtagtcccggctgcttgggagcctgaggcaggagaattgcttgaacccaggatgcagaggctgcagtgagccaagattggcactccagcctgggcaagagtgagactccatctcaaaaaagaaagaagttgaggactgagtgtaaaaggacattaacgcagtaggcagcgaggacaggcagcagccaattctcaaatggtcactttcagatactgagtgcatttcagtcttggtagcactgcgtaatgtcatttcagtcagcaagatggccttccattcttgtgataaatgcagaagtctcattttaggatcctagctgcttcatcacgtcattagagctcgtagtacttgcaggggtgatgtgtgtgggcctgggattgagtggtcagtgatgcctcaggctttccctaaactgaaggaggtgacaagacaaatggccacagtttatccttggagctcttgtttactgtctctctctctttagagccctgcgctgggttacgcctcagatgctgtgtgtccctgttaatgaagacatcccagaagtgtctgatatggtggtgaaggcgatcacaggtcagtgaaaccaagagcctttttattgggatgttttccccttaaagttaacattttactgtaatattcatctatacatttgtaaaatgcagattgtcgaaggtacattggaatgtagtaaaagtgatttgtaagattgttttatgaatttgatggcattcagaagagcaggttctcttttacccctttattttcagggattatggtctcgtttcttgggcattaaactaaactaaggtcaaatgcagatagaataaattttttttcttttttttgtacttctttttttatttagtttttattcagctgactgttccatgatagaataaatttcttaggattcagttgcatttatatattcaaaataattttggatagaggaagggaactggtaaggcaaggtaatccccacgctggagtaacgtagtaaaatgatgcctctgactggttgttagagaagcgctatgagttatttttctggtttgatcaggaaataaatgaagttccccaaattgatgtgacactgccgttctagacaggtccagcctcctaataaggtttgtttctcattcatgggaatgaaccagcaagagtgcaacacaaacgtttaaattacaaaaaaaaatcttaatggagagatggtcatctttggccagtgtctcctttattagaaagaggccttggaaaggcttgttcatgtagacattgttaatgaaattctattggaaaggaagtgggttaactgatattagtagtgttggaggctggccatcgagtaggctccttttgttacaggaaccagagactcacccaagctacagaagaaatggaggtttgcttaaggtattatcagggttataaaggaggtggagtctttcaggaccctagccccaagggtcatccagggagtgggctatcttactgcctctacaacggcaagagggtctgctccaggcattctctgctgatgtgattcttccactttctcgggttctgcttctctttatcttcccgtgtcaactcctgttgttaagtaaattactagtttctgtaatttcttgtgcaagttctgaaggtagaatccaagtggcccagatcaatactattgtttttttttcttgcaagcttttctgctaggctatggcgtaggtcatgactactctgccccccgcaccttttgctcggggaaccccataagaggttgaaggtggaggccttctaaaagcctgaatatggacctgggacttgtgtttttcctgactcttactagaaagttcaagatcagctggtttacatttagagtgttctatgagagttttgtccaagccaccgtagcctttacggcctgttgctaatagggaagtccccagccttcctggcctctttcacccaagtagggcatggttcactgggcgacagctggtagcgagtgtttgtgtgacccatcagtggtgaaagtagaggtgggtggcccaagggatcaggaaagcatagctgtgttccatgaatagtgggactcgataggagaggctgcccgttaagttacacagtgtgggtcacgttcttctagggcaggaggctcatgttctgggctgacaagtaacaaatacgaggtctgttgaagagaactgcataaaattttgaaagtcatcaagtcctctgccctgaggtcgaacactctttaggacttctgaaaggaagagtgtgccaccccaggaaggggatcagagagtccatcatcagctcctcttagctccaagagtttaggacaaggagagtgtcagggcctgtggctgatggtggaagtttccctttctttctgttttgtttaatttttaatttttatgtgtacataataggtgtatttatttatgagttccgtgagctattttgatccaggcggataatgagtggtaattaccttaggggaaatggggtccatcctctgaagcatttagcttttgtattacagagaatcctgttatattctcttaattactttttaatgtacaattaaattacttttgactatagttcccctgtcgtgctagcaaatactaggtcttattcattctttctaacttttctggtaccccttggccatccccactatcccccatgccctgcattacccttcccagcctctggtaaccatccttctggtaaaacatccttcagttttaagtgtttagctcccaccaatgagtgagaacatgtgatggttatctttctgtgcctggcttatttcacttaacataatatcctcctgtttcatccatgttgttgcaaatgactggatcccattctgaatagtactccactgtgtatgtgtgccatgttttctttatccattcatctgttgacagacaccctttcccatttggctccacctgcatgacttctgtgtggctatgggggcagtggttcttagccaggcaccagtggtcccccggagacattggacaacatctggagacttatttatttagttagttagttagttatttatttttgagacaggatctctctgtcacccaggctggagtgcaagtggcaacgatcatggctcactgcagccttgacctcacaggctcaagcgatccgtccgcctcagcctcctgagtagctgagaccacaggcacgtgccaccacacccagctaatttttgtttacattctgtagagacagagtttcatcatgttgccttggctgctcttgaactcctagactcacctccctaagttactaggattacaggtgtgagccactgagccaggcctggagacatttttaaatgtcacagctgtgggagtactactaacacctagtgggtagaggccaaggattctactaaacattctgtgatgaacaggatggttccctacaacaaagaattattcaaccccaaatgtcaggagtgtccatgttgagaagccatgacctggaggtacagcctttgttttcacaactccattaaagataagcctggacacctggatccagcagagatggagcgtatacttagctctgtgtttcctattcatgtgaaggcagagccctgggagaagacatagagcaattatgcagggctctgaagagtaaatcatagcaggcaggctggggagggaaattattagacagcagtgagtttcctgtgtgttgctttctcctcacatgtctcctagttgagactttgaagcagtgcaaatcatggaattgcacacatgggaaaatccaaagagttccacgaagaattccttcaggccagaggatgctaggaacgggtctctgcaggatgaagcatgtggaagagatccctgggggtgtttgtctttctttattctccttttccttcccttctctccctttttccaccccagccctgccttatggcaatagcagccacacatccagataaaacataattcactttttactcgctttcaaaatgtcaacagtaaagatgaacaggatgcaagatgaaagaacattgaaaaataaagattaacaagaaagtagtttaaataaaagagagaaaaaaaaatcaccaataaaaggtagaaggctaaagataaatgaaggtagtaaaaatggctttaaaaaatcttacccaatcttacccaattcttatttagaataagttccatataagtagaaaaagaaaaataaatagatcaatgtaacaataattataacccaggattaaaggattaaaggaagcaaacaataaaacagcaaaaattatgtaattcacacagtagcctcataagtaagggaataaaagcactcaaaagttaaaataatgcctgtgcactgcctagcacatctgtcccccacacgttgtctttcatggcagatgggcctaggagggttccccaggaagctgacctcagggatgatctaaaagctgaaagaaccctttggtataccccaccgcctggccagagtctgaaacgtttattcctgctagtggcaagaatttggtgtaaaattaagctgccttggctcttttcttttgtgatgtcccaagttgctggccgatgtgcaaccccagaggtacgctgcctctccagcggtgctgtcaccacgtgcttcagcacccttcgctgtcccccaggcttgttggaaaagggtgggcattcatgagagcccactgcttggacttagtgatagttgtgggtagtgaaatttttctgccgggagcagtgagtcacacctgtaatcccagcattttgggaggctgaggtgggcggatcacgaggtcaggagttcgagaccagcctggccaatatggtgaaaccccatctctactataaatacaaaaattagccgggcgtggtggtgcgtgcctgtagtcccagctactcaggaggctgaagcaggagaatcgcttgaacccgggaggcggaggttgcagtgagccgagatcgtgccactgtactctagccggggcaacagagtgagatgctgtctcaaaaaaaaaaaaaaagaaagaaagaaatttttccctgggagaagtaaaatgttattttgagattaagtttattcccttgcttgatcccctctgccaatcagcaggtgtgaatgttgtgatttctgtagctagtggagatccacatgctggagagtttggccactgttgaactaagtgtgtcggattccagtagctggatttttttttttttttttaacaagattttgctctgttgcccaggctggagtgctgtggtatgatcgtagctcactgcagcctcaacctcttgggctcaagccatccttctgcctcagcctttccagtagttggggctataggcacacattaccacactcggctaatttttgtattctcacattcaatacaaagatgctttgtgtagtagccacatttctaaaaagcagtatgcaaattgggactgtcgaaaaacattctaaaatgtaacagaggcacagaagcagtaaaaagactcttcatcagacaacttcttccttctccatggagctcagaggcagcttacattgtgattagaagtgtgggcttggccaggcacggtggctcacgcctgtaatcccagcattttgggaggccaaggtgggcggatcacctgaggtcaagagttcgagaccagcctggccaacatggtgaaaccccgtttctactaaaaatacaaaaagtagctgggtgtggtggcgggcatctgtaatctcagctactttaaaggctgaggcaagagaatcgcttgaacccaggaggcggaggttgcagtgagcagagatcacaccactgcactctccagcctgggcaacaaagagtgaaactcagtctgaaaaaaaaaaaaaaaaaaagtgtgggctttacagtcaggtagacatggtttcaaattcccaccctgctacatactgtctgtatgatcttgggcaaatcatttaacctctctgaacttcagccccctcatccctaaaatggataatattaataagagtatccattgcataatatgaggattagagaaatgtgcttgtagggtacactgtgtattacctggctcttggttctgttttccatgagtatgagatcatatttactaagttattatatactaagttaactgctggaaaaggggttaataaggattccttcataactttagagataaaacatgattttcctattgcttcttttttgtgattcttttctcctgggaaatattgtcttttctgctttgtagatatcattgaaatggattccaagcgtgtgcctcgagacaagctggcctgcatcaccaagtgcagcaagcacatcttcaatgccatcaagatcacctagaacgagctggcgtcagcagatgacttcctccccaccctcatctacattgttttgaagggcaacccccatgccttcagtctaatatccagtatatcacgcgcttctgcaatccaagccgactgatgactggagaggatggctactatttcaccaatctggtgagtaagtgagttcttggtgttgtggagaaggactaggaaggtggtggttttggggatgtgacaggtcacttaggcccgtgacaggtgaatgcttctgtgtgagaaggcagcatggctgaggaagctcactttgcatcagggagcacaaggaccaggccatacagacactccgcctcccagcacttgatcagagattgtgtttatcctacggaaacagatgacatgtgttgggcatcactccccacggtcctgggtagaagagtccttcacttggcagggctttttcaaccatgaataaggcaaattatgtataagttaataaggctgaatatttgccccctcattcattcactcattcattctactacagggtctcactctatcacccaggctggagtgcagtggtacaatcatagctcactgcagccttgacctcctgggctcaagcaatcctctcacctcagcctgctgtgaagctggtaccacaggcatgcaccatcacaccgggccaatttttttttttttttgagagatggggtctcgctgtgttgcccaggctggtctcatactcctggactcaagcagtcctcccaccttgacctccctaagagttggaactgcaggcatgagccaccactcctgacctgaattcttcctttttcttcctactaaactctgcttatttgctttagagggaatgtactgtaaagctaatgaatttggagacttggggcagcgtatggacttggttttctgtgttgagagcctgggaactaagaggtggggaggggaagccaggatgcattgcgagtatttctgataaattgccaaaaaagtctcacaggtacgtgaatctctcagtctctaaaaatatgtcatgatttatttctaggttctaagtatgtattcacatttatacctacttttgtatttgtcactcttcttccttttcctgtaagtaggttcccaaaattgtataagcttcaggttcctccaaacttggacctgcccccatcactcatcaccctccagcattgtgttcagctacatgttactgtagtcaccagcatcttgggagtgtgatttataggtggagggacttggtgctcttgatcagaatgatgcttttacctttattcacactgttttccatcctcccaggcacatggtggtttaatctgtagtactgaaaaaagtttaagtggcccatatagaatgagattagaagtactcatatatcctttttttttttttttttttttgagatggagtctccctctgtcatccaggctggaatgcagtggtgtgatctcagctcactgcaacctccgtctcctgggttcaagtgattctcatgccttagcctcccaagtagctgggattacagatgtgtgtcaccatgcccggctaatgtttgtatttttagtaaagacggggtttcaccttgttggccaggctggtctcgaactcctgacctcaagcaatccacccacctcagtttcccacagtgttgggattacaggcatgagccaccgcacctggcctcatatttcttaatataaatgaaacatacacttgcctacgagggaagagcgttttggattcagttctttatccaaagcgagtcagacaacctggaagtccctgagaagtgtgaaggtggagacatggcaggtattgagagaagtggaggaggaccaggacgtgtttgagcgtagccacggtcactgacagtagaggtggctggcttgcacacacttagcagcttctagtgcccttggcctgcagccttaagtacatttgtgccttctctctttgtcctcttcttgcctgactcagagtctgtctcctacacccattgctccaatgaaactgctctggcaaaagtaaaaagtttccagctgacgaaccccacgggcactcacagtcttcatcttccttcgcttctcatagcactctccaagagtcctttgttctgcaacttctgttgttccttggcttccacaattccactacttccttgtctctttgtaaagtctgtgtcttctacttccaccttgaattgtgtcattccatgggactccattgtctctgcatctctcttcctgcaccatcttctctgtcacagagctgtcactcactgtgcagtgatggcctgcagctctgggtcacctgtcttgaccttacacttgtattgcacctcaaatataatttgttcagagctacttccccttcagatgtttgtttcttttccagtattctctattccttttagtggcaatgccatgtctccattcacctaagtgaggagttagaatcacctcctctttccaggtcacagaggggccacagcaactccacacacaccatgagccagatggtgttccgttctactcagatgaatcagatttttctttttctttattccttttttctagagatggtttctaccccgactgtttcccaggctggtctgaactcctggtctcaagcaatcctcccacctcggcctcccaaagtgctaggattacaagcacgagccaacacgcctggctcagatgtctgttgaattgggcatttgcagtgccatgtctgtactaataattgctaccgtgtattcattgctcgctgcaggcctctcggaagcacgtgacatgttatgttgtttaattctcacaataaatctaggtggtatttccccccatttacaggtacagaaacctcagagagcttaagtaactttcccacggtcactcactgttgttgttaagtgaaagaggtgacagtgaactcaggttcagtcacttcagagttgttccttttttttttttttcctgagacagtcttgctctgtcacccaggctggagtgcagtggcgtgatcttggctcactgcaacctccgcctcccaggttcaagcaattctcctgcctcagtctcccaggtagcggggattacaggcgcccacaactgcgcccagctaatttttgtatttttagtagagatggggtttcaccatgttggccaggctggtctcaaactcctgacctcatgatccacacgtcccagcctcccaaagtgctgggattacaggcttgaggcaccgggcccggtctggagctgttcttttaaccacttgatgttaaaatattcatttgaggatcagaggtctgtgtgccacacctacttggggactatatcctgggtggggatagcaggtctgggaagactcagacagaatggcttcatggtgcacctggggaggctgcacccagacatcggccctggagctcctgggagtgtataggaagcacgaccggggataggagtaggtaatttttgaggctgaaatacacagaagttcatgagtttgttttgtttactttagcttctgttttaaatggtctgtgatcaaaagatttttacaaatcgactcgagtatgcatagctttcctaatatgactgtattaacgtcctcttcttgtagtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttccaaaaattgatttggttctttcttaggaaaatatacattattattaatattctcatgctacagaggttttctggttaagctatacctaaaaatgaaacattagagacatttgtcagttaaaattaagaagacaagaatatttgctgtcaccacaatcaatcaaccttgttcttgcagttctaccaaggtactcagtcttcaaacagacataaaagtagagaaaaaaggagttaatgtaatcaatatagagctattattgtctgttggtgaggacatgaactctgaagctggaaggcttggatttggttttgaattttattctgctacttattagctcattggccctgaacaaatctcttgtttcagatccctcagctgtgaaatggggttaataatattactgcttcatggggttgttgtctgaacttagaacaaatgatagctattatttgtagatggttattttatgtagaaaacccaagagaaggctgggtgttgtggctcacgcctgtaatcgcttttggaggcaaggcaggaggaatgcttgaggccaggagtttgagagcaatgtcagcaacatagtgagacccacatctctacaaaaaaaaaaaacactagctgggcatggtggtgtgtacctgtagtcccagctactggggaggctaaggtgggaagatcacctaagcccaggaatttgaggtggcagtgagctgtgatctcaccattgcatgctagcctgagtgagaccctgtcttgaaaaacagaaatgtaaaaaaagaaaacccaagagaatttatattgaaactatagaatttcatctctatattagtgaaagatgaaaattctaaaatagcgataaaagctaactgtacaaaatgactttcctatataccattactaaccacttagcaaacattgtggagaaaaaaatcaatttacaatagaaacaaatataaatcacctacagagaacaagagctttcaggatcgatacgaaaaacagaaaattgagtgagaagcacaaaggtgtgactgcaaagggccctgtgcttggactttagggctctgtagctgccatcgtgaaattcttcttttttgtttttgtttttctttgggctggggggtatagggtctggctccgtaacccaggctgtggagtgcagtggtgtgaacatgacttactgcagcctggacctcctgggctcaagctagcctctcgtctcagccacctgagtagctgggactacatgtgtgtgccactgtacccagctaatatttaaattttttatggagacgaatctcactatgttgtcctggctgatcttttttttttttttttttgagatggagccttgctctgtcactcaggctggagtgcagtcgtgtgatcttggctcactgcaatctccaccttctgggttcaagtgattttcctgtctcagcctcccaagtagctgggactacaggtgcgtgccaccatgcccagctaattttttgtatttttagtagagatggggtttcactgtgttagccaggatggtcttgatctcctgacctcgtgatccacctgcctcggcctcctgaagcgctgggaatacaggcgtgagccaccggcgcccagctgtccaggcttgttttaaactcttgggctcaagcaattctcccaccttggcttcctaatgtgctgggattaccagcatgagcctccgtgccccaccccaccgaaaaaagaaatttatacttaagtttttgcccacaggttcctcagtgtgttaaaaaggttgaatggggaacctgaaactcctccccctgctcttggaagtgtagggcacttccctttctccacagtgtcagtagaggatgggtggagactgaacttccagccctgccaggtgagaatgaagtgtttgttcctgtcctctccaccctcttctgtggtgttggtgggggctgaggggggagcctggatttctacctccacccatgataatgaggtcacaactcactttcttcaccagtgtgacattggctaaagaatatttaaattagattgagagcctcctaacataacaacaccccaaaccttcaagacacaataaaaaaaatcactgaccatctgggggcagtggctcctgcctgtaatcccagcaccttgggaggcccaatgtaggcggatcacctgaggtcaggagttcgtgaccaacatagctgaacgtcatctctactaaaaatacaaaaattagctgggcgtggtgttggatgcctgtaatcccagctactcaggaggctaaggcaggagaatcacttgaacccgggaggtggaggttgcagtgagtcgagattgtgccactgcactccagtctgggagacagagtgagactctgccaaaaaaaaaaaaaaaagaaaaaaaggccgggcacaatacctcacacctgtaatcctagcactttgggaggctgaggcgggtggatcacctgaggtcaggagttccagaccagcctggcgaacatgacaaaacctcgtctttactaaaagtacaaaaattagccaggtgtggtgggagcctgtagtcctagctactcaggaggctgaggcaggagaatagcttgaacccgggaggcgaaggttgctgtgagccgagatcacaccactgcactccagcctgggagacaagagtgagattgtgtctcaaaaaaaaaaaatcacttatcatatctgaaccaaatgacacatgtgttggaattatctgacaaagattttaaagaaggcatcataaaaattcaataactaaagacaaacatgcttgaaacaaatgaaaaaccccagcaaaaccactgaagacatgaagcaaatggaaatttttgaatttaaaatgacaataactgaaagtttttaaatttcatattagagggctgggcgtggtggctcacacctgtaatctcagcactttgggaggctgaggtgagtggatcacctgaggttaggagttcgagaccagcctggccaacatggtgaaaccctgtctctactaaaaacacaaaatattagccgggcatgctggtgcatgcctgtaatcccagctactcaggaggctgaggcacgagaattactacttgaactggaagtggaggttgcagtgagccaagatcatgccactgcactccagcctaggcgacaaagcgacactccatctgaaaaaaaaaaaaaaaattcatattagaattgcagtgatcgaagaatggattaactgggatatagatcaatagaaattcccaatgtgaacaacagagcaaaaattgaacttttaaaatgtaggctcagggacccgtgggatggttaaaagaaaaaagagatctatcattgtcactggagtaacagaaggagaggagaaaaatgcatatggctaaaaaatattaaatagcaactgaaaatctccccgaaattttcatgcctgtaatcccagcaatttgggaggccgaggcaggaggatcacctgagggcaggagttggagaccaccagcctggtcaacatggtgaaaccccatctctactaaaaaaatacaaaaattagccagttgtggtggcatgagcctgtaactcagctactcaggaggcttaggcaggagaatcacttgaattcaggaggcggaggttgcattgggctgagatcacgccattgtgttccagcctgggcaacaagaataaaactccatctcaaaacaaacgaagacaagtgctagcatgtgccaaagggatcccagaccaccatctctctctctctctctctctttttttgaaacagagtcttgctctgtcacccaggctggagtgcggtggcaccatcttggctcactgcgacctccgcctcccaggttcaagcaattctcccgcctcagcctcccgagtagctgggatcacaggtgcacgccacctcacccgacttaattcttgcatttttttggtagacgtggagtttcgccatgttgcccaggctggtctcgaactcctggcctcaagccatcctccctccttgacctccccaaatgctgggattacaggcgtgaggtgccgcacctggctcctattctgatttcaaagcactaagaccacagctgattgctgaataaggagtgggcgtgtcagctaccttcccggaggggggcaggcaggctcctgggccctgtaccctcccaccccctaggtccccccaccatccacctgtaggcacctcctctcccctggagtctctaacacagagctggcagggtacagtcgggcctggattgctaacctggcttgcctggtcccttaggccctgaagttgggggccagctcctccccacttccagcctggccctccaatcccaaaccaggtcagggtcatggtgctgggacaacagacctccccctgagctcaaccttaccttgaaagccctgtctcttcaggctctcgcccaccagagggtccctggaatccctctctgggggcagggcagggggagagaaaccaagtgaggaggcagttcctgggacccaagatggcatcattaggggaaacccagtgcgggggtgtggggagaatgccagggccaagatgagagcaggacagagccagcaggaggaggggctggtggcagaggctcctgggcccctcccttgcccgcccacaccatgtcccacgaccccgcgctgggtaccttgactgtcaatgatgggctctttgactccctcagtgagcagctcaggcctggaaaacacaagtggggccatcacagaggtccctccaagcatctctgggactgcccagccctcccctctgggcctcggtctgcacatccctgcaatggaccctcctggctccgcacagttaggcctggagtccctgctgccccatgtgtggaatctggggggctgccctgggcttgaaggatccagctgggagtgagacccacccagtcctgaacaggtccgtctgatatctcactcctgctccagggacattgcacgattgtcactacctgggattggagcaggcggcctcagggggcctcctgtggagctggtttaaagtgtagaaacaaggtctagtgcagtagctcacgcctgtaatccctgcactttgggaggtcgaggaaggcagatcacttgaggtcaggagtctgagaccagcctggccaacatggtgaaactcgtctctactaaaaatacaaaaattagctgggtgcggtggcaggctcctataatcccagctactcgggaggctgagggaggggaatcgctgaggaggcggaggttgcagtgagctgagatagcgccactgcactccaacctggatgacagagcaagactccatctctaaataaataaataaaataaataaataaataaataaataaataaataaataaagtgtagaaacagtcggggtccactacatagcaagaactctgagcttctggaaaggtctcagatctgtggctcacatctgagagctgctgtgtaaatgcagtcgggagtgccagtgagcaagcccagctttgtattataataatgtctttagctccacagactccagaaagccctgtccagacatgaatcaaccttctttatcataccacactgcttctaaagtctccatcttcagcacaacttgtcctgttagagcaagcctgttggggggctggggtttgtggtgggtagaggacactgggaaaatcatgctggccagaagggggctgtcgggggatggcagggtaggccatggagtggagaggtaatgagctctctgtcacaggggtaatcaagcagcagcactgaggagtctctgcctgagagtgagcccaaaggccaaactctcaaggagggcaccccttgggtccccagtagatgaggatttggtgcctgctctggcggtgggcatctcttaagcttctgaacagtgccaggcacagagctggggtcacagggccagggctgggagggggaagcataaccctgccttgaaccacagtctcaggagctagaaaaggcttcggactgcatttgggcccctcctctttatgggagaactcaggttctgaaaggggaagtgacttcccagcagtaaacttagagaggcagaagctgggcagagcccctgagtcccaggccagagtagcgacagtgcttccccttaaatagcacagccggctgccaaggccacagggagtaacaggaggagctggcctcaaacccaccagacagcctctcccgtcggccactgcgctgatctgcctccttttccaaatgacaggtgtagaaagccatcgtgactttaaaaagtgctcaaggctgggcatggtggctcaacctgtaatcccagcactttgggaggctgaggcagggggatcgctttgagcccaggagtttgagaccagcttgggcaacatagcgagaccccttctctacaaaaaatgtaaaaattagccaggtgtggtggcgtgctcctgcagtcccagctactcaggaggctgaggcaggattgcttgagcccaggagtttaaggctgcagtgagttatgattgtgccactacactccagcctgggcttcagaaagacctgtctcttaaaacaaatgctcatggccaggcatggtggctcatgcttgtaatcccagctactcaggaggcttaggcaggagagttgcttaaacctggaaggtggaggctgcagtgagccgagatggaaccactgtactccagcctgggtgacagagcgagactctgtctcaaaaaaacccgcaaaaggctgggcatggtggctcacgcctctaatctcagcactttgggaggccaaggcgaacggatcacttgaggccagcctgaccaacatggtgaaaccccgtctctactaaaaatacaaaatttagccaggcatagtgacatgcgcctgttattacagctactcaggaggctgaggcagggggattgcttgaaccgggaggcagatgttgtaagtcgagatcgcaccactccactccagcctgggcaacagaatgagactgtctcaaaaaatagaaaacaacaacaacaacaaaacccacaaaaaacaaaaaaacaatgctcatgagcacaaggtgtctctgcacaaaaccataaaaaatgtcattcatgaggacttgctgttgaattggcacctaacctcaagctgcccgggtgcccctggtttatggtttgagggagtgggcgttgaaagcaaaaacaaaaacaaaaacaaacgagaatgagaccctgtctctaagaattttttaaaaataaaattcaaactctttaagctggccccaaacccatgcgatctggcccctgctacctttttcttttttttttttttttgagacagagttttgctcttattgctcaggctggagtgcagtggcactatctcagctctctgcaacctctgcctcccaggttcaagcagttctcctgcctcagtctcccgaggagctgggattacagattacaggaccccgaccccgaacaacacacctggctaatttttgtattttttttctgtttcttttgttttttttaattatactttaagttctagggcacatgtgcacaacgtgcaggtttgttacataggtatacatgtgccatgttggtgtgctgcacccattaactcgtcattgacattaggtatatctcctaatgctatccctccccgctcccctcaccccatgacagtatttttagagatgggtttgcaccatgttggccaggctggtcttggacttccgacctcaggtgatccaccctcctcgacctcccaaagtgctgagattacaggcgtgagccaccgctcctgacctatttttcttttttttatagagatagggtctaactatgttgcctaggctggtctcaaactcctgagctcaagcaatcctcccacctcagtctcccaaagtgctaggattacaggcatgggccactgcgcctggtcccttgctacttcttgggcctcaacctcaccatccttccctcattcaccccgtaccagctacaagggcaccttgcgagccttcaaacacacaagcacgttgttgcctctgagacttggcatgactttttctctatccccacagtctttttttttttttttagacagagtctccctttgtcacccaggctggagtgtaatggcatgatctcggctcactgcaacctccacctcctgggttcaagcgattctcctgcctcagcctcctgagtagctgggattacaggcacgcaccaccacacctggctaatttttgtactttttgtagaggcagggtttcaccatgttcgtcaggctagtgtcgaactcctgaccttgtgatctgcctgccttagcctcccaaagtgctgggattacaggcatgagccactgcgcctggcctgctcccacactctttatgcacctggctggccctctcacttcattgggtcgctgctccaatgtcacctccttttccaggttcctcctgtccctctctccccctcactctgaattatatcctgtcacagcagttatctctacgtgacatgatgttgtgattttgtctgggtgacatcggcaactccagggcaacttggtggcatttaccgctgggctgcaagcccaggacctggcaggcatccaggatggttttttagtttgtttgtctctttgtgttttatttatttatatatatatttttttatttattttgagaaggagtctcgctctgtcgcccaggctggagtgcagtaatgcgatctcagctcactgtgacctccacctcccaggttcaagtgattcttgagcctcagcctcccgaggagctgggactacaggtgagcaccaccacgcccagctaatttttggtatttttagtagagatggggtttcaccatgttagccaggctggcttcgaactctcgacctcaattgatgcatctgcctcggcctcccaaagtgctgggattacaggcgtgagccaccacgcccggcctctctttgtatttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccacgcccggccctctctttgtatttttaaagggacgaggtcttgctctgtcacccaggctagagtgcagtgatgccatcatagctcactgcagcctggaccttctgtgcttaagcgattcttctgccttccgcctcagcctcccaagtatctgggactactggcacataccactgcacctggctaattttttaattctaaaaatcaaatagagatggggtcgctatgttgaccaggctggtctcaaactcctggcctcaagcgaccctcccattttgtcctcccaaagtgctgggattacaggtgtgagaattttaaaaattttttgtagagatggggtctccatacagtgcccaggctggtctcaaactcctgggctcaagcgatcctcctttctgggcctcccaaggtgttgggattacaggcatgagccatcacgcctggccagaatgtatttacattttttttttttcagatggggccttactctgtcacccagactggagtgcagtggtgcaatcatggctcactgcagcctcgaactcctggctcaagcaatcctcccacctcagcctcccaagtagctgggacttcaggtgcacaccaccaagcctggctaattttttttttttttttttgagatggagttttggtcttgttgcccaggctgtagtgcaatggcatgatcttggctca

SEQ ID NO: 1559 - DNA, 2843 bp, Homo sapiens
agatatcattgaaatggattccaagcgtgtgcctcgagacaagctggcctgcatcaccaagtgcagcaagcacatcttcaatgccatcaagatcacctagaacgagctggcgtcagcagatgacttcctccccaccctcatctacattgttttgaagggcaacccccatgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttccaaaaattga

SEQ ID NO: 1560 - protein, 177 aa, Homo sapiens
LPPHPHLHCFEGQPPCLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 1561 - DNA, 84826 bp, Mus musculus
  misc_feature (1)...(84826): n = A,T,C or G
atgtattttaaggagagggcataattgcagtgttgaggctagtctctgaacaggctgtgaccctctccctcttatttatctcccccgttccttttcccctctctcatgtactcaaaacatttgttaagataatgctctgttttcgccagggactcgggattggatttctttgttcttggcttatgtattaaagagacttttctagtcaccgatgccgtgtgtgaatcgcatgctatgtagagaagcctgcactgccacaggagctgaggctggcagagagtcaaaagcatatctggggaatagggctaagccgctgtctgacacacaagcaagagccctgatttgggggagccttgtgtgctggggttggtatctatttggggaatgcaaaactggactcacttaatttatcaagcatctattaggcacttgctgtttgccagatgctcaaaagcacacacaggctttttgagagcttgtgccttcacatttgcagggactgagtcaggtgtgtgtagatccagatgtgcccatctggaagggacaggttcttgccttatcttctccccagaagcagagtattggagtccaccaaagatggcaccattgccatcccaggatgtgtgggtgaaggaaagactctgatgtgtgcattagtgagccaggtgctgaccacaggagacctcaaagaatccattcagcagctatcttggtgtcgcttagcttaggggagaaagtgtgagtacttgttcttcctgcaggagacactatggcctgtctagatgactctagtctctcccccctatccccacccctttcacccacaagcctagctttctcaagtacctgtcaatgcctacctaaagccatttcctgggagtctatagtggacaataccacagcagcatcttccacagagtcatgtcacaaccaatacaaaaatgaacttgaacagatcaaagacctaagcagtgtaatagccaagactacaaagaaagcatggggcggggagagctccatgacattggatgtgaccatggttccttggccatgattccaaaactgcaggcatcaaaagaatatagcaaaacctcaatctttaattcatcaaaggatactatcaagggagtgaaaacttgggcaggggaatgtggcccagacagcagagtgcttacaagtgtgcaggaaggcctggtatccatccctagtaccatgtaagccaggtgtggatactcacatctacatatttgccacatttggaaaataaaagttactgcgagttctaggccagcctgggctacacagtgagttctggacatctatagtaggcctctgtctcaaacagaaagagagggacagacagtgtgtgtgtgtgtgcatgaaaggaattagtactctggatggatggatggatggatggatggatggatgaatggatggagaattcctatagctcaaaagcaataatagcaacaaatataaaccacctacttttaaaatagacaaagagtcgaatcagacatttctccaaagaagatgtacctatgactaatgaacacgtaaaaagatgctcaccactgcctgtcactggggaagcatggctcaaaaccacagtgagcctccattcacactcaacaggacggctatgagtaaagccaggaaataaaaacaaatccagaaacaaatgttgccctaaataaataaataaataaataaataaataaaagtgacagaactggagcccttctgctccataggatgtacattctgaggcacagaaaccatgggatgcaccatgtgacttgacagctctgcatctgggtttgaaccccaaagaacaggaagtagaccattgaagacttgctcaccttgcatgttcaaagcaacattattctcagtggccaaatcactggaaaccaaggttctcactgacatatgagcatatcaacaaaatgtgacatgcagctgtcataggtaatcttgattgtcaactctcgatgatgtttagagtcaccatggaaacaaggctctgggcctgtccgtgggggagtttctataatggattaactgctatagtatatctgaccttaactgtgggcaacagaggtggggctgcagcctagctgtggatacaatgaaagcagtgggatacaatgaaacaatactcttgttgccattcctcctcaaacttgatagactgtacccagcatcaatgggcttttataaacccccttttattgtttattatcaagaaacacctaacatgatacatgtgatggaatattattcagctttaaaagggaagtacatcctgacacagggcagcatgctgcataaacttagatggcatccttagtgcagacagattcatacaggcaaaggtagaatggtaggtaccaagggctgagggaaggaggctaggaagtcagtatttaatggggacagggtttcaggttggcatggtagaagccacgctggatacagatgttggagatgccacttgacactcagtaggatggtggccacagtcacaaacatgaatgtggagctggggagaaagctcacttggtgaagccctggtctcacaaggcccacagctggcagccagagcttctcttttgcagtgtctccagtctcactgggtacctggtggcataatctcagatgccatgcctctgctctccgtggacctgagcctctctctcagagagctttgttcgtccctacctccccaaccttcaccaaaaccagaaagctataatttcccaccccaaaattgttctgccctatctgtacattgtatcagagttaaatacaatatttaccaccatggcaatttcctttttttaggatttatttaatatgagtacactgcagctgtcttcagacacaccagaagacgacatcagatcctattacagatggttgtgagtcaccatgtggttgctgggaattgaactcaggacctctggaggagcagtcttaaccactgagccatccctccagccccaccacagctatttataagtacaatattaatgttgatttggctcatccttccaagccagcttactaaatacatcagttttttttctttcctggggggtgtggggggggggggctcatgtatcccaggtcggcttggaactcactaagtagctgaggatgaccttgaactcctggtccaagagctgggatgacagacttgtgccagggtgcctggtttttgcagtgctggggatggaacccagagctagctgcacactagcaaggcactcttgaagttgagccacatccccagccctggtgtggatctaagaatactcagcatacttgccacttccactaacaacgtctgactgtctgtgtctttccattagactttgaagtcagcgttttgtcatggagcccctgtagcaggggctgggaatggggaagggtgagcaagcactaatgtgtcacagggccctgccaacagggcctgcaggctcccattgtccttgctgatagcctcagatgggtatcggctccgtgcccacatatgcattctttgcagaattatctacaggcactgcttaatggagctcagagtgacctgttatgcacctagttagttcttagtgactttagagctctgtgtggaagtgacctcagcccaggaaggtgccctgtcactcaatctacacagccccatgtggtcctcagcacacagtccctctgccactgaatagtagatcgctggcttgtgcatctacataagaaccaggattctccacttttgctcctgcatcctgactcactctcgtgtccagctgtgaagttccaaactcatgcctctgctttatggtttatcaatgtgtgctcactcagaactaaaaaaataaataaataccccaaccagagaggcgccttttatcaccttcatttttctctgcccagtaaaaagccgatgagaatacaccctctgctgtgttccattcatttcaaaatgtactaactcccaactatgtcgtgagcaagaaggaaagtagtagctgggttatttgtcaagctgtcctggtttttcaaatttatcatctcttgtcaattgacaagtccaggaatatgttgaaataaaaatggaagaacatgtaaagataaaattgtaagtgggatgccctgaatgtgtttcctgccatttttttttctttccctcctaccagtggacagtaaacaagaagaatgaagccaaccagccagagccagctcagctctagggaacagctggagctatgggaattgggtctgtgcctgaagccacccttcccatcccagcatgcctcagtgcattatcactaagcctttgagagtcgcagctggggatagctggtaaaggacaaaggaaacagcttttaaccagccggaaacatttccctagactttgcctcacccaaccctattggagcctagaaatagccaaaaaagaccccttattaccaagccaggtgggtgtggactgccaagggaaaatgggactgtggtgccacgtcagtggtgacatacacacttgctgcacaagcatggggacatgagttttgtcccagaatccatgtgaaaagttagcatggggaagagggtgtgtgatcccaatgctagagcatagaatcaagagaatggagctaggaatatatagccctaagtctctgtggtcagccagcctagtttaatggtgaactctggtccaatgagagaccctgtctcaaaaaccagcaggatggtgcctgaggaacaatcagtacctgaggttggcatgcggcctcttccatgaatgagcagtgtgtacctgcacacacagacaagcacacgtgcacacacccctgagcacacagtgagtcaggaggcatcaaggatgaggagagtttgtccgtttctgaacgctgtttctctgtcaggagagaagccagccattgactccagtttgcacaataaagcccatctttaaatcgccctgctttgcctcgagaaacttgcctcttggaggctggggaatgacctggggctgcctgctgcctgtacatttttcaccgctgcaccctccaaaactaatttctgtgtgttactagaaaaatatggacgtgtctaagtcttttaaaaaatatgagccctgggggcttcaggttacagttggagttatgcagactgggtttctcggcgtggcaagcgaccactcacctgttgctctgagatgctttgctgtcaggaaagcacttaatcccccaaccaggccacctcacgccgcagggcagatatgaaagttgcaagtggctccagagacctcggacgcacagaaaatctccaggttttcatcgatagcaatgtctccgagccactttaactcattctccagaagagcagccaatgctgagggaaggtcaggaacctaaggccggcctgttgttgcccttttcatcgtcagagggtgacttagactctgctccagcactgggccaagcaggactgggaatgtggacagagtacttgcctaggccatccttggctacatggtgaattcaggtctagcctggggcatatgaaaccttgtctccacaaaacaaaacagcaacaaaagagaagcttgggagataactctgcaggtcaagtgtttgactcataagggcgaggacttgggtttggagttccacttaaagctagaggcagttgtctgtaatttcagcaatcgtatggtgggatgggaatcagagacaggagaatgccaggaagctagtgggccagatagcttgccatatgcagcggcaagcaaaagatccacacactcttatacacatatatacaggtacacatatacactcacacacacacatacatacatacatacatatatacaggcaaaacatacatatacacacaggcacatacacacatatacacatacaaacataatacatacatacatacatgcatatatacacacacacaaacatacatatatacacacaggcacatagacatacaaacacatgcatatacacatatatacacannnnnnnnnnnnnnnnnnnnacacaagcatatacttacacaaacacacgcatatgcataaacacttatatacataaacacacatacatacaggcacacacacatacatatacttacacacagagacatatacttaaacacacaggtatacacacaggcacatgcatgcatgcttacttggctcccatacattccagagtaaagtccagactcttcagaatgtctgtctgtctgtccgtctgtcctgaaacagtctcttgatagctcagagctgtccaagctctccagcgctctcttaggctatcctgatgggcaagtgagtcccatcctgtctctgtcaccaacactggaattgcaggtatacaccaccacgtctggctttttatgtgcctcctaaggatggatgtcgggtcctcatgcttgtgtagagtgtactttaccaactgagccaattgccagccccaccgtgatctcttcagtgatagggttgagctgagtggtcccagccctggtgtgcatctccactgtgcagttgaaagggaaaaccatcagtaccatggcagcagcctgtcctgagtgtgatatgatagtgacaaccagctgtgctaccctgagatactgtttatgttttcatttaacaagcacctggtgacgcacatggtcccctgacaaccatgaagcagaggagcatgtgtgtctctgtattccaaaagggatacaagcacctggcagactgcaccacctcggtgaggtgaggtggtgtgaaggagatgctgcctggtggacagtggtccctcctactcttccaagatggccaatacccctgctttagtgtacaatattctttaatttttatttgtgtttgatatgggtggcatgtgtgccccactacacaagtgctggtcagaggaaccagttctccccttccacctttacatgggttccagggcttgaactcaggtcatcaggcttgtacaatgaacacctttatcagttgagatagcttaccagccctttgggcagattcataactgttatcccatttattgggtcaatgtgagtaaacactgtttttactggattttgaagattcaatgtaaattccagttccttcctgttgggtttggttttagttttactttctgtttggattctgtaagcattccaccagttttatttaaggaacagaaagatgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaggacaagcactttacagactcaacccaactcctcgcttcctctttccacactgctttgtcatttatatgcacctctagtataaaaccagttcctctgtaagcaaggaacaccagatacagcactctagatggtgagtctaccacaaatgagccagaattctgaatagccataactgcccacatgctaattgttcactgtgagggaccaaagagggtattttgctctttggtcatttaaatttgtttttattcccggtctcttacatccacaccctgtgttgaagtccctactctataaatgcttttgatttcccctaaaaaattagtaaagttgctgtgggtggtttattttgatgctaactgtactttagggggaaagcagcaaaaattgcatatagctttctccttcttgtctctataagtgtgagctcaaattatttatagtttgatactcagagatggtttccgggtatttatgtagcagaaaagcaaagggaccgggggtgactgtggagagaagagaacacttggatgactgaacgaattcaccctgggtgtcaccaggactgatctgtgaccctgtgcctatcagagttcccaacccatggcatatttgtccagctgacctgattagaaaatagtggacatattagttagttttctggccatgacaaaatgtctgacaaaggggacttacagaagcaagcgttggctctggctcatggtttgagggtgaaagtccagcatgcttggggaagcaggagcgtgcagcatgcacagacaggaagcagactgagtgtgagtgctatctcaccctctgctttgtattcagccctggatcccagccatacatggtgccatctatgttcagggtgggtctacccacttcgcttagactactttagtaaaccctctcacagacaggcctagtggtttgtttccatggtaattataaatctcatcaggttgacaattaagattaactgccacagtgggtatgccaggtgatgtcaataaacaaacgcttagatcaatggaaaaaaaataactggaagcattttagaaaatgccaagcccctgaaagcttgccgctgcccaagtgcccagtggtgacaggtggccggcagacaaggctggctgtgcctagactccatcacctgcagtctgatggaggccaggggcaatgtaaaaatatcccatgccgtgctcccttgaggggtcctggtaagtcatatgttctgagtttcctcttgctgtagttttacatggctctttctctgtccttcccccatcaccccatcttccattctgaggagtgttccatggatgttttgttttctctgtcacaggagatactggtacccacgaggccatggccccaatcatcgtggttgccccaggcaacagaagtgtggtagcagggtccagtgagaccaccttggagtgcatagccaatgccaggtacagggtgtgctctgggcgtggggacttaggtggggcatctgtcatctgaaaacccagaccctgaaatacttccaaatctgggacttggcgccttgatgccaagctgcagtggaaatttccaacccgatctcatatctctgatgggtcaaagcacagatgcactaagaatgaatatagcatgggattccctttgggctaagtgtgtaaactgcagatgaaacacaaatggatttcatgttcagacttggctcccatccttatgcagtctcactgagaatatacaaatactccagagggggaaaacccaaaatacaaagtacttataaaggctgggcatttcaaataaaggcaacagaacatggacaagaggccggggagatggcttggccagtaaaagacttgatgcacaagcatgaggacccacgttctgctccccagaatccacataaaagccagatgtgttatcgtatactcctgtaatcctagcgttggagagacagatacaggaggatccctcgggatctgcggttcagctagcctagcaatacaccaagctgcaggttagtgagagaccctctctcaaaaaaattaaggtagcaagaggtataaataataaccacattgacctacctctagcctctctgggtatatacacacatgtacactcatacactccgataaataagagagaacctggacttggatatcctcctgtggaaagacagtgatgtggagaacagcgtatgagctccacacttcagactgcagcaggctcgcttctcctggggcactacatgtcacgtgtcagggaatgcaggggacctcatgctagatacttcctcccactgtctctgcagtgcatggagcttttcaggttagctcctggtgatggagagacctcctcagcaacaatgactcaagctatagagagagagatgagccaaacccctgttcagccaaggaaagctagttcctcttgcccttctagttccaggcatgccctgcctacttcctggtcactctaggttgaggttttagatggtcacaccttccatgtatctgtaggtcccctagtagtatttatttgaagcattcttttcctgggcaaatggaatcattagcatgtatggtccattgccgctgcaattagctatccttgctcaatagcccttgagcagaatgtctcgttgaggcgagctgtgagggagtggagcaggatctggattgatttttaaatgtccattgttcaacccgccatggttcctggtagaattagctttgtcaagctcgtgctgaatgcctgaaattattattactgccgtccacgtgattcgccgctcgctgtcaccggtgcccttccgctctttcgcaggcccgtggaggagctgagtgtgcactggaagagaaacggagttcgactcacaagtggactacacagctacgggaggcgccttaccatcaccaatccgacatcagcagacaccgggatgtacgtgtgcgaggcgacactccgggggagcacatttgagccagccagggccagagccttcctttccatcataggtaatgctcagtccagcagtggtgctggctgcatcctcaggtagctctccattcccacagtgccaggcagacaagagagctgctgtgtatcccactgacctgatgtatttgtgcacgtgtgccgcctctgcacacagatgtggaagccagaggttgacatcaggtgactctcctctgctaccctccaacttgttgtttgaggtagggtctctctctagaacccgagagctttccattttggctagactgactggctccatagctggctctcaggatccagctgcctccctccaaccacagccctggggttatagatgatccactgctgaccctggctttttatgtgggagcagcgggtcctcaagctgttgcagtgagtgtgctgctaagtcatctcctcagtccccactgacctttatttttaatgacagtgattgatgattgattgattgattgattgtatgtgtatgtttggagaggggatgctcacaggccacaggatgcatgtggaggtcagaggacaacttgtgagagtgagttctctccttccatgtatcctggggatcaaactcaggtggtcagacttgtctgagcacactttccagcttagccatctccctgggccacaccgaccttatctttaatgatgtaaacggtggtatagtagagtttatcttctgagttaatcccatttgctttagaccaaagtaggaatgtctctagtaccttctcaacatagccttgcctctcgcctttctcgtcactaggacagagcacctgctagaaactcttcaagacaggacaggctttcgtttacaattgcaaggcatacagtcctccgtggtagggacagcccagtggatagtttggctttgtttgtggtagtgagaccctgcagcccctaaaattgtgtccaaaatccctgctagattatgacccttgaaggtctatcccctgtaaccaccaaaagttctgacgtgtcccaaaacagcaccaccgcctggggagcaaacattgagaacgggagcacgggggggggggggggacggacagttcaccctcagtccacaatcacctgctgccataaagcttgacagtggaggtgggggctgtcctcatcacagccactgcctgcctcttctggcctctcttttgccccaaacttcttcctaactctccctggctctcaccatctgtactcagaagtcagcctatgtgatgtcgactgggaaggttgaactgaagtgtaagaacagcaatcattttttaaaaaaacaggccaagtatgacccggaggtggggagggcagataaagttaaatgttccgagtcaccactaaatactgtaagatcacaggcttggaagcatggcttgggctgcggccgagggaattgtaagcttaccacaagatgatgatatgggcgcatcacacagcgaggcaagtacccgcgcttgattttcccagcttcctgcatggtcacgagcttgttcttaaaatggctgcagctgctgtcctgctgccctgcgagtcctcagcagaagccactgctgacagagagtgcctcaaaggcagcttcactccatctcttgtcagaaatgaaaggcattgaaatggacgggggaaaggcctctccagagaattactccttcaataacactttttttttttttttgcagtttgccattttgcaaaaagaaaaatgcagatagatttctatgaaattagccagcaccgagcagcattgcatagaaggtggttgccctgagcagtctcttgtctgttagccatcaggacaggggtttgcgctctccctgtgactttgctacatacagcccaccagcaacctccagagcaggtcatgagggtgatcagagaatcagagccacggggcagagtcgccaatcactgctgatcccacccgagggtctgagctctggctgccagtgctagatatagatgtgaaaatcatatcccattctcagcagagacttccattgggcttgatctatgactgtctgagcacagtccattatagattgaaccaaaattaaaatttgttatgtgtaaatctctggaagacaggactctattgtgttaaaaaacatttttaaggtaatttaaacaagggaggaaatttatctccctataaactgggaatgtttgcctctatcaccattccttcctcgagtatttaaatctatcatcctaactttgatctcaaattcacatcagaatcggtttttgcatttagcccttaccatccctcatgttctggcttggaaaggtacgggaacacactccagttcttttgtctgtagatgaatgtatgtgtgtgcacatgttcgtgtatgttcagacattgaatgccttcctcagtcactcttaaccttattttggggatttaaaaaatgtgtgtgtgtgtgtgtgtgtgtgtgtgtgtgtgtgtgtgtatacagcagcctgtgtagacccaaagagagtgttggttcccccagagctgaagtcgaaggcagataccagcctcctgatgtgggtgcttggagctgaacttgggtcctttgctagaacagtaaattctcttaactgctgagccacctcccttagtttttgagacagggtctctcactgaacctgtagcttgccattttgtctagtctgactgccgagcctcagggatcctcctgttcctacctgcagcatccctctgtggtagagtcacagggacacactgtcatgagtgctgagggcacacactcaggtctccatacttgtgcagtgagtacctcaccactgagccacctcttgtccccagcactttctgtctgaataagtttggcttcagtccccttttgtttagaagttgttgtgacagatgaaattttgtggttgggtcacactggagaaaacactgaagaaagcatttctgttgattcaaaggactcagggattgtcaccaagctcggccaccacatcagggagggattccgagcaatcgtgaccaatctaccaggctgtcaccagcagagctgggcagagagctattgatatgagcatgcagatgaatggaagcgaaaggaatagccttccaattatggatatttcacactgatgagacgagacagacggcagcggctgtttgccctgcctgtcagcttccagccgaattgctcaatttctgtagtctaaacaggactccaagctctgatcactagaaggtgcctggcatccacactgtagagccctgaggtctgtcccctgaccccctcactgctcagttgtcctgctgtccctctttcctcctgacctctgctgtgacatctccctgctggccagactctgggccattgctctgacactcagaggctagtgtgtaacatgaccgctgcctccctatggtgtacaactttctgctctgctaccaccttctctttcttggtggcatctttcaggcataggaaccaactttacccaccatggggggggggggagtgctggtgctgccccccccaggagaagctccacccctgcatctgctgatagactgtgagctttgctactactaaccatgcagttctatgctggagattgtccatagtctgcaatgggccttgcctcttcttgctctctaaacagttcagccatctcccaagcactgcctctgcctctgtagccagtgtctggggccagctttgttggaggcaaaccctggatggtggcctcaggctgtgagcagctgtctgtgactgacctatccatcctttagcttctgacaagcttgcctgtcagtgagactaggtgtcccttgagaatctcctggaagtcactgtgcaagagtctcagctctgctctgtagcagttggcacatggtagcaaggtatgtggcagggagatataagcataggttttagggttcatgtctgactgtatgggtacctggtcgctgagctttaatgagtgtctttgatattcttggccttggttctgatccctgacatggagaggtggtaggtaaggctactgtctgaaacaagggagagtcaacaaagcaagctcaccataaaagtgctgaaagaatggcttcacgtgtcattagcatgaccaccatagcacgtgttgctggctagtgagtgtctatgtcatattaatgagtgtatgtgtaacatcagtgagtgtatccatcacactctttttacactaagagccatgatgctcttgccatccttggaacattggtaatttggtcaggataaaacaaaggatggcaactgtgatggctggctttaactgtccatgtgacacactctagtgtcacctgggaggagtctcagtgaggaactggctggttcaggttgacctgtggacatgcctgtcagggattgtcttaattaagttaatggatataggaagacccatcctaaagccagcagcaccatccttgactccagaccctggaccgtggagaaagcaagctaagtaccaagtatgcatatggttgttgtctctggccttggctgcagctatgaccaactagctgctttaagtccaggagtatgaggcagcgggtcatactgcatcctcagtcagggagcagaaagagatgaactcttgtgctcagctcactttgtgctttaaattgactccagccaccggttcctctctgctgtggtggaccacaacctggaggtgtaggctaaaataaaccctgtctcccctaagttgcttttcatcagggtgttttatcacagcgacagaaataaaactaggccagtggctcttaccaactatagcatcttggaccactggtgtgtgtgggggaaaccattagacaccttttcctcccaactgacagattcagcatgtcccacagaagccatagctgctctgggcccacccctgccagtgtgcacagagttccttcacacccaccctagtcctaggagcagagagtggctatgttggtttttctcattgttgtaacaaaactaactgagcaaagtaacttagggaggagtggttatttcctctgctcacacttggaaggcccatcctggtggggaaagcccgacaacaggagtatgaggcagcgggtcatactgcatcctcagtcagggagcagaaagagatgaactcttgtgctcagctcactttgtgctttaaattgagcccagcacacagcccacagcactcagactggtgctgcccacactgggggagggcaatcttttctcctcagttatacctttctggaagcatcctcaaagacactcccagaggtgaggtgtctccatggtgttaataaatccaacaagcacacaaggaagactgagcaacacaacaaccaatactccatctctttcttgcaaagctattctgagtccctgaatgcagatcactcctattttaaaacaaagccactcatagtggctggtacagtgtcacagatgagcagccattctgcagcctagtaggtgtttatgtctctctctccctcctcccctccctctcccctcaattcctcttcctgtccctcctatccatccttcctttccccacccctctgtctttccccctcctctctctcttccttcctttcttctttcccttctccccaccattttccttttttctcttcccttcctccagtccttccatcttcacatctctgccctgcctcttgcctctcctgcttccttgtagagaaagttctccactgtctgggctcctgccatgagacctggccactcagctaaccccgctctcccactctctccattttaagatccatgtcctttatcccacttgcagagctcaccgtgtcccatacagagcacacaggtcccaggggatctggtgtagacatcctcagggaccattctgcccactccagtggacgaggcacccagtatggacagctactgcagccaaaggcacagcatagcagcagaactgggcctctagagggcagggaagctgatgtaggcaatgtgcttatcagaacaggcctggggatcagtctggattcaccaccaagcctgagggctgtacaacatggcctgggtatgcattaaccacccccactgaggcagtccttcaagcacctctgcttctagccccttctgtcaatgccccagttttgaactacttggaggggtcctagctctggttctggtactgcagctgggccatctggaggacattcagcccatgctggctttaagctctgatttcacccagggcaagagactcttctgatgtcttcatcttgattctaaagatggaaatgcccgtttctatcctgggttttattggctgcagctgtgatcgatatttaacagtccagtacaagcctgtgccaactgggctggctctcgctctctctctctctctctctctctcgctctctctctctctctctctctctctctgagtctctcatttgccaagacagacagattcacccagttgcccttggaagatcaagtggtaaaaaaggcatgtgacttagatgactgtcctcagggtgtctctgtggctcagctgcaagtccccacagctgaagacctagtaagcgccccactatcctcatcctgtagacaatgtggaaacaagcaagacccttgaaagctcccattgaattgggttgatgtgagggacccacaaagagagattgtggcttatgggtggcagggaagaagtgccatgaagcaggcagtgtcactgtggcagctctaacttctagcctgtcagctcacctacctgtcagccttccaggaacaagctgtaacaggtgtctccgaagggttacaaagtttcctggtgcctctaggccacccttccgcacatcagtgagagaggtgctgtaaagtagggaggtggcatatctgcctgactgtgtgctgtgcaccacacctgcctggccaaggcttgtggtgagtgacatcccctcatgcatgtccatccccaagaacatggtgtggactcactgtcttcatccccagtcatgtgccattgtgcactcctcagaagccaagaatataaatagcacctgggcttcttagtaaattttttattgccatgataagacaccacaagcaagacaacttattttttaaaaaagaaaagaaatttattggagggctcataatttcagaggatgagtcagtgaccatcagggcagggaatgcggtagcagggagccacagcactggaggagtacctcaagcttacttacatccccatccagaaacacaaggcagagagagccaattggaggtgggggggcttttgaaacctcaaagcctaccctcaggaacccaccacctctaacaaggccacacctcttaatccttcccaaacagttccatcaagtggagaccaagcattcaaatatatgagctcatgggggtggagcatttctattcaaaccaccacaccatggccctggaggtgctgggagtcctcaggatgggtatatgctcttaagtgtgcctcctattggacacatttcaagggaatcacacagaatgaggacagccacttccaagtgacatacagcaatactggttccataacattcttgacatgaaaaactaatgaaagtggggattggtcctggggctaggcacccgggctagggtagatggcatcttcacgatgaaggaccattctgtgttccaatacagtatagacacatgaccctacatggtgactgtggtgcatggaacgaagcacaggtatgtgcacacacaagcagaagcatgaaggagcagttaggatcaactctgttgaccatgtggctgacaccctgtaggtggctcagtataggatggcattaccagtagggtgattattgtagacccagacccaagaagacacaaaccagatctataccccaaggcaacactacaataaagtctagctcaatgagccagtgagtttccaggttacttgtagagctgtgtgaggggtcacttacagaagcatggttaacctcaaagtagccacctcactaatagcatgctattgtagatggcaactcctcagtgggccacacaaatggagtccccacttccattaactttccacctggtctggactctggcacctcccagaaccaggcaaccatgtttagtcaggagagatttatattcattgatccagaaggtgcaggatggtgtggctgaaatctcagataagggtctaaggaccttacatgcctcctccttctatgaaggaatgtcaacctgcatgtgagggtctctgggggaagtcacaagggctttgatgaaggtaacagttatagccattttcccaagaggacagagttccacagggtaaaccgaggaaaagatatatgggctcctcctgtattatgacttgcaagtgcctgagtctgcagttatctgaaaatagaatgtttgacagaggaaatggaaactgtaattaatcacaagcaaatgttgatatttaacttaatttttccccttttgccctcacatccctttaatcagaacatgatggtagctattgaatttagcatccactgatgaatacgggccatgacctgttcgtaaggtccttgacaggctgcaccgctgtggagttggaacataaatagtactgctagcgttactattgattagagagacacgtctgagcagggaatatctgtgtgcaaagaccagctaagaaagggaagacttcacatctttacagctcgtctcctggccagtctctacacacaaaactcatatcagagggttctgcttctgcctagtgaacccactgccacctccacagggcacatggggagttggggcagggctcctgctcaagaggcccaggtaattgcagagttggtacccactttctgtccattcagaaaccttcagtcttttcttcttggagctcatgttttcatctctgttcccctctttaggtcccaccctggtttgtggggttttttttcttcttcttaaaatgtagtcaatatagaagacacaccaagccttattatccacatttaacactattacaatgaaaagaagatgtctccagaaattaattatcacgcagaaagtgaacaccagagcctttgtcgtcgtgataatgaagtatcactgaagccttaatgctcctgagcccggccatgcctctgctggactctgctgaagaaacgggggaatgctgcaatttactctccaaggaaactcattgtctaatgctgccaccatttcctcttctgcaagcaagggggaggctagagaaaaatgcctgggagtttccctccctgccaaggatggatgagagtctctgcccgtcctcctccacctccccccactattattttgcattccatcgaagtattaaatttacattttggaggagaactgctaagacttaaaaaaaaaaaaaaagttaataggctgcgctgttccgtgatatagacctggccccttgttatagggctattcagcatgcctcacgggtggtgtttagtttagatatggaaacaaactagcctctaaagtactgtgctgtaaatatacctttatgaagctcttgggatgccctttctaaaatgtgaattaagatattccatgatttcaagcccataaactgagaagtagccatcgccctgagtggtaatttgctttctgaaaccttagaatataaatcacccttgcctgctgctccccaactttgagtctgtgagcgtgatggtgactaacgatgatgtagttagaacaatcctgagagcacagactgaggactggggaggcggctccgtcaataaaggacttgctacacgtacatgaggacctgtgctcaggcccccagcactcagagaagaagccagctacggcagtgcacatcggtactcttggtgctagggtagaggagagtgagacaggaggattccagtctagccaaattgctgagcttcagatcccatgatagatgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgcataatgatccttgacatccttcctgtgttagttacgttctcactgctgctaaagggagaaaggggttgtgttgcccatagttcccgcgggagcaggcggggaagccccagtggcaggagcagaaggctgggtgttctgcattgcatccattctttagaggcagagagtaaacaaaaagtggtgtctggctacaaagcctcaagacccatccccacaagctcacttcctccatcgactccctctcttagaagttccccaaccttcctccacagagcctccatctgggaaccatgagtgctcacatgctcatgaactatagaggacatttcacattaaggttatgacatgtctttacttaggggttgttttcttctccttgtttaaagagccaccatatttcactgctgagccagagagtcggattttaggggaagtggaagaaactatggacatcccatgtcgagccatgggtgagtatgggaagtcccagatggggacctgtggtcaatgactgtgactatcctatccttctagggggacagggagcatgaagttttgggaatattggacaatgggactcagtaaccagcctgtggtgttgctgaaggaagtcattgtgaagaccctgcttctttgtttgtctataacatagcccaggggtggcaagatgtaatgtctacttacccttaagaggggagagaagtttaggaagctcttaccccttgtctgcccgagagacagaggacacagaagaccctgtgactccccctcagggcctgggttccccagagtatgtgggcctaagaccatggctctcaggaaacccatcttcatccactagatgataaggactgagtaccatttttattaataattagttaatgaattaattaacttttaaagacaggctctcgtagaacccaggctggcttcagacttgcccttgattgaccttgactgagcacttatttgagctgcctgtatccacctctgagtgctgggattataggtgtgagccaccacacatggtttatgtcgtactgggaatggaacttggggcttatacctgttaggcaagcattctgctgactaaggtatattccaggccccgttattaattattttgaatgggaacatttcctacttttctgtccttttagctctggggcagctctcatgctccacaagtcattgtcccctcctccctatggctcaccatacctattgccctgtccatgaactttactatatggtttcacagggagttacataatgctgcccctcccaccatgtacacacacacacacacacacacacacacacacacacacaagcactaccagtttacaaggcaatccgtttaccaagacctgtatagatgaaaaggctcttttcctgtctatttaaatctgacatcataaaaatagttttccttctctcagtaaacgctggaagggaagctttgcttttgtgagaaacaatgacccccactttgtaatgagagtgctggagatccagagtagccaatgtgaagcagtttattttacgaccttgctaagtctggcatcagcctatagaaaaggcagaaagaaaaaaaaagtcctaaattccctatccaattggttcaggataaaaagcttttatctaatggatgtcctggggctggagactccctccttttctgagctgtgactgactgctagtgacttatctaccctagcatgaactgggagcacctggacaagcagatatagcaggggacccaggcctcctgcttgtctctgccctctgatgagccttaaaggcacctcatactgaaaaacagaccagactgagatatttctcacactaccagtttagtgactgtcccagtttcacaagagagatgttacctctttacacacagttgacatctttcaccagagaaagcacggttacgtgttacactcagagcctccaagatgaaacaagttacatattggaaatttgtcaccaagtgtctggcatgtagaagctgctcaccaaatactgggaccattcagcaatgcaacagaagtccaaaacccagttcatggccatgtgccccagcacaagctcctgccatgacactcagatacctccgaaaactaatgcctaggactaagagcagattcacctccctgtattcaaccaacacagctctgaaatgggagctgtggggctcccaacagctcttggtaaacgcagtcgcctctggccagaagtcccttcccatgatttatatcagacctactctttggcagagaacttgcagactctggtccccactcctggtcacctcatcatggtcactctctaagcacgctgtgtttctgttctcctcagccacagctctgttaatgcagccgtagaggaggacaggagaaggacgggatggatgctgagtagagacacctcatactgtggtggccttgtcctcttccccctagcgtagcagcctctaaagtgtagggtgagaagctatgtgaagtctgtattttagaaatgagtgcattctctactgcacagctctactacggtggggcttacggttcccacttgacgttaaattgcccctaatagaaacactcccaccctcccgcgtagtaactattatttttcagtaaatgacaatctcaacattctcccttgtgacaggagaaggctctcttcttcatataatccctgcagggtaaactgttaagcatagacttgtaaatgtgtattgaacaggtcttccgcacagtgctctgccatcatgtgatttacagctttcccttaactctggcgaggagacaaaccgcatgggaggtgggggtggaggggcaccccgtgagagctacatcatgtaatcgccattatgaggttttacatgaattgcatatgcttttaccttgaaatgggttttaaaaagttgtcctgatttaatgagaggtgacaggaaacgtaattaagggaaaggactgcccgagaacacatcatctggaaatgctcccgacattagctctattcattcaaatgggccttctacacccacgtacgctgacatcgagtcaggggtctgcgtaagccttagagaatcctggcaaaatgtgctctttaaaactttaatccattttataatgccaggcctggaggcacgcgcctgtaatcccagcacttaggaggcagaagcaagaaggccagcctggctgtgcagcaagatttgtctcagaaccaaccaaaaaaaattcatttttatctaaggaaactgaggaacaaaggcagctaaactctagaactaactctttgtatctttttgggttcccatgtccgctgcatttctggagtttgttatgtcatatgggtttgggctggttctctgtggagcctcttgcacacctagttctcactttctggatgggtgtggtcttcttggacttggggaagggcagagatattccccaggaagctgtcttcccctacctagctgtgcacaggtttgagtggagggcctatatgttccctaccagactgggttgccccaggcactgaactgctgtggtccaccagccctggactatgtgaactgactgctgccatggcaaagaaaggcttcaaaagtccacatgtgctacttaggctgcaggcagttccctccgtatacccccgaggttatgaaagcctgtcttaatgtccacattggaagccaggtcttgtttctcacggagataccaccacacaaggaaggggatactaggcagggacctgggttctgagcttgtctagtcctctagtcctctagtctagtatcctgccatgttttcagcttactcagctcttgggggacaggtacagggcctcttgcaccccctacttcctgtcatcataaggatctgagggacaaagcaagttattcagggtccacaagctgacacctcacatgtccctcacctcctttaatcagggtgtccctaaggcttgcaaatcactccccccacagtatagactttccttaaggccattgatagccatcagctcattggatgaggccgtgtttgaagtggcctcagctttgttattgactgtagtaataagtacccacagtatccacagagcccgtgctaagtgcctggtgagagttttatatacaaacctgcccaatcttcactgcctctgaagttatattagcaatttgtttcattgttgtgactaagtatctaataggctgagaggtcagtccatcaccacagggatgtggagcatcaggaactgatggtcacattgtatctacaagtcaggaagtagagagagaggggtgaatgctggtactctgctcatcaggaactgatggtcgcattgtagccacagtaaggaagtagagagaggtgaatactggtactcagctcacttcctcatttgtgttcagttaagaaccccagccccagccccagccccagccccagccccagccccagccccagccccagccccagccccagccccagccccagccccagcaacggtgccaattcttcccacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagagtggggaggatcccccggcccttgcttattccttcttcctcttcagacctctcagtgtgggtttcttcatgtaagatgaggggcgtgtccccagtagatgggatgtggtccgagaagattgcttcagaagacacttagtctttccccgcctacagaaacctcctggagtgcaatgttcctctctgttcctatccaggggttcctcttcccactctccagtggtacaaagatgctgttcccctcagcaaactccagaaccctaggtataaagttctccccagcggaggcctccacattcagaagttgagtccagaagactctggaatcttccagtgctttgccagtaacgaaggaggagaggtccagactcacacctacctggatgtgaccagtaagtagcagtatggccagccttcaggtcagacagagctgccccctctgctcagacacagggtggtagtaacatcctgtcagctcctgaggtgaaaggacagggccctgtgatggatgagcggtgagataaggagagtcatggccttcaagctttgctctttgaggctgagttgtccaaaagaaaaaaaaaaaaaaaaaaaaactactatttcagacaagaagaaaaatatttccattttctcccccctctggacagaatcagaaagactattgggtatatagtgtactactaatcttttccttttgatcttttttttttctccattaaaaaaatttcattctctactttagttttattgaacaattatagttcttttgtgggcttcttttattatcccattagcagaaataccatggcaccctgtctttgaaaaaataaaataaaagtacaggttctcactgtatctgcgggttttctttctaatctcccgcagctgtaacattgttcttctgaaatgaaatggaatttagcagttacagaattgcacctttcaagtttgcccttttagtggcaaagtgctgatattgcagatgtgagcaccactggggagtgtggctgtgcatgtgtgcatgcgtgcatgtgtgcatgtgtgtgtgcgtgcagaatgggactggtgattttctgtagtgtattaagagatggccaagttcctaaaatgcatgtgtgtatcttggtaaactgggaggtcactgtccttgacccccttgctaggagttacatttgtcctccacaccagagcactgggaaccaatcttgctctgagcagtagaaataatattgggttttgatgccagaaactgaatttgcatccattagaattatttaaaacctaccttccagctatggccagggtgttctgaggcagagatgaccagatagtttggggttgtgtgtgtgtgtatgtgtgtgtgtgtgtgtgtgtttgttttctttgaagggtctggtaatagatgttgtagactttaagaaacatggtctatgtcacagctacaaagcgcagaatgcatgcctgtgcagaagggtatgggagtgtatcgaggatagctggatcaccaccaccaccaccaacaacaacaacttctcctatcttgtagaaaagagtgcttagtctggcaaacactggtacacaggctgcattttatcccagcatgcccctgccgtattccttttatacaggactgagcagccctcacactgcctacctgtccccacgaataaaaagaagccacagcatggaacaggagttcttaaccatgtatttcagctctcagaatgctcccgggaagtgtagatgtgtcatcctgtagttggcacagtttgttacctaaaggacaaagacagtttctgtagataaacgtgctttctgggcccccggaacttcacacagggcttccacttccctatagacactaaacaataacaggtgattcctgggatatcaataacactgggttggagccactccagaatgactaatggttttgacatagtagccttccctctgattggtcctgcatgttctgtgtgactccaggcaggcttctcagagctgatgccacagctcactgttacctctcccctcctcccacagatattgctcctgccttcacccagcgtccagtggacaccacggttactgacgggatgacggctgtcctgaggtgtgaggtgtccggagctcccaaacccgccatcacatggaagagaggcaggtggctctgcagtggccatggctgctgtggaaaacactggaatgttggctgatttgttttcccttctcagtcactcagggaagattaagtaacatctattgaatacctctgacaggaactagatgccagggtgcagtgtgagtgagacaagtgagcccaggcttccagaaaacttggggactggggtccctagccctgtgtaccaggtgtacctgtgcaaagctctgtacctgtcatcctggaacaagagaggcagagacaggagatcctggaggcttgttggccagacagccgtgcccagtgcgtgagcttcagtttttagctgtaaaccttgtctcaaaaaaaaaagaaaaggaaaaaaaaaaaaaagaaaaagaaaaagaaaaaaagacagcctctacatatatgcacaccatttacatgtgaacctgtgcatatgcacatgtgcatctacacacacacaaatattcacatgtaacccatacactagtggttctcaacctgtgggtcaagagccctttgggtaattaaatgatccttttataggggtttacagccaacaggaaacacgggtctctacattaggatttacaacagtaacaaaattacagttaggaagtagcaacaaaagtgattttatagttgagggtcttcccaacacaatgaactatattaaagcgtcacagcattaggaaagctaagaaccactgctgtacacatacagtttttttttttaaatcagcaaggtcagtgggagttaaaaggtagtaataactgtgtaaatataactgtcctatacataagccctccatgagggcctctgtctgctggggtcctgaagatattaagccctggatgtgaggtaaacagaagcaaacacccaaaggcaaggattccatacacagatcctaatctgtttaacagactctcatagtgccaggcagctagcatgctcctggtattcacaatcccctcagtgatggtgggaaacccgcttcagccattgtgcacccaggatgctccttttacaaggagtattctcctgcctgctgccatcctccctcaccttccctgccagaggctgcgcctctaatgctcctctcttctgctcttcagggaaccacattctggccagtggctctgtccggattcctaggttcatgctgctggaatctggggggctgagaatagcccccgtcttcatccaggatgctggcaactacacctgctatgcagccaacacggaggcttctgtgaacgcctccgccatgctcaccgtgtggagtaaggaccattctctgagaacctactgtgaactccgctcttgtctctgcatgatctgtatcccagggatatcaatacccccttagatttttctcacttaatccaaagaaagtgattatttttacaactaatttatagaaatctgttgagtaattaaattttctgtttctgaaagaataattaggagacgcatccagagattcactggggctatttcaagagctgtaacagatcgactttttaaaatcagtagacttattatacccggttggctggaatagctaaagtaatgttttgattaattttataagaaaattgagttaatcattgatatcctaaagaaagtattagaagtctaaggagattgctccatcaataagatactttgtctgcaattatgagtttggtccccagcacccacataaaatcaggaacacacttgtaaccccagtgccatagcaacacagacaggaggatgctgtcttactgggcagcctgtctcattgtacacatctctgggtacatctctaggtacaggaagagactctgtcttgtgaaataaaatggcctccacacgcaaacatacatgtgtacatgcacacaaacacacaggaacatgtgtgcacacacaagagaaagtatttgttctataccatctgatttgtagctacattagacagggatgtttcttgtatagtagaaacaaacagtgggaatgtcctttgttcctccagcttttaccagcctcagtggtaggtcactggttcttgaagtacagagagaattgctttttgtaacatgacgatctgaacaccaaatgttccctacctctagtgtgtaagtgctctttcctcttgttactcctacccactttactaacagctcatttttccaacagaagaagccagcacacactgacaatctctgtaagggtctctggtgaaagagaaagttcaaattcactcaaataatatgtgaagatgtagtcggttctaaaacacacacatgtacacatacacgtacacacatgaccacacatacacacacatgaccacacatacacacacagaagtacatgtacacacatgtatgtgcatacacatttacacacatgtatgcacacacatgaccacacacacacatgtgcacaacactttcattcatatatggcatagtctctcataccatcactgtacattttgataaatgacccttttaatggagtttttaaatttttttcaattatatgtattcctgggggcagggagggcaaagccaatatgtacatgaatatgggtgtccacagaagctggaagagggttttcagttctctgaagctggaattacagacagctcaaatgggtgctgggagctgaactcagttctctgcaagagcaatatgcatgcttaactactgagccatccctccagccccaaataaccctttaaaaatattttattgggtattcttgaaacatcagaggttttatttttaaacttatttaaattcctgcaatattgacaaaatactaaaacggagtatgttttgttacgtttggaggttggagtcaagcagaggaacgtgcatggggaacgtcgcttcgcagccagaagcttgtggagaaggagataatgaggcttgactctccacagatcatattccagaaacttctgtggatctgtcgaggatcaaagttagggccgtgctatgtgacactaagtcagctcagtgcccagtagacttacccaggtttctcagtctagctgtctgtaatcatcacatggcctctcgtaggcaaagactcaggaacttttcctgagacacagctggcaggtcactatgctgggcttcaagggaagccctggaactcacaagttttagttctgtgtgtggtcctagagtggggtcccctggcttctgtgtggctgactgtgggttctggggtcctcagctgtgggacagccaatagaccctgtctctcaccagcagtgtggtcctgggcaaaccccacaggtttgctcttgtgattaaatcaatcagcacaaataaaagcgacttccaaagtcccggggtgctatgtgaacactagaaaatgttaacacaataattatcttagcaaagaatatagattttgtttatacactaatttttttttttttttttttttacttatgtgttcatttacaacaccgggggttaaacctagggcttccaccattgagccacatccccagccctctttttaccttttgttttgaaatagggtctcataatgtttcctaggctgctcttaaacttagcctgtaatttgcaggacatgaactcactccatagcccaagctggccttgaatttgtgatcctcctgcctcaacctccatttctactctgctttgaggatccagacttcaggctaaagagacagctcagacagcgcagtgcttagcctgcaaagtttgagggtctgaggtcgatccttcgaacccacatagaagaactgggagcaatggcccttgcctattatcctatgatcatggagtcggaggcaggcagatactaggagctcactggccagcaagtctaccctacttagtgacttccaggccagtgagagaccctatcggcaacacaaggatcctcacacatccacaaaagacacagagataaagcactccaaagagtccagactctaaatgtgtacacacagtctttgtctctctgttctggggagctcagagatcagggatgacttaggagtgggtatatcaactaactctgctgccacacagaaaggcttgtttttccattctctgaacatcactgagcgcttccatttacacccatttttgccaagatgagagagaatttggaggctttgatgtcagatgaccaattcattatccccgagggcacaggctcacacgctgctgacttcatccaactgtgacttgtgttgtttcagatcgaacgtccatcgttcaccctccagaagaccgcgtggtgattaaggggacgacggccaccctgtgctgcggagctacccacgaccctcggacctctctccggttgctcacactgctcttgttcattaggactggttaagattccttgggttaatagagggaaagtggagatgagaagtgagagtttggtggtggtggtcggggggggggggtgtctttgattttagcagcagacctctgatgatgccatctctcagtggcgagctccatcattaatcacaggaatccgtcttccattccagacttatgtattatttacagtgggctatgctccactccgtggcttcaatacagctttttgtgattttcctgccaaggttaatacactgtctgtaaaacgcacttgtcagggtctgatacttaatgagacaaaaatgccagagggatggaataggatttcagtggtgttgacatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacactgaggactgggtttggacacttgaccctcctctgccctttcagtgcaagtatttgcaaaccatccatttctccctccccacctgaccctccagagtctccaggactggaatgcagctgtcttccagcaaatgcaaaagccaaagggacagataggaagcataatgtttgactgcgggaaccctggggggcctgcccagagagagggaaccctggggcctgcccagagagagggaaccctgggggacctgcccagagatctccttcacacttaaagaaaactccagtcattgtaaaggcaggaggacatggcttttaaaactgctccaagagctcagaggttccactgggatggtccctttgcagcacgtcccgaggtcagtggaagataccccctttctgtgaaggacttgaactgtccccactatggatggacccaggttattagggcaattatcttttctcttcaaatggactatttcctgttgtctcttgtgttgcaaggtgacctcccgtgaccaattcatgaaaatctatgctgtgaatacacagggcagcaggggctggcacattttgaaaatgtaatcagattcttctaataaataaaaccagaactttcatcaattcagccatcggtagggcctcacccagggacatttagtactggacaggctcttaattgagtctataactggaaaagaaaaatgtgccaaaatggccctaaagattaactgaggaagaaaggtagagtcagagacagcctgctagtgtggtgggcctttagcagttagagatgcattgagctttgcctaggaagagggagtccctctctgcgaggtcctaagcaggactgaaacaggagagctaggcagtaagtgacaggtctgacccacagaggccctgtctcccagacacatgctcagatagatatccacagttgtcttcattgtcctatttgaggattttgtttgttctatgtgtgtgtgtgtgttgggggtagtacatttatggtgcacttatatacatgaatgtgtgtgtgtgtgtgtgtgtgtgtgtgtgtgtgtgtgtgtgctcgcgtgcgcacgagtgtgttcccatgtatataggcatatacatgtgaaagtacatgtatacctacttgcacatgcatggggagatcagagattatatgaatgcctttgatggatctccacttcatttccagaggcaaggtctcttgctaaatccaaattcagctagtctaccagccagcttgtcctgaggatcccttctttccctctgagtgcctggattacaggcgtgcaggcgggctaccatacccactccgcttttatgtaggtgctagagagctgaattccagtcttaatgcttgtgcaggaaagcactttataccttgagccattatcccagtcctctaccttgttttgagacagggtcctccacttagccaggatctcattggttaggctaacctggggaccagcaagcccctgggatctacctggtgttgcctccctagtgttgaggctactagtgtgtggtatcaccccagaccttccatgtggattgtgggaattaaactcaggtctttttgaatgacaggcagacaccaactaaacaacccccccaccaccacgcaccaccactgcccggctttagtcaccaaagcacccaccagcttttataggttatctgagatattgccataaaactctcctttttaaatgatttatttttatttatctcttactgtgtgtgtatctgtgtgaatgtatgctgcatgtgtgctgttgtccatggaggtcagaagaaggtgtcagatggtcatagctggaattctaggtcatgagtcacctgacttgggtgctgggaaccaaacttgggttgtctggaagggcagggcacacttttaaccactgagccatctctctagccacaaatgatttctttttttaaaaaaagtttaacatggtcatgtttactctgctgtctaatacaccaactgcttgcaccttgctatcagggaaggggtgcggatctgctcctatgtattttgtgatcaaccctctgcttggcccacagctacgtttggaaaaaggacaacgtggtcatcacagcgtctagcagctccagaattgtggtggaaaaggatgggtcgcttgtcattagccagacgtggtcaggggacattggtgactacacctgtgaaatcatatccgagggagggagtgactcccggacggcacggctggaagtgatgtgagtaccaagcctctcctgtctccagacttccacgcggccatacttgactcatgtctgcccacatgctgccccatgccatcaacctgaggccagcacagccctccattcagctgtgtatgatggcaaggtcttttctttttcacccatgtgtgtttgtgtgtgtgtgtgtgtgtgtgtgtgtgtgtgtgtgtgtgtgttggagaggtgcatgtacatatgctgggaatagggctgggaggtatcgaggctagaggtcaacttcagaagtcacttctcaggagttgtacattttgtttgtttgaggcagggtctcttatttttacctggactcttctgatatgctattctggctggccagggaaccccagaagtctacatgccactgcttccccaatactgcaattacaagcaggtgccacaacatatgacattgttgttttggttctgtgatgaaactcatgtcttcatggtggcaagacaagcactttaccaactgagctgtggcctcaatctatccatccttccttccttccttcctttcttccttccttccttccttccttccttcctttatatccccactctgccttcacctctcccccatgacctcatgtttcattcttacatagatggtgtgctcacaggtcatcgtccccatgaatccttcatatccctgcacagacacctatcatgaacgctgtctacctcattgccattatgtggggatgagttccatgtgattgcccatcagtttctgagtggtgacaatgtcaggtcaccctatccaaaagtccagaaccaagcagccaactaggcctccaagtgaggtcatccgcagatgacacctcctactaagtctttcacactccttaagagcactgtcccgttgcttccagtctagaactctctgtgggttctgggctcaggtgtaagctttggtgcccctatatttcctcagctccctctctgatcacagaggaggaagctacaaggcctgctggcattgtccaccttttcaacgtgtatttatttgctttgtttaaaaaaaaaaaaaaagtgccctcccagacaatccctgaagtacaggaagagaaaatacaatttgcaaagagagaatggaagcctcacggctgctaaaccaggatctggtgtctgatgcccatctgcccgcccatcccatccactgcagggcgtgctgggccatcagaaggcaaccatgagaggcttttctttcagctctgcccaccttgatgcaggatgaattctgaacagaaagcattccctaaaaatagcatcagaaccctttgcatccaacgaagtctcatttgtctttgaatccccagcgtctgcgaggggattaggaatgaagagagtgcctgcagagagccaagccaggccttctgtgtgtgtcccaagcactcaagaaggagcaaattcgagctctccaaattagaggaatttaaaaggtcgatgaccatgctggagagatggctcagcagtgaaaagcacgggcagctcttgcacaggactggagttcagatcttagcccccacattggggatctcaggcctgcctgtaactccagctccaggagatctgacaccctcttctgacctcctccagcagccacacacatgaggcacacacacatataaaagatataaacaatggaagtttaatgatggggctggggtgtggctccatgggcagaaacatgccgtgcgtgcatacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtatacattcggaagctgaaacagtcctgttctacctcctgtttgcccctctccagtatgattctgattcctcttggacaatgatatctctggggagcaaaggcacccattagccatgatgagcctggagcccagtgtagtccttaagagcagccttggggcctatttggctttgggcatccatggtcttgttgatccccccacccccaccccccaccgtcatcattggagccctgagatcctttagctctcttggtcctttcctgtcctccatggtgtagcatgtgtcccctgctggtgttgcccacaggctcctgcctatatgtcctttagcattcagccccaggacggtttcctgccactcagtcactgtgcctccccgtttgtcctggcctgtcctcctcatggcatctcaaacacactggaagagaagtctgccatccaagccctttcctcccagaagtccctcagcgtaaatgtttgcatgctgggtgcctggcataccaacaggtgcccagcaagtgcacactgagtgcttgttggctgaaggcatgtaggaatacatccgtgagtgtatgttttaggccattgatttgcctctactcctctcttacctgcagtgtatggcatagggataaacgcacaggctgtctattaaaagcccagctccactgcccccacatcagatttaaaaaaaaaaatcactttgatgatgttggagaacacagactgtgaattcgcataattctacatgctattcacttttcttttcttttcttttcttttcttttcttttttaactaccttggagaactcttagatcatctagtctgggcatcaaataaataagtgttagcagttcataaaggctccgtcagcaccaacacaaccgcacacttccaatactgcacgttctttttattccgcaccttcttatgttctgcagatttacatatcttccccactatttacttatttgatttcctctaagtaaaatacatttttcagcaaatgttgctgtatgtataaaataataggctttctgcgatggtgaaacacctcattgctaaagatagaaatatttgcagatctgtgattcaaaccaatttgggtgccgcaggctgcggagctgagtcagaaggctgcaggcccctgggagttgctggtggaataaacacagtactcttccaagtcggaatgaatggggagagtggtacatcgttacatctggagctcttggggctagggagatggttcaatcagggaaatgctggccaggcaggtatgaagacctgcatatagatgtccaatgcctttacggaatgctgggcgtgatagcatgtgtctataatccccggggcggggagacagagacaggccatccaatccctagagcttactgggcagccagtctagctgaactgttaagccaagctgcaggtgcagtctctgttcagactctgtctcagaaaatgagatgggcagagacagtgagatgactcagtgggtagaggagcctgccatgcaagtgttgtgatctgagttcaacccctgtatctaacagaaagatgggagagaacaattcactttatacaagctgttctgtggtctccacatgcacatgtatgcttgcacgcagcacaaaccacacacacacacagacacacaaacacacacacacacacacacacacacacacacacagacaagccactcacacacatacaaagctctggggacaccgctgcaccagtgatggccagagtgacgataatagcaacaagtcagaaatggagggcatcaggtgcctctcagagaaccttctagtccagcgctgtcacattcccatgattgctcagacagcaaataaacaaatacggaagaaaaagatgaataatgccaaagggacagagaggtacttaggcctaaacagtgtccttcaaaagcccgagagagcccccctttctctccacttcagttaaaagccactctgttaaattagggctgggagttggttcagttggtgaagtcctcacctggcaaacacaaggacaacgtgatccttagaacccacatgaaagagaaaggcagggtccctggagctcactgcccagccagtgtagacagacatctccgagcctgagaaagaccccagagtacaaggaaaaacatcaacagctcctgaagtacaatgtgtaatgttgacctctgcccttcatacacaggtacacatacacacaaatgcacatgtacacacacatatgtacacacacacacaggcgcgcgcgcacacacacacacacactttgatcatttaaaatgagcttgtgggaattccagtgggatgtccccatgctcattagctccgtggttgatcatttcagctttatctcgggcagaagctggctgagtgacgcttcatgcccacattcctagtaacaaggctgttgattacagcagaaccgtcaggagccaggatgaccacaggtccatcccaccttaccgtgggacttggagcaggtcgccttgttcctctccctcagttggctcagctggccatggcggcactgcctcacaggactgtcatggagtggaatcagccagtgttttgtcagttctgtgttgagcccagtagaagagggactctcgagaaaataaagctcctatggatttctccccaccacagaaggagcccagttgcctcttgtgttgtgggtctctttgtcttgaagttgatgcttccatccctgagactctgtgttacttttgaccatggcctcatgaccatctgacatgactcctgccacggagccctcagggcctacctcagccaagtatacagtaagtgcccactaaatgcctcgccccacttgctaagttaaaacaggaggatatttgcattatccaagacaagcagtgtatgtaagctctgatttaatcccctctctaaaattccagatggttctgtgatgtgtcctatacattagcaacagagatcttcatcagtaaacatggtcaccttgaaggctagagttgtagctcagttgatagagggcttgactagaacacatgaggccctagatcaatccctgggcatggtggtctacctgtagttttagctccctgaaaatggagctaaatgcctggaatttatggaatgcctggaacaaaccagacagctagactagccaagtcagtatgctccaagttcaaaggagagatcctgcctcaatgaatagtgtgacatgtggtcaaggaagacacctgaagtcaacctcagccttcacaatcacatgcacacatatgcacacacgtgtgagcatgcacaagttcacataacaccaatcacacaggcacaagacaaattccaaggccatccttggccagtctgggatacctgagaccctgtctcaaaaacaacaaaacaaacaaacaaaaacattgtcactttgggttttgatcctgtctttccttctagtttactggtgctgcagtggcaggatcacagtcctggggtaaccccatctccccgaaagcatcttgccctattgaacgtgccagaaaaactaggttcctaaggcgttatagagtgattaattgttcaatcatttaaagatccaattagcatcacctggcccctcctgcagtaagagtctaattcttaggagcctgaagaacagagaaaaatctaatttactgagctgactggaaggctcagaccctgaggcatcaggaaacgattctttcaataaactacttctgacaaagacataataaggagtgaacaatctgacgccatcccccaccgttatcaggccccgagtcttcctcctcagagcaaagtggaagaagatgggtttgaccaagtcacgatttgtgcatcaaaggggcaaagctttcctgatggagaaagactgacctggtcctctttctcaggagcaattctcccttggccacaattttaccaattgttcaaaactgttccaccctcatgaacaccacccttctcgtctccccccgccctgtgtgagctactatgccattgttaatgcccaataatactatggtctaagtgacttggtgccaatttctccatcccatttccattgtaaggtgacttggaactggcctccatttccatcgctccttttctctttggcttgtccccattgggtattgtcaggtccaaaagaaactcaggacaaatgactaaactatggtgcctattagcataccaaagcacatgctggcctccagggtcactcagtcccaaggctccactcagctctacccaccctaccccctacccctaaactccaactcatgggcttcctttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctggctgcaggttttataaaggagaaaaaaatgcatgaccagatcaataatgagctggagagttgggaaacatctgaatctagccatgtatgggacagctgtagtatgcagctatgcacatgatctgcatgaaggcagacatgcatgcgtataacatatggggcaagatccagtcaattctacatcctcttatgtatggctttcacatcttacctcatgacaccagccaaggacactcagcagagccacatccaatagacatttcctgattagctgaatgcctccagcttccttctatcccacagaagtcagaaatggagttgacactccagcctccaaactcatggcgcctttattgtcctggacctacctactgcccagctgtgtaaccccataaccagtcattgagctgtggtatcccaggaatgacagagacaaccccatccctcaggatatcccaaggatttagaaactccgtccattccagaccagaaaaacactatttttatcaacagttttacctgggtatttttagacaagtactatactcttggtttgtgtaaaaatgaatatcaccaacttgacagaatctagaaacaccaaggagacacacctctgggcattttagggttgttgtgggggattttaagtcaactccggcagttttgtcacagcaacgagtacagtaacaaatggccggtttctacttagggccattcaacaacgttggtcttgtttcagaccaaacctaatctatcttggaggaaacaaaaagaaatggggcttgagagtggatattatcatcctgccctccctcttgaatagtgtttattggggtctaatggaggcttggctatcagataagttaaatagaaagaggagcttcttatctgatttcaaacttgagtcacagttaaggagaccacaagacaatattccacactcaagacttgtcttgtgtgtgtgtgtgtgtgtgtgtgtgtgtgtgtgtgtgtgtgtgttatctcacgctaacacacagcacagttctatctctatgaaacatgttcatttgctaacgggtagatgggtgagagtggtatgctccttacccagctgagcacagacaactgcatcagttgtgaaatagaacaggtgcgtttctctctgggccacgctgaggacggaaaggacttgaacaggagctatcaccccaacccacacggacatttttaaatgaaaagtatcaggtttggggctgggaagaggctctgtgggttacgcacttgctataccagcaggaggacctgagtctggatctccagcacccatatagaaagctgagtgtgtccagattgagggggcatggctgagaggcatagaaggaggggaaactaatcaagatagatgagagcaatatcttttgttttgtttggggtttggggggtttttttttggtttggtttggtttggtttggtttggggtgtggttgttgttgtgtccttttgttttgttttgttttgttttgattttggctttggtgttttgagaccaggtttctctgtctagcctttgctgtcctggaaaactgtctgtagaccaggttcgtcttgaactcagagatctgcctgcctctgccctctgagtgctagaattaaacacgtgcatctccactgaccagcaaagagtctattctcaatgaaaagggattttttttttaaattaagattagaaaaatcacttgggatggagagatgcctcagccattaaaggctgggtaaaatgtaagaaaaatccgtgtacacctgtccactggagaaatggatgccagaggatccctgggcttgctgagcagcccttccagccaaatctgtgagccctgggttcaggagagagcctgactcagaaaagtatgtgggaatgattgagcatgacaccgaacttccacctgtgactccacatgcaaatgcacacagatgcacatacatgcacatgcacacacacacatatacatgagcacacacatagtcaagtatacagggagccatggtactgtgtgctgagattccatcattgttagatcagatgttagagagtcatagcaagttcaaggccagtgtagccaacataataagtttccagggatgatggatagatgacagatagatggatagatagatgacagatggatggatgggtgggtaggtggatggatgaatggatggatgacagatggatgacagatggaagttccaggctagccagggctagtaagacccagccaatcaatgaagggatggatggatggatagatagatagagctcccaagcttccaaaatatcaagttgaatgttggcatttgatctgaatcccatgtggttctctagtaactgatatccaagagagacccagaacaaattagtggggacacaggtcaccacttggaagccttcccatctgtggtaccaggtctgttatgggagtggcctccatgaagaaggagcatggggcaggcccagatcccaagtccccagagatgtaaggctgaaccaaacttgcacagcttcattgtcaaggtagagacttcatactgtctccagtaaatcccagcaaaaacttggttttggtttgttttgggttttttgtttgtttggtttttggttttttgttttgttttgatttgaaattagtgacttcttttttaaacttatgtaccagagttacacttgcactttatggccttgtccgtgtgttatttactatttctataggtgtttcattgatttttctcactacatctactcataagagctttccccagacctctattactctccctaagacagagctacaatataacctcatgctgtggataatttaggcagtccacttgtctaagaagcagggagagtggaaacccctcacactgggcagatcctcgccgccaggcaccaggctttcctctttatagggcttctgggtttacatgaacagcctctagctgcattgacaaataattgactacattttgtctcattaatgatataatgccaggccaggggtgtggctcggctggtaaaaggcttctgcagaaacaggagaacatgagttcagtctcaagcacctatgtaaaaaaaactgggtgcaatggtgagcacccataacctcagcgctggggagacgggagcagaggatccttacagccccctggcagccagcctagctgaatgaattggtaagaccacctcaaaaattaagtgtaggcgttcgttttagtttccttccaattgctgtgataaataccttgacacaaagcaacttggggaagaaggatttgtcttagctcacatttccaggtcatggttcattatcgtggagaagctgatgtggcagaaactcgacgcaggtagttgcatcatatccacagggataaatgaattctgtgcttaatgctcagatggatctctccactcttacacagtccaagtttaaagcccagggagtgatgccacccacagtgggctgaatctgctcacttcaatcaagacaatcaagacaagcccctattgatatgcccacaggctagcccggcctagacaatccctccttgagattttcttcccaggtgattctaagttatatcaagttaacagttaaaactaattatcattaatacctgactcgatctctagcctacatatgcacacacacacacacacgcacgcacgcacgcacacacacacacatacacacacatacacacacgcgcacacacgcacacacacacgcacgcacgcacacatacacacacacacacacacacatacacacacacacacacacacacgcgcgcacacacatacacacacacgcacgcacgcacgcacgcacgcacgcacgcacgcacacacacacacttgcatacacaaagcaacaagacaaaatagaatgtaataaaagtacacacagggcccctgtgaagttacctgtgttgtgattgaggaaccgcaaaattcacatcaaattatgttcgaattacaccacagggggtgggtctggtcttggtttgttcttaggggaccacagagagaggactagttcattctcattccataaccgcacacactagctcttgccatcacgggcatcagatgacccataagactgacttccctgttttcttgttcttttcacttccttgcctctagtgagctgcctcacccacctcaaaacctgctggccagcttgagtccagcacgcagccactcggtgacactatcttgggttcggccctttgatggaaacagcccggtcctttactacattgtgcaagtatctgaaaacagtaagtagcaaaacaactgtcagccccaaacataaaccagatgtgtgtgtctttgtgtgcatgcatgtgggcgagtggggaggcatgggatgggcctgggaaaacctaagaggccagaggaggatgttagaggtcctgctctgtcactcctagccttaccccaccctgagacaggggctctcactgaacctggagctcagctagtgaccagcatgccccggtgatcctcctgtctctgcttgccatggcactggggttacacaagtgccagagatctgaacacaggtcttgtgcttacacagcaagtgttctcgctaacagggccatctatctcctcagccccagacaccagatttcatgtgttcttaatggcatgtcctttccccaccccacagctgatggggacacttggccatgcttcacgggtaacaaagcaaaagcaagatggtgtgtaggagagggaagagccatgtggcctggggggtgggggtccttaatgggctctcgagagggcctggacttgagaccaggcctaaccagagtagctaagtccatgagactgcctcagaggttctagcagacagtgttatccctgcggcctgttggaaagggggtcacggtgcctcctggagctgacctcagagtgggcagtagcaggcctttacatcttcggagggttttgtaacttcctgcctgtcgtttgtggaagcccatgaacagagacaggaactaaacctttagatctgcactttgttcagagagcaagccctctgagaggacagtgggtcagcatcctaaatgtttgcctacatctcgtcatcagtgatgggtcctatgagggagtggggggcgcaggcagtcaatcacctcagagctgttcgtcccctcaggaggtcagcaggtttctgaaacttgtagtgtctgtgcagctgctgcatctctggtcctcttccttccatctgcatgtcaggcatgcacacagtgcctgaatccagttagtgcctgctcttgtcaacctgtactcctccagggcacctgggatggaaaggggttaactcagaacagtgtgtgtgtgtgtatgtatgtatgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagattcctgatttcaccacagaaaagattcagggtgagccagcaagaaactgagccctgcgtttattaaaagacaactttaatatgatttttaagcaggaggattaggaaaaagtgaggtagttgggaagaaagatgggcctgggcttctgcccctccgaccctttgtaatattcatgcaaaggccatcttggtattattgatgctgttaccctcaaagtgttaccaggggacctaaatgaagtcataaggattaggggtagagggctgaggggcacctgacagtgctgactctgacagagtgaaacactagctggaaggtatgcaggacaatggggcatcttccttgtaaaagttagcggtcttgtttaagattcccagagaggaatgaggccccaggtaaggcccacgtattcaggccccaagcctgcttcatgtctaggttaacattcttcttggagatgcctctgtagaaaagagccttgtctctgtgttggccaccttcacagcagacgctgttgcctgagttggaattctcgccactccgctggccatagcttaagccagactccagtgtgagtagatcctttcctccctgtgccctcctcatttctgtcctgcctcagaacccagcccagaggcgcccccatctctccctagttgttgcaacagacatagatgctttcactagcatctcaccatcatttcagccctgacctcggtcctcttttcccacccagcatttccttcaccgggagcccagttcctatgtcactcaagccacagactggaaaccgttccccataccctccaccccacccacccgagcagcagcagttctggccatcaatcctaggcttctctgacgctcttgcccaggccctctcaggatcccagtaaggaaacctcagctgccccagttgcctccccaggccctgcatccgtttttcctttcttagccattctttctacaaacatcaatgctgattctctccaaatagcaatggacctggcctctccctgtgagcccctcccagctcctgcagcatccaggacaaagcccaaagtctccaatcctgagtaacctccccttgctacaagctttctctttctcaccttgctgggcatgcatcaattacaagggctccactttgcccctcagcccctgccaaaagggccatgtaccgcctccatgtttcatcctctactcagaatgcttgcagggatagtgttgtccctcggccactattctcctccaaggggctccacacagcacaatgtaacttttgggctataagctagggtcttccttagcattgtttttttgtaaatcagggatgggttctaggtaagaattctaccaccaaccacacccacagcctttcattggtgggttctaggccagtgctctactgatgacccacattccagtcccttacaggggcactttaggcagcctcatcaccacaggattctaagcatgtgctctaccatacagctatattttatatccactttctggatcctaaatccatgcctcagccgcactagcaggcctggacacagctcacaggagatgttggagtcaagcctttctccctccttcacctctgacctcacttccttccatagaggaggcaatcctgggactaggctgcatgataacagtgtttccgtttaacccccagtcagagaaggaagagacagcattatttattaaaataacctttcagaagacaaggttttcctgaggatgtcatggctgtgtggcctttgacgataatgtgtgtggagagaatgtgacaggagcagagctcttgtcatctgaagttgacagatatccaccataaggacagcttccggcaggcatccatctcctggagacaaagagccgtgttctgctcgattttgtgtccctgtccctggagtttagtatctactctgaaaatgagataacatgaatctggcagagccaccaggatagacttatgcatgacactattccctggggagatgggaacaaacatccactcacccaaatatggaacccggaacagaccatagtaacaatactaccaaagtacagtgagtgcttggggtcacccaaaaggtgacttacaggagcagggtccaatcaaaggcagctgcatcatcaaaacccacttgtcatgactgacaggtaacgattcaagaaagctggaaccctagagctctctgcacaacttccaggcagctcaaagggtcagagagtctcctcccctaagccatcttaagtgcttatgtaactttggggatagaaggggccatgtccatctggtaagtttcaggaacttcctgaggctttccatttgtttactttctcagttctaaggagcctccccttagcatgagatgcttcagttcagaggagagtgctatacaacatgacattctgggcagtcttccaccaggaaactgttctaccttccctttttgtcaccaaagcaggcactgattcaaaatactacacaagccatttcccaactgacagcaagacttatttttccagtcaggcatgctgcctaaatcagaagcaagatttttatgtaaccatccatccatccatgttgattgaccaggcagtctgaggtgtgctggaacacagacataaagtaacttcagacaaggacgtggtcaaacacatcagcgctcaaggctcaatcagtaaagaacctgatgtgcaaacccaaagacctaagtctgaccctccagaacttacaatagcaatctgggagtgatgaagccctttggtcatcctgaggctggagaagtggagagcagtggatccctggtgctcacttgtcagctagtggagcttaatcagtgagacccactgcaaaaccttgtctggaaaaccagtgtggacaactgaaaaatgatggcctccacatacacatgtacacacatgcacctgcacacatatgcacacataatatacacacatacatatacaaatttacatatgtgtgtattatatacatatgtgtgtgtatacatatatgtgtgtgtaaatgtgtatatgtataaacacacacacacacacacatatatacattagggtctgtcactactttctgtttcttgtgtgttaaggttctgcagttaaacccagtaccttggacatgctaaacaagctctctatcacccagccaccctgccagcccctatctgtccttacgcttgaccaatggtcaccaagagcacacaatagtcaatttaataggtgtttttcagatgcttcagtttgctaagaacatcccaaagactggcactgactggtccctcactgaccagttgactctctcatctggacccagctcggggctgcccttcctcctgccaagcattgagagggcagaacagttgctgcgtgctggtccttgacttcaaaccgtaagataaatctatggccttggtggaagcagcatgtgttgttaccagttggttggtcgtatgccttcttatcagagggtcgcctcagtcatctggacctgtgatgagctttttatttttattaggaacgagtgctgttaagaagcagctgaacatgcagactaattacagccagagagaagcgcttagcagcaggcacactgaaatggagattgtatttggcccacactcaacactgaggagtggacagtgctaaataaccccagctacccacccaacatgccagctacttgggagagcggctgctgccaactttagcagcctagcaggctgacagggctgctgttctcctgaatgcccaggatcctggaggaaccaggcaggtgcggctcagtggctgaggcaggggcctccttaatgcttgatttcaccacaactcctaccattaaagaaaagctttctctgaggtttatagaccaccatggaggagcgtggttccatgcacttaactagagtcaaaactgcgtggagaatgtctggcccctgtagtcatattaggttcctcttgccatgaagtttgatggttctcttgttgcaagtgcctcggtaagctagaggcatagacagagctgacactgtcataagactgattcagggtacccacctggtgagctgaggtaggcaggtctggagatacaagcagaaagggcttctctatcgagctaaattcctggaccttcgagtaacatgagaagttggtcataaaatgaaaagcagttttcttactttctaaaatatgtactgactgtggccaagaacgatgtgtctatggggtcagggtttttaaggagagctgttgggaaaagaacttgaaaagctctgatgtagaccaaggatgcaaatgaatgcaggtctcaccaggcgcctcctctgacttgatttcaccgaggcttctctttgggccatcttaaaactctgtaaattctagaaaagtcgctacaattcaagtaattctggtctgtaaaaatgaagatggatgcaaatagattttatgctatagaaggtagggctgtgcctgattgtagctctgtagatattgatcagttttgcttctgtttgtcaattcattttagcattattgatgtacgtacgtacgtgcggtttgtttctttcttgacacaattggaacatcttattggaatcagcgaactaattaaaactgtgatacaggactggggagaccattcagattcagggagagaccctgtctcaaaagtaatgaggggtgcaactgaggaaggcactgacatcatcgacctctctggcctgcccatgcatgcacacgcacagacacacacacacacaagcacacacagcaggcacatctgcccatgagtgcacatacacagacacacacacacgcacacacagcaggcacacacacacacagagagcaggcacatctgcccatgagtgcacatgcacagacacacacacacacacacacacacgcacacagcaggcacacacacacacacagagcaggcacatctgcccatgagtgcacatgcacagacacacacacagcaggcacacacacacacacagagagcaggcacatctgcccatgagtgcacatgcacagacacacacacacacagacacacacacgcacacacagcaggcacacatacacacacacacagagcaggcacatctgcccatgagtgcacatgcacagacacacacacacatgagcaggcacatctgcccatgagtgcacatgccagacacacacacacacacacatacacacacacatgagcaggcatatctgcccatgagtgcacatgcacagacacacacacacacacacacacacacacacacgcacacacagcaggcacacacacacagagcaggcacatctgcccacgagtgcacatgccagacacacacacacatgagcaggcatatctgcccatgagtgcacatgcacagacacacacacacgcacacacgagcaggcatatgctcaaggttcttctgtgtttgtaaaaaaaaaagctgtgatgctcctttttaaataaatttatcactgaacttaaatgaacatttggcagtattaaaaatgcacactctcaatgtaacactgcaagtttccatagaaaccctgatatttaggagaggtgattcccattcctaaactgagaccctgcctgttttccgtggactgggccaaggcatcctcctgatgaacaagagctgcggttgccttttaccagttaggaagaaaaatcaagtcattttcttaagatagtttttaagcttagtgcctgctgccgcctgcctatctcctggtaagttatccatgctatatttatattttaaaaaacataaatacctgatgatactagttcttaggttttgcttttagtaagtgtgagtgttcatagctacaattttgtatttctaaaatttagacttagttataagataaaaatctttgtactttagttacaaatttatatatactcatagccaggtatagtagtgcacacttgtaactcccacactgagagagttaaggtctgaggattgtgagtttgaggccagcgtgggccatctatatagtgatgccctggcccaaaagaaaaaaattaatagactagaaaatagtcactagagtccttcattccatgcctgggtcactcttgctacattctccatcacgtggctgcatcattcagtccctctcggcctccaggtctccctcactccggctccttctgcctaaaggagagggctctgctggtcatcacaactttccgaccctccctccctattcttcactggagccatatcctgcctcacccctgtcgcacccctaccacaccccggttacgcctcaccacacctctgccaagccttgccatcctgagcctccttcttgattgctccttccattctagagccatcctgaactctttgctcctgtggccccacctctgccccttttttcactcatggatgtgttggggtgagcgtatgcctacagatgtccatgcacgtatgtacacatgtgtgtggagatcagaggacagctcagatgtcattcatcagttgtcatctactttgttttttgaacacaaggtctcaagttacagaactcaccaagcaggctgcagtggctcaccagtgcgccccgggggttcgtctgtcttcatttccccagcactgggatagcacatacagactaccacacctggcttgttatgaggtcctgggaattgaactcaggtcctcctgcttgcttaacaagcccagtacaggctgagcaatctctcccctgcttcacctcttattttgctgtctctccttgccctgatagactcgatcttctctcctgtcccttatgtgttggtggtccctgaagcgtcaagaacacagcctcctcatccagctgcttgaccaatgactctgtgtgcctctgctattctccttccccacagagacttgtcagtgtatctctaactgaatcctccccgagccccagtctgcagtccaaggaggctacgcctggacagcttccatgctcagacaagtcctcctgtctactgcagtacttgtcacctttgccccagaacatgcttcctcttagctatgtgaagctatttagggttcctgccacattccccccacaacctacttccttttaccctctccacaactgctgatggagtaggaatgccactctgtcccattgtcctgtgtgcctccctcaaggccattcctcattgagccactgggagctgctgcagagcaattcctaaagggagcttggcttgactaagatcgaaggtaggaagtgttatgtccctttccgcctttaggaggtgctattatttgcgctgaaccatacactaggcccagccaagggaattcctcctctggaaacccctttatgggagccataaatgctccacggagcactgtgcagcaagacagggagcttggttcataggataggctacattattataatgtaacccaaaggttacattgtatccaatcgctggcctatcttctcaccgtcttgctatcctaagtctatcctctgtagaactagtcgcttgaggaatagattctaggctgattagcatgggagacagtaccattcatcatctggccactgtctgcctctccatatttgtctccggcctcttactggtctgctttctctgtgcttcggcagcaagcattgcttgcacttccctgagcatgtctgagaattatctcttccccaaacccccacccctcccattcctgacattctgtgatccacttctacttatcaagtcctgtcagctgtgcccagaaagtgtcaggggcactttcttcctccctactatgtctttccacaaagatggcctaggttgtgctattcccatcttctcctcaaggaggcgcagccacagaccgtctctggcatggtaaacacagtcccggctcctctgtgtgctgtccgtggtactgaaccacgcaatgggcgatgacagtccttaaggtacagtgacaacagatggcaatcgttttgttttgttttgttttgttttgttttgttttgttttttactaatctcattcttcaggtttgcaaagaccacctcctatgttttcagcagactcgtggttgtaacctgtgtcttccatccgatagctgcacacgtgtacatatttttgatccccagcacagctggacatgttttttccaagttgcttagcttttttctacttttcttgctgtgatctgtcagctttctttcccctatttttctaatgaggattgggtatttctttcgtctgtcatttgtgacaagtctttttgctttggtttggtttgattttttccaattttctttttgcacttaatttttgtagattttatttatttatactgtaatcaggatttcatgtatcccagcctgctctcaaatttactgtgtagccaaacatgaatttggaattctaaacctcctgcctccatctcccacttgctgagatggcagacatttgccaatatgcctggtttatgaagtaccggggattgaatccaaggctcagggcgtgctccctaccaacagaacttcatccaacccagcactgtgggttatttttgacaaagaagtgtttgattcttatgtagtttagtctgctgctgtttctcttacgttttcttctaattgcttttgtatttggatattttaacattatcaggtataaaataaatatcatagatttgcacctttattttaagtagttaattttccacatatgtaacatatgtaattcacctggaatataggcatattatacaactttttctggttttcattctacacacatgatttattgaacaatccacttatttataatgctaatttttcacatgctaaatgttcctgtttttaaaaaaacaacaaacaaacaaacaaaaacaaacaacccagacttgacatggtgacacatacccttgatttcagcactgtaaaagggaagcagaggcaagagaatctctctgagttggaggccaacctagtctacatagcaagttctaggacagtcacagctacatagtaaaacactgtctcaaatttaaaaaaaaaaaaaaaaaaaaaaaggtctgggatgtatttggacctagttggtcatcatcaggtgtctttggttggggggggggggtggttttgtttgtttttctacttgtagttcttgtaacattttaatgtgttttaaatacaatgacttccctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctcataatgtcctcctgcctccgtttcccaactgcttggattgcatatgtagtgacttacagatgtatgtgactacatctgtctgggtttcattgaggttttaaggaaggagttaaagctgtgctgagttctatgaagactgacttcttggttgacccatctgcccatccagagggtcctgcactactactactactactactactactactactacttcttcttcttcttcttcttcttcttcttcttcttcttcttcttcttctttttttttttttttttttggtttcttgagacaggtttctctgtgtagccctggctgtcctggaactcactttgtagaccaggctgccaggctggcctcaaactcagagatccacctacctctgcctcccgagtgctgggattaaaggcgtgtgccaccacgccccagctgggtcctgcacttctgcattcactctcaggatcgctttccaacccctttgagtcagtagccaggagcattctgctctttctttccatcaaggttgtcattgctaaggcagagtttctcaccctgtaggtcaaactaccctttaacaggttatctcacagcagatatcctgcatgtcagaaatttacattacagttcataacagtatcaaaattacccttaggaaatagcaacaaaaatatttttatggttgggggtcaccacaacatgaagaactctattaaaatgttacagcactaggaaccactgtcctaaagtgtcaactccctgctttgtgatttggactttcccacagtcaccacctcccagcttgccaaggttgggacacaggaggcctattgtcatcctggcacttgcttttccactgctacttcccattctcttgttattctaatgatctttctgttgatcctcttagttttcaaagtaaacaatgtatcctctccactaatagaatccattgtcttctctttgtttttcctatcttgctgggctatcagaatacttttaaatgataatgagcctggtagagtcgcctgttgttttgttcccccctgatctcagtagaatatcttctaggattttggtgccttgtataatacagatttctttttgttacatattgagtcacaatttgcatagaacaaaacacagatctaagtgagctctgacaaatacatctatctatacctgcagtccatgctttgaacatgtgtgaatcatttcaactctctagaacatccactgggtccctgtccccctcccttcccccttcgacccttcgaattctcacctccacaaatcagctttgcctgattgtgaacacacccagaaagatgctggttggaatggttgatatttcacagtaaaacacacacactcacatacacacattctctctctctctctctctctctctctctctctctttctctctctctctcgtgtgtgtgtgtgtgtgtgtgtgtgtgtgtgtgtgtgtgtgtgtaagggcagccatgtgagaaactataaccacccatctcttcagctttaactcttgccccaagctttctgttaccgagcttagcagagcaccaccaggtggactgccagagatgtatcctcttctagccattgctgttagcacctgggcagagcctaaattcatcaggagacaaagaacactcaggaaactaaatcacaaacccagggacaggggacatggcctaagttggcatatgaacatttttccagggaaatgtttctgagagtcaggaccctcaaaggaggagtcagaaaagccctcttggacgtgaaccacatgtggagatttgcaggacctgggtatgtgtgctaccctcataggagctccagggtacagaaacctggatgcaggaagtattgtggcctccctgccatgcccagcacatgtatttgcaagagcagaagtttcccagtccaagagaagccagtggcaaggattttttttaaaaagcattttcgatgtagtaatatatatgtttaagtccagggtaatacatgctgattgcagctagaaaaatgttagcagacatacaaagaaagacttgcttatctgcctccaccacaaccaactgttgctggcagtctagtgaattcccttcgacactggagagagagacctgtgaggaatatgaagggaccagaggatgtcaggcacatcccacacagagctgttgaacaagcttttaggcagcagaacttggcaggcgcagagagaacagagcttgaggctccaggctggaatcgtggagggcagtgtggacagtcgcccacccctcagttgctgatagacatccccagatgggggtaccaggaacagtctggtctttgggaaacagaaggcttctgtggagtgtggatctgagcagagcatcagtggtcatgatgagctgcagcgtgtgagaggctgttctgggattctgctgatgatagaaagtgtagaatattctcaattctgcagtgacctgtcccacccaattattagttttatgttatttgtctgtcaatttgtcagtctgtctttgtctctctttcatactgaaggctgacctcagactcgctatgtagctgagaatgaccttgaactcctgatcctccagcctctaccttctgaatgttggcttggcaggcctactccgatagtgcaagtttatgtgttgcaaggcttggaaccccggaccctgtgttttccaagcactcgctccaccaactctccacccccagcccacctgtgcttcctttgtatgtgtatatatggatatctgtgcacatgtgtgggggggtacattcacccatgcatgtgggtataggggatagaggttgacaatggatgccttactctattctcctccaccttgacttttgaaacagggtctctcattgaaattgtaggccaccatttcagctagactagccaggcagtgactcctgggtcccacctgtctctatgccctcctcccagcgatgaggttacagacatacatcactgtgcccagcttggttcttgtacttgtacaaggagcacttcatccactgagctatttctcagcacctctcagctttctgaagtggggctgggtgtcagcttctggtccaaggctagcttctagagaacactctctgaggctccacactcctctgagcatcctctctagcatcactggaggccaggactctcccaacacagagagagcctggaagcatggttttgttcttttccctaatgccacaggtgtcttttcatgtacagacccttctgcctcacacaccgcactgtgtgagctcatttgctctgctctgcgagccgctgctgactgtcatcacacaatatgttaaacatcttcctccacggttgctattatgtccttaaaagctgatgggctttgtgctgttttgcttgtctcgatggcagaggctttgttctctgtgcttcagagtgctctggtgctgtctttgaaacttattgcacaggggtcctgctgacaacctctggagctgttcaggagtgcttccaggtggctcgttgtcctgtgggattttacatattgagcctcaagctccccttttaaaatgcagcccaagagaaagcacctgtcacaggtattgatggccattgtgggagcccagaaatggactaggatgcgggtaccagggctcatatacaggttgttctctgcccttatggagaagatggttgacccacgtatcctccatgggcctgcacttgccttatggaaggctctaaacatcatgacctacagaaggtcattccttactgtacgcatgtcacatgtggaggccagaggtcaacctaaggtatcttacctccaaagctgttgaccccccccccttccctctctttctctcctctctcctctctctccatctctccctctgtctctttcatctccatctctctcttctctcccgctctccctccccgcccccaagctctcttctctctttctttcttcttttgttttagaaagggtctcccactggccagtaaaacaccagtgagtctatacttaccgatcagaaatctccagggatctgcctgtctcttgctccccaccacacacggcattgcaagtgtgcactgccttacctggcttattacacaagtgccacggacccaaactcacatttgcttatgcattttctctgcttttaatggtggagaaaataaggactgagggatggagaaatggctctctagggtagatccaggttttatatggcttataaaatcctggagctcatgttaacacacacacacacacacacacacacaccattcaaagggtctctgctaggactttgtcctggtctcattcctgttgctttgacagaacactctgaccaaaagcacctgagtagaggagagcatttatttggcttagagtccatcatttcaaggaaagcaagacaggatctcactgcatcacacccacagtcgagagtgggagagacagatgcacccatgctacctgctggctgcgtccactcagctggttttctttactcagatacagttcagggtccagcccataaaagggcaccacccacattcagggtaggtctgcccacatcaactagcctaatctagacacgccatcggtgacatgcccccaaggcttgtgccccagctgcctttagatcccgtcagggtgacaatactaacctctagccaaaagggacatttggtggccactgttagtggtgggtatagttctcatcctatgattccactctaccccagaggcagcaggtcctcaaatgccgccctcacacagcggcacggtccacacttggaacccaccctatcctccagggctacagcatggggaccaagcatgcctgctttggctggagctctcaggcgccctctgctccagctggtatgcaaatgcacatggattcaagcacttgcatgtgtgcacacaaacatactcatgtctccccctctccgtttttggtatatgtgtgtgtatatgtgtttgtacttgtaaagagatacttgtgtgtacatgtgtgtacaggccagaggtcaaccttgggtgtccttcctcaggcactgtactgttttacacatagtctctctctggactgagagttcaccaagtaggctaggctagctggccagaaagtctcagcactcctcctgtgcccaccatattgtcttgttttgtgggttcagggaattgaattcaggtgttcccacttgcaaggggaactctatgcaccaagccatctacgcacccctttgctagagcttctcttacaaaacccagaatctcttaggacagaccctactcagaactttgtaactggcattttcttccttcacttatgaccaacagtttgccaacaaacccacctttttaaattgttttctcttgataagcttactgttataatttagcagagttatcctgtgtgcctcactttgagtcagtctctctctccctctatctttctctctctctctctctctctctctctctctctctctctctctccctctctccctccctccctccctccctcccttcctccctctcactcctgttggtgctgcgtgtgtcccagagctgatgcatgctcagataccctgttttcccctgctgtttgttccctgtcttagagcccctcccagaatccctcaggatgctcagccatcacacagccttgggcttaggcagcaggacagtttctcagttgtccctctttgccttgaccgtgacagctttgaggatctctggcggttttaggaacactgctcagttggagtttgcctgatgcttctcttgtggttggcctgtgtgagagaatgtccttctcctcagatcacgtcaagggctctccctgtcagtttgacttagcgccatcattgttaaatacaccgtgtgtgtgtgtgtgtgtgtgtgtgtgtgtgtgtgtgtgtgtgcgcgcgcgcgcacacgtgtctgtctctgtgtgtgtatctgtatgtatgtgtatatacatgtgcaaatgttcatgtgtgtgagaccatgttcatgtatatagacaccaaaggacaacctaaggaattgttctcaatcccagcactccttgctcttttgacacaaggtctttcctggagcctacagcccacctatgaggcttggccagcaggctagctagtgaacttcctgtcttatctccttagcactggggttacaagtgtgtgccaccatgcctgaccctcaaaatacaaacaaaaaaatgtgggttctggaggttgaactcagtctctcatgcttgccacgcaagcactttactgactgggtctctccccttgataagtcttttaagctccagcaatcagcttagttgggcctggattcggctctcagctgcacctgtcttgagtgtgcagcctgatcccaaggaaatgcaacatctgtgctctcatgcaacatctgcaaatacagcctgggtgtagtgggaagtgtctctgatttacgtgacacctcttctctgtgacacagctgagatctttgtgggcacaggagaatggctcagtatcttgaccatctcagcgactcctttagtttccatggatggctaggcaactaagagatgtgactgggttcaccaaggcacactagcactctatgtcagtagcagctgaggagacactagcttggcttcagtcacacacacacacacacacacacacacacacacacacaaacacacgtttcattaaggccagctattccctcacatggtaaggaactgttagtgtcaacacacagtgcttgagtctcataagcttcagagtgcagacatgtgcattgaggaaaagactttaaaactagaaataatcaatttgctctttaattaagacactgagctcagtatcctggagggactggatttgttttctgtttatgtatggggtatgcatgtgtctgcctgggtgcgtgcaggtatacatgtacaggtgttcatttgtaggtttgcatgtgcaggtgtgtgcaggtatgtaggtgtgcatgtacaggtataagtatacaggtgtaagtgtacaagtttaagtgtacaggtgtgcgggtgcaagtgtgcaggtgtgtgggtgcaggtgtgtgggtgcaggtgtgtgggtgcaggtgtgtgtgtacaggtatgtaggtgcaggtgtgtgggtacaggtgtgtgggtgcaggtgtgagggtacaagtgtgtgtgtacaggtgtgtaggtgcaggtgtgcaggtgtgtgtgtgtacaggtgtgagggtgcaggtgtgcatgtgcatctggagatcaaggtcaatgtcaagtgtcttcttccatctctctcccccttggtttttgaagcaaggttccttggtgtgtctggtgctcactgactgacccaggcttgctggccaattagccctacagacctccttgtctcttcccttcccagtgatggagggtcacctggctttttaggtatgcactgcagatccacaatcaattcctcatgtggagcaaatgtttctatcctctaaccatctctccaaccctactgttttgttctaaccaacagatccctcaccagcctctctcttgcctggtcaggggctgtggtaactaccctgagggcgcccagtgccctggatttgggccacatttggatttgttgctgaatccatccccacatcttcctttagcacctggaggctggatttgagtcatattccatctgtgcatttgtgcatatattatctatgtgtgtgcatgcctgtgcctcggtgcctgtgtgtataggcatgggggcaaggacatctgtgcacaccaaacatgagaaaaagaaaaagaaacagtaaacccagcagtcgtctgagcccacacacagaacagagtgatcaagtcttaatattctcagcctttcagagtccagaaacagctaccaggtcaggcaggagaggagcatgtgagggggaggaaggaggcagcaggaggcaatgggaggcagtgggaggcacatgtgtcaggcccttcagatccaccactggctcttcagtccttaggagggacctcactggtagtcttgtgaggactggcttgggggagcatcttctcaaaagactttgcctgttaactgttgggtccagatgtgctgcaccacttacatcctagtgctcagcaagtttatcgctctggagcttgtgaatgaataaacaacttcccagactacgattggggggggggagggtacaaattagggtacctgtgagatggactaggctcattttaatcagctttacagtttaatttctctactgccagatctcttatcttctagaagggatagagatagatagatagatagatagatagatagatagatagatctatagatgagactggagcagtgacaggacgagagacacagagaagaacagggatcttcatcaaatcaaaccaggcaacagactctgtgtcttaggttatggacatttaagagctgatatgatattgatttgatactaatacaggaacagcaatgtcttagagtagatttgtgttgctgtgtcagaatacctgaggctgggtaatgtgtaaagaggggaggttatgtcacacacagtagagaagtagaaaggaaggcaggtacatatgaggcggccaaggagaggtgccaggtgcgcttagaaactagctctacaatggagaaaacttgctcctacaagaatggcactaaacctttcttgtttgattgattgattgattgattgattgattgttgttttgtcttgtctgtgtgtgtgctgaggattgaacccagggttcataagtgtaggcaagcccacagccccactcttccctctaaaaggtctctatacccccccaccccccacccaagcactgcatgtcaaaaacatgccctggcatcctaacttcttctcttgttgctgtgagaaatactccaacaaaagtaaccccaggggtttgtttgttctcgtgtacagtccatcatggcagggaaaccaaggtaggaggaactagaagcagctggtcacatcacatccgcagtggggaagcagagagcactgaatccatgctgctgctctgccttttctccacttatacaagtcaaggatcccaaatagggagtggtgccgcccacagtgggcaggtcttcctacctccatgtaatcccgaaggcttgtccagagtcttatttcacagttgattctagattctgtcaagttgccagttaacactagccatcacgtcagggaagtcattctcaacatgaggcttgagggggacataccagattcaaagcccagcaggcaacttcctgtcctaagccttctctgaccttcccttgctctgatgaatttagtccaccaactagcagcctccttcttccaattttgtcccccaatgaggaggctcactcgggtctctaagcagagtagctgctcactttcaggcagctgaagagaaggctggcatgagctgcctgagagctatatatacctccagggttctgaaaggaagtaggtggcccagtgcgtgacccctgttgttttctgtttgtttgcttgatatcggtttcacgatagatgtgaggtgacaggccctagtgagcttgatgatctctcaatttcacagaagttcaaaggaaacggagcatctccacgtgaagcgttcactgcaaatgtcgctcttcaggttcttcccatctcacaccagctgtctttgggatggaactagttctgtaaatgttaaccttggcaaagggaggctctgctcctaccagcctggcccagttcctcagtgtcagagacacttgtctgaccttctgcattgtcagagacgctcgtgacggactctgctgagaaactgcagcctttgtgggctgaatgatagtgacagcggctcagagggagaggcttttcatccctaagggtgtacatattgtggagttctctctctgtgtgtgtgtgtgtgtgtgtgtgtgtgtgtgtgtgtgtgtgtgtgtgtgcctgtgtgtgtgtatggtacatacatatacagatgctcatacccatacatgagtaggcaaaagcgtgatgccaggcatcttttcctgctgtccaccttactgcctcaggacagggtccctcactgagctgacgctcaccatcttcgccagactggccagcatgttctcaggctctgcctgtctgtgccccagaattggggcttcagacacacactagctttatacgtggtactggtgattcaaacccaagtccccttgcttccagagcaagccctcttacccactcagcccaacaccgtgcttttaaatgaagcataaaggaatccctgtcaacagctaattacccaaatcaccaaaaaatcaaaagccaggaacataacatggcccagctggtggcaaaaactgtattcccagaaagctatgcttggaagcagctttgtctataatcatttaaaacaaaaatccatctttacagcccaactggcaccatgtttggggcagcttgacttttgtgttaaggaatctcagctaatgaattttgacctggggctaggcatcccttttgttgcctttggggtgcctgagttctgttttggagcagtataaggccacctcgcagtgacctgtaagtagctggagtgacaggtacatttcccacgaacccctgatgtatgccatgacctccaagttggccatcagctttctgcagaagcagctgtgatttttatgggtggtgttcctgtgtagctggtgtttgttgtccaaagactgagcagaacctagcccactgggaaccacacattcattctctctctctctctctctctccatttttagtgagggccaaaggaggttgctagtaacactgcctctgagggacaagaacaatggtttggttcccaggagagcctgccaggcacctatgtgttcagagtaggaacccacagcagatgctgaaaggcacagcaggtcacccttggctgggctgagaggcacagaaaatcataggacagcagcaattcctccagaacattcccaagcctaccttgcaggcaactgcagcccattctgctgacaaaggcatccgttcacacctgcaggaaagctgcttccgaagggtgcacagaaccacgagttctatgccttttcccagccagctcagctcagggcgtggcagaaacaggctgccgctcagcagatgggttgcgaaatgcctagcccgtccatatttaatcaccgtaatttccttattaaaatgttaatgaatatagtgcttatttatcatcccctgatgtgtggagcatccttttcctggagacaaatcttcgacctgcctgatggtgagccaagggacaactttccccactttataccgagctcaggaattaagacttttcttccttctcttgaagtgccatatgcaggctgaagaagaaggaaagaaaagtttattttggctgaggggacggctcagttggtaaagtgttgaggacccaaatttaattccccagaatctatctaaaactgtctggtgtgatggtgtgagcttgtcatcccatgctggggacacagacaggaggcttcctggagctcactggccagccaatctagctgaataagtgagttccatactagtgagggatcctctctccaatgcagaatgacccccaaggttgattcctggcctccatgtgcgtgatagtacacatgcttgtacaacattacctgtatgcatagaaacacatacacaaagaaagcaagaaaggagggaggcaggcaggcatgcacactttcttactcaggatcaatggaagggtctttctgcccacttgtcttggagtgtccataggaataacaggaggttctgccccagatttagggtgagtctcctgaacttcatgccagcagccatattgctagccacacagcggagagccttgctttgcacatttatgaggtgggctaggcactgcctctcctagaaccgtctgggaaagcaaacaggatggttcttgtccactcactgtggagatcaatgctcatgcatgctgactcgctctgtgcattcttgtagactctccatggaaagtgcatttgtcaaatgttggcccggagatgacaggcgtcactgtgagtggcttgactccagcccggacctatcagttcagggtgtgcgctgtgaatcaagtgggcaagggccagtacagcacagagacaagcaggtgagtgagcctgatgtcctcctagagcaagggtggtgtgggtcccagcagtagatactgggaaatctgagcagggtaaatcctggcgtgtattcagctaactgtacttccctttcacctgttcagaggccactgtcataaatccttccaatggtgctctctgacttcacaggtcattcctgacggcacagccttctttggggtgatgggggtaagtgggtagggtctcatgtagtccaggctggccgggaattcactgtgtagctgaggatgatccttctccctctaccaaaacagagtgccgagattacagatgtgaacaccacacccaaattatatagtgctgggggtaggacccagcgcttcatgtctgtcctagcatcatttccgttgctgtgataaaataccctgataaaagtaatgtaggagaggaagggtttgtttcagcttacagttccaggttactgtcaatcaagccgctggccatatcatacccagggtcaagagcagagggaaactggcacacacatgcttgcttgcttgcgctcatctagatttcctcaggtcaggatctctttcctagggaatgatactgcccacagtgggctggatcttcccatgtcaatcaacttaattaagacgatcccccacagacatgcctatagaccaacctaattaatgtaggtaattcctcattgagactgtcttcccaggtgatcctaggctttgccaaggtgacagaactaatcagaatggtaaatgagcgacatatgccatacatctgccattgcctcctggccgagttgttgccatgttgactgtcatacctcatgcacacacggcctcaatggggtcagctgcatgtttggggctggttttctcctcaaaaagcctctgggctgggcaccttgttgctgtccctcacttctctccctgttatatttcgcctttagattgatgttacccgaagaaccaccgagtgctcccccaaaaaacattgtggccagtgggagaaccaaccagtccatcatggtacagtggcagccaccacccgaaacagagcacaatggggtgcttcggggctacatcctcaggcaagtacctaggacaggccttcagggtgtcccattaactgttcaggtcaagtgacagactctagggagggatgctgactggagcaaagcagatttcaaagctaatggctgcctctgtggagcctctctgggtatggtcaccttcagaggtcacacagactagcatcagaggttgcactgaactgaagaataaaaggggcattatgggaaagatcccagacgtgtttttcctggtgaagccttccttcagagaatatgtacatttataagcacaatcacttaatgaatactaattaaattgatgtagctattaacctacagccactatgctaacctgttataccattttgccagatcttctggcatatcaaagaaaaaaattttactgtgtgtatatgtatgtgggcatgtgtacttaagtgtaatacccaaggaggccagaagagggcctctgtcaaatgcactagcccagtggtttgtatgtactgtatgtattaaagggtcagggcatgaaaagagttgagaggcattgttctaaacagatacttctgaaagagctgtgggcttttcctaataactcttagagacaaggtgcccaccgaggtctcctttcttccctttattcattatttgtaggtttattatatttctttcactatttaatgaatagaggtgtgtcagacaacaacttgtgggcgtcagttctggtcttctaccgtgtgggtcccagaaatcgaaggttatcagctttgcagcaagggcctccacctggtaccattcctctggctgtatctttctgtgtcaatgtctcaggtagctcaggttggcctccaactaacattgtagcccaggataaccttctcctcctgatctcttgcttctgcctcccaaaggctggaatgacatgagtgtgctaccacacccagcttgaaaatgtcagtcctttagctctatttgctttgactgcgaagggcatatgactttagtcacccactgttcagctaaccatgagaagggaggctggacttctaagtacggtgggaaaacctgaaataaaaatggtggctggagagaagtctcctttacccaaaatcccttgctctgatcaagccagagctgaggatcacagtcagctccctgctgtccctaaggttccccccagcccaccatcttcccttaaccaacacccagccttgtctgtctaatggggcttcaaggatcaatagaaagtcaatgcccacggttcctcagttcctcgtatctctactcacagctgtcaccctccatttacaaaaggtcagagagctacagcagtgtcatcctgcagcagtggccctgggctctgttccagctggtggcagttgccagtggcctgaccttcctgcccatcctcctgctgcctcctgtggctcaaggatgactttccctccaactttagacatccctcatgtccgcacccatcagctaatgaaaataattagcttgccctctccacagccgccgcctttctcagcagcagaaggaagtttcccgaggctgagcctgtcaagtaggggctgtgatgtttgtcccattgaacacgcttggggcagagcctaataataaaactgtctgatgttatgaggcctcacggtagactgcgcatctctctattttgcaggattactgtccttaaaggatccttggtgacagtgctgttggagtggagtaggggaaagggcatctgtgctgttgacagcttaaatccaagaaaaccctcaaaaaatgagggcacaccaccccaggccttaaatatcaaagagtgtggaagttaaagacctgtaccaaaatgcatttgcctgcaaacatttctgagcaagactccagcttgcatatcgttgtttgcgagcgagaaccctccagggcacgggctctgtgtcggatccaacacacaacgcatgggagcaaatggaaaataaatcaccttggtggctcacaccgaaagaagtagttaggatactctcacagtgataaaatatttataataataggcagcacatttctccgagcagcgctcagggttatgtccttagaaagaaagaaaaaatgctctcctgtttatttctggataaaaactcatctgttctggctcagccagtgtccagggtaacagatcctcctagaaaggagggagggtgctctgagagctcctccctcaccttgacctcctcagacatctggcatacatcaccagagttcctagagcctgggcctgagtggacctccctgcctaactattttcaagaagtgaatcttagagatcgctcattgagtggctgaggacactgtagctgggacaggctttgtgttctgagcaaggacttcagcttgtgtccccaatactaatttcataatttttccatggagagtgtgctgggtagttaagggcttcctggagccatcccttttcaaggcttgttttgcaatgtctcctagaaggctgtaaagaaacatctacttaggacctggggagagattgctcaggggatgagagggctggctctgcagacatgaggggctaagggtgaatcctagcatccacataaagaactgggtacggtatcacatgtcagtccccccagggctgcacctgggggtaggggccagacatggggagctctgaagttcatttaccagcccacctacccaaatggatgagctccatgttcagtgacagaccctgtgaaagagagggtggctgatggtgacctctggcccccaagtgcattggtatataggtaacacatgcacacacacatgcatacacacacatgcacacacacacacacacacacacacacacacacactcatatacacatgcacacacagacacacacacacacagacacacactcacacacacacacatccacatatgaacacatagatactgtacacacacaaatagaaacaataattaaacatctcctcggcgctgtattgaagggggcacattttgacagtcataaggaaaaggatggtggacaatcccttgggtgcatctttcttgagagagtggcaccgaggtgtccttacagtggagatgcatatccactgggctctctaggttatatacctaataggatgcattaacggtgagatttaaagaaagatgtgcaaggcctcagtttcaagttaagcatttccttttgttactacaatcttatgcaaattttgtggacttcttagatcaaggagatgaggagtgagacattgacacttggggctgcaagcattttgactgttttgtttggtcggttggttttgaggcagaagttcgtgtaacccaggctagccccaaactccttatgcagccaaggatgaccatgaccttctgatcttcctgccttcactttccaagtgctaggattacaaactggcacctctttatccagtgtaccaggtgccggggcacaaccaggggctccagcttgcaggcaagctttctgtcatgagccacacacaccctcagcttgtttatttaacatccttgtgtgaaatctatcccaggctactttgagaattatctgctgatgtttctagactctcagttagcaggtgacacaacttggatcccagcaggagggctgtctttcccttcttaggtcccttcattgtgtctgcattcctagcctgcctctgagggattcattttgtcctatggtctccaagggctccatccatatcacttggctctgttatttctgagcttgtgttgagacagagtcagagcagaaagacctacagaaagactatggaggagccaggtacaaaatatacattttgaaggcttggccatagtgacctgccttctccagcaggccccacctggttcctgccaactcctgaatcagttatgaacctgctgattagatcagacttcccccatccgacccaccagggaggagtcaggatttaaacatgagagtttatctacctcaaaacacaactccacctcaaatgggtaaggagcatattctagaatcaaatctaagtgaccatggtccagggtcacagacttagggtcgcttcaaattctgggctctaacattattacagctccttgaagttttgtagtcaaggaacaaaaaagtcataaatcaaagcactttttcagctacagtgatagaaaaatgggtaggtaaagcagggctggggtggctgggtggcgggggtgggggtgtcagctattgccctcagatgctagctaatggcacacacagccttttggttggtggaagctagtggtctgctaagctaattcatttcatccttgttaatcacaatgatgttaagtcagacatagaggtaggcaaggaatggctatcaagggaaggtggcccaagattaattttaattagactttggacctgcaacactccaacctcccccacagtcactgaagttctgctagtcagtcaatgagtctcgcagggcccaacaggaagtgcaggccttctcgagagcttgaaaattcatgagtgtttggtagaatgaagagaaaggccagctttgaccttcatgcctttaatctgtctacccttcagcatttctgttccctaccgagtgggcctcaccaagcacaaatggttcctaaaataagaaggatatcctcagaaagtcctggattgcaagaagaaacttgtatggtttcatttgcatatccctcaaggaagtcacagtatatacaaatacctgcatttccaggtcttgtttgttttttccaaccatggtgaccttgctgacctcagagtccctctgctgggtgtgtccctttcctctgctctgtcgggcacgctgtgagaagttagcaggtatgctgcctctctgtctgagcctctgtcaaggctcgctctggatatcacacaaagctgcatctccgagaggcactgctttgagaagcttcaggatggctgtgcgtgtctctcatcttccccgggggaactgatccagaaaagctctgtgaattaactgagccacttcagtacattaacttctataaacggaatcatggaaaaacatttgctaatcaaaataatgcaggagaaaaaagcctttccacagtacaaaagccgttccctgaattcatgcctcttttttttttcttttttttaagagctggcttgtgtaagcatcttgttaataaatataactttaaatttctgctccagggcattgaagacaaattacccaaggactcacaaagcaccctctttcccaccccaccccacccccaaaaaaaacaccttaatttgtcatactcagacattttagaagttttaacacctttacaaagccacttactatgggtatgggatatctctggacagtctagactattcttaaatggaaacagaatggacttggacagaggacttggacagaggccaggaacatacaggccgatggcttcctgatttctccccacaatgcactctcaggaggcagcctttctccccacccctcacagagatccatggtggaagcttgacccatagtcactgtacgtacttggcagttcacaccatagccactgttcatacttggcagttcacaccatagccactgttcgcactgggcagttcacaccatagccactgtacgtacttggcagttcacaccatcatcactgtacgtacttggcaattcacaccatagtcactgtacgcacttggcagttcacaccatagttactgtacatacttggcaattcacaccatagtcactgtacgcacttggcagttcataccatagttactgtacatacttggcagttcacaccatagccactgtacgcagttggcagttcacaccatcgccactgtacgtacttggcagttcacaccatcgtcactgtacgtacttggcagttcataccatagtcactgtacgcacttggcagttcacacctgaagtgtaaaatctttaaaacataataattcagaactatgtaacttgggtgttcaggaagctgagcatggatccaagtgaagcctgggctgcatagcaaaccctgtctctaaaggaaggaaggaagtgggagagaggggcagagggaaagagggagccattattttggttccaacagcctacccctccccatatcctccttctagcagcaggggcactctaagccttaactgatggtgtaggctttaagaataactttggctaatctctcatttggggggaggggcatttctattacttttttttttttcaaaaggaaaacagactgggtgcagaggtgcatgcatgcagtctcagaacttgggttgagatgtgaagattattgcaagtcagagcccaatctggactacaccagtggctaggatctctctcaaagcaagagtaacaaaaacaacagaactttcccatgaccatacagaagttcaagtccactctacttcatctggagtttgcagtcaccatgagattagagtatagcaagcatgaagccattgtccaaggcaagctctggtcagggatgagctcaaagcccagttcatggctgcttccctctgccttcctcttgaggtgattccagtccactgcgggcggtgtccctacggtactcacacccgtgcttcctctcggctgcaggtaccgcctggctggcctgcctggggaacaccagcagaggaacatcagcagcccagaggtgaactactgcctggtcaccgacctcatcatctggacccagtatgagatccaggtggctgcctacaacggggcaggcctgggtgtcttcagcagggcagtgaccgagtacaccttacaaggaggtgagctgcgaggtggggggtggggggaaactgtgggaacctgggaactggggttggcaaggtctgattgaaatgtgcaactctcaagtgaaatgtctacaaaaacacaggtcttacctcaaaatgggtaaaagccagtttattttggagccagatatgagtgaccacagacaaggaatacagatttgagttgatccaaaaagtcgtactccactgttgtagaacaaagaaagtcataaatcaagacactgttcgaattccttgttggaaagctcacagcaaagcaggatagttgctgtctcaggcctgttgctgtctgatggtgtcacaggcctcagatactgtctgaggctgtcacaggccttggatgctgtctgatggcattcctgggctctgagtgggtggaagctgtaggtcttttttatatatagcaaaaggatttaaccagcagtcttaaggttgttaggtcattcatggaactgggctgggaatgatgaaatcgagggctaaagagagctcaaggtgctttggctctggacttgtaacattccaactctcacagacattctaatcagccagtcaaccccatagaaggtttgacatgattatgtgttttatttctctgggagcttcggtttctgagagccttgagggaaaatctaaccctacagcagccagtggcatagcttcctagtagcttgggttcctctgggatctggggacagaagagtctatgcacgtaatatatgggggtctctggagggtctaggaattcagactttcctaaatggaccatagttgtggttttgctcaaggagccagtccaattcaccatgtcactgtcattacctttcgaagcgaacagccattcacaattctgctttagtttatgactacggttattgggaatagaattcacaagttttgtgcttttcttcctgtattatacatgccaacaatgtaaaatcagtagaagctccctcacccctcaaataaatagtcaggaagaatgtctgaaagccaggaggtcctcaacatatataggctaagacagccccaagatatagagttaagcctttcaagagagaataactctttctctgctttctggaagattccccagttatagccctgggcagctgaatgacattcacaggcacataacattgttgtcctgaacagtaataaataggccctttcttaatgtccacattgattctatggcagccccaatcctggctgggggacacaatttcccctcctggtctcaaagccgttcttcctcatgcagcggtgtatggggctttcagttcacaggtgcagttttcccctcctggtctcaaagccgttcgttcttcctcatgcagcggtgtatggggctttcagttcacaggtgcagttttattttcctaggcacttttatttctatcaggctatgaccttttttcaaatgataaggtttctaactgcccacttctctccccaaatcctgcctcagacctaatgttccttgatattacatgctgttattatcagcccttattgattggctgtcggttgtcatctgagagtccataaatcctcctttataaattaaaaacagtcagcgctgcctgcccagcaagtagcagaaatattaaaatgctggacagctgggcaggacttgcccatctgcaagggactcctgaccacccatttgaagaggcaaacagtggacgacctggacaataaatgcttgctttaatgagtccgtttaataaaataacaataaacttgaagacatttaaaatgactaacatggaggctagagaggtggctccatggctaggaacatctgtagcattcacgttgaacaacttaaagctctctgtaactccagctccaggggatctagcgccctcttctggcctcagtgagcaatccactcacgtgcaaatgcatgtaattaaaaataaatctttatgaaattatgaacatggctatggattataccctattatcattaactgggactcccccattgtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1562 - DNA, 2256 bp, Mus musculus
atggccccaatcatcgtggttgccccaggcaacagaagtgtggtagcagggtccagtgagaccaccttggagtgcatagccaatgccaggcccgtggaggagctgagtgtgcactggaagagaaacggagttcgactcacaagtggactacacagctacgggaggcgccttaccatcaccaatccgacatcagcagacaccgggatgtacgtgtgcgaggcgacactccgggggagcacatttgagccagccagggccagagccttcctttccatcataggtaatgctcagtccagcagtggtgctggctgcatcctcagatccatgtcctttatcccacttgcagagctcaccgtgtcccatacagagcacacaggtcccaggggatctggtgtagacatcctcagggaccattctgcccactccagtggacgaggcacccagtatggacagctactgcagccaaaggcacagcatagcagcagaactgggcctctagagggcagggaagctgatgtaggcaatgtgcttatcagaacaggcctggggatcagtctggattcaccaccaagcctgagggctgtacaacatggcctggagccaccatatttcactgctgagccagagagtcggattttaggggaagtggaagaaactatggacatcccatgtcgagccatgggggttcctcttcccactctccagtggtacaaagatgctgttcccctcagcaaactccagaaccctaggtataaagttctccccagcggaggcctccacattcagaagttgagtccagaagactctggaatcttccagtgctttgccagtaacgaaggaggagaggtccagactcacacctacctggatgtgaccaatattgctcctgccttcacccagcgtccagtggacaccacggttactgacgggatgacggctgtcctgaggtggaaccacattctggccagtggctctgtccggattcctaggttcatgctgctggaatctggggggctgagaatagcccccgtcttcatccaggatgctggcaactacacctgctatgcagccaacacggaggcttctgtgaacgcctccgccatgctcaccgtgtggaatcgaacgtccatcgttcaccctccagaagaccgcgtggtgattaaggggacgacggccaccctgtgctgcggagctacccacgaccctcggacctctctccgctacgtttggaaaaaggacaacgtggtcatcacagcgtctagcagctccagaattgtggtggaaaaggatgggtcgcttgtcattagccagacgtggtcaggggacattggtgactacacctgtgaaatcatatccgagggagggagtgactcccggacggcacggctggaagtgattgagctgcctcacccacctcaaaacctgctggccagcttgagtccagcacgcagccactcggtgacactatcttgggttcggccctttgatggaaacagcccggtcctttactacattgtgcaagtatctgaaaacactgatggggacacttggccatgcttcacgggtaacaaagcaaaagcaagatgcatttccttcaccgggagcccagttcctatgtcactcaagccacagactggaaaccgttccccataccctccaccccacccacccgagcagcagcagttctggccatcaatcctaggcttctctgacgctcttgcccaggccctctcaggatcccaaaagggtctcccactggccagtaaaacaccaaggcagcaggtcctcaaatgccgccctcacacagcggcacggtccacacttggaacccaccctatcctccagggctacagcatggggaccaagcatgcctgctttggctggagctctcaggcgccctctgctccagctgactctccatggaaagtgcatttgtcaaatgttggcccggagatgacaggcgtcactgtgagtggcttgactccagcccggacctatcagttcagggtgtgcgctgtgaatcaagtgggcaagggccagtacagcacagagacaagcagattgatgttacccgaagaaccaccgagtgctcccccaaaaaacattgtggccagtgggagaaccaaccagtccatcatggtacagtggcagccaccacccgaaacagagcacaatggggtgcttcggggctacatcctcaggcaagtacctaggacaggccttcagggtgtcccattaactgttcaggtcaagtga

SEQ ID NO: 1563 - protein, 751 aa, Mus musculus
MAPIIVVAPGNRSVVAGSSETTLECIANARPVEELSVHWKRNGVRLTSGLHSYGRRLTITNPTSADTGMYVCEATLRGSTFEPARARAFLSIIGNAQSSSGAGCILRSMSFIPLAELTVSHTEHTGPRGSGVDILRDHSAHSSGRGTQYGQLLQPKAQHSSRTGPLEGREADVGNVLIRTGLGISLDSPPSLRAVQHGLEPPYFTAEPESRILGEVEETMDIPCRAMGVPLPTLQWYKDAVPLSKLQNPRYKVLPSGGLHIQKLSPEDSGIFQCFASNEGGEVQTHTYLDVTNIAPAFTQRPVDTTVTDGMTAVLRWNHILASGSVRIPRFMLLESGGLRIAPVFIQDAGNYTCYAANTEASVNASAMLTVWNRTSIVHPPEDRVVIKGTTATLCCGATHDPRTSLRYVWKKDNVVITASSSSRIVVEKDGSLVISQTWSGDIGDYTCEIISEGGSDSRTARLEVIELPHPPQNLLASLSPARSHSVTLSWVRPFDGNSPVLYYIVQVSENTDGDTWPCFTGNKAKARCISFTGSPVPMSLKPQTGNRSPYPPPHPPEQQQFWPSILGFSDALAQALSGSQKGLPLASKTPRQQVLKCRPHTAARSTLGTHPILQGYSMGTKHACFGWSSQAPSAPADSPWKVHLSNVGPEMTGVTVSGLTPARTYQFRVCAVNQVGKGQYSTETSRLMLPEEPPSAPPKNIVASGRTNQSIMVQWQPPPETEHNGVLRGYILRQVPRTGLQGVPLTVQVK

SEQ ID NO: 1564 - DNA, 131576 bp, Homo sapiens
  misc_feature (1)...(131576): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccccgctcccaccacaccacactcccatacacacccaaatccatcacatagatgcacgcccgctcctttcgtgccgcgtgagccgcgcgttggcgcgcagaggggtcctccccatctcccgattatactaccacccaacacatcgcaggccgacctccacccccccacgcctcaaggtccagaaacaagaaccggctcggaccagcacccacaatcatagtaaaaatgaacagggtgttcgactacacagttaagtgtgggacaaataaaagtctttctacagttgaacatggacacacttgccaagcgtcttgctaaaatgctgcttctgatccagcaggtcttggggggcctgagactctgcatttctgacaggtgcccaggtgtggtgcctagccagcccatgggccacaatcaaagtaacagggatgtccattaattttcaagggtgtggtagagacacaaataccccttcccaaaccctatctccaagcctccgtgttggaattagtctccctacccccttgtcccgccccggcaggccggcaggctggctgaagagtttcctacccgcgtctcctctgctctgtgcttacctcctggcaggcagagccaggataaatgttcccctccttatctgccaaggcagtggcatgttttaaaagagcaatatggtatttatgttcacacatacacacaaactcacacactacacactacacacccaaggcgcaggagagaaacgctgtctgcacccatttgcaagcatctaagaccccattctctcagcatgcccacacttctctccctgaaagggcacagaaacctgcccttcacctcacacaggaacccccgccatgctgaagggcacactgtagggcaggggaggaggagctacatagcctgactccagggtttaaggtccgagttcaaattctgactctgtctcttcctagttaggtgaccttagacaagttaactaacctctcggagcccatttgagcagttttttccattgtaaaatgtgtgaaatgatgaccaacctctcagggtggttgaacgaactggccgattgaaggatatagggatatgaatggagacagtagcttagggcagggtgctagtggtgaggcagagaatggggtggcccgagcaaggtgtcctccttccctgtggtcatcctgtctgccccgaattttccgtccatagccaccactcccaacctgggagctgggcagtccctgaggctgacctcccgcccctgatcctactgccgttgtcccggctgcagacatggggagctttgaggaaggtgagaagcaccagagcgtctcccacggagaagcagctgtcatccgtgccccgcgcatcgccagcttcccccagccacaggtgacctggttccgggacggccgcaagatcccgcccagcagccgcatgtgagtgcatcgctctgaggggacggggaggggaggggtgtctgggggaggaggtttggggccagataaagtctcccttgagtgtggaggagggcctttgtgcagaagcccctttcagctcctgtgggacacagccaggtaggggacctcccaggggctttcttaggatgcacaggcaaggacttgggaccatgaaacccatgcccggtccccttcctggggaatcccagggcgttgcctccaccatcagctggagaataaatctgcttttcagagcacttaaaaaacccaaacaggcatatacgaaggcgctgtcaccgtggttacaggcccaggactcaggccagtggcgctgggggaccttggagaggctggcgtctcctgggcagccgggaggccctgggcgcgtccgttggcagggtgtttactggtgtgtgagggctgtgtgtgtcttggctgtgcggcggaggtgtggccagggaagccctgggcagagaaacacacaggcctctgagtgttcacaaggccgtctctgtgtgcccctgggattcgggggcagcccacctgtgggcaggaggatggagccaacaccccacacctccgcagaaggcgagcaacaaagcagttcctcccgagatacacccgtctccccgccctcctgagccacccccgggtctggaggcagctggggctctcctctttccaactccagctctcccctgcttccagaagaccaccttctgatctacccaggctgcgtgtacacaggactgagcctgtcctggtctctgtagagagtggaggcgtagatggatggttcctgcctttggggagcattaagtctagttgggggaaggaagcatagtaacaataacaataataataatatcactatcacaggccggacgcggggctcacacctgtgatcccagcactttgggagactgaggtggactgatcacttgaggtcaggagttgagaccagcctgagcaacgtggcaaaaccctgtctctactaaaaatataaaaattagctgggcatggtggcaggtgcctgtaatcccagctactcaggaggctgaggcaggagaatcgcttgaacctgggagtcagaggttgcagtgagccgagatcggggccactgcactccagcctccagcctccagacaaaaccagactccatctcaaataatgataatatcaccatcatcataatagcagctgccgtttattgaatggctgctatgtcctgaggactgagctaagcacaccacacacatcccctctctttccggacagccacactctgtgaggaagaagatgctctcaatctcgttctccttccagtccgcagagcacctgcagaaaggaggcgttgttgaatgaatgaccctcacaacaacccggtgaggtgctgggtttctccccgttttacaggcaatcaagtgaagttcccaaaagtttaactactttgccaaatctcacacagctggtcagcactggagctgcatccagccctgccaactccggagtcaggttctttaattcttgtattatgtgaaaagtgcctgaaaacaggttcacagactcgatgaaaagatagtgtttgtggggaacaagccctgtggagtatctcaacgtagctacctgttgaaatcatttgggagtttggggatacagtcatgtgttgcttaatggcagagatacattctgagaaatgtgtcatttggctgtttcattgttgtgtgaacacacacctagatggtgcagcctactacacacccaggatgtatggtgtagtccattgctcctaggctataaacctgtacagcatgttactgtactgtaggcaattgtaacacaatggtaagtatttgtataaataaacatatctaaatataggaaaggtaccacaaaaatatggtgtaaaagatttttttaatggcacacctgtataaggtagtttcattataatcttatagaaccagcatcatatatgtggtctgtttttgactgaaacattatgcagtgcgtgactgtgtactgatccttgggctctatcctaagactctctgacttaattgaaatgggatggaatttgagcatcagaaattttaaaagctccccaggtggttctaatgtgaagccagggttaagaaccaccatgctagtatgtatcagctacccacagccacagatatgctgcgtaacaaaacagctcagtgggccaggtgcagtggctcatgcctgtaatctcagcactttcagaggccaagctgggcagatcacatgaggtcaggagttcaagaccagcctggccaacctggcaaaatcccatctctactaaaaatacaaaattagccagggatggtggcacatgcctatagtcccagctgctcaggaggctgagacaggagaatcgcttgaacctgggaggcagaggctgcagtgagccaagatcgcaccactgcactctagcctgggtgacaagagcaagactccatctcaaaaaaaaagaaaaaaaaaaaaaaccccagctcagtggcttagagcaatacacatttctttttcttgtgagtctgcaggctggtgatttaggctgggcttggctgggtggttcttctggtcttggctgggctctctcacttgtctgggactggctgacttgtctgggtgactggggtgacttggctgtgctgcacaggaacatacacttttccagcttctgctgacatcccatgtgccaaagcaagaacatggcagaactcagaatcaagatgtaggaaaatagactctgttccttgagcagcaggacctgcaaagtcacgggacaaagagtgtggatacagagcagggtgaagaattggagtggcaccccaggttaacaggggactcatgctgtgtgagtcagagtgtgccctcttaggcctaacttaatgctcaataaaaccagcagagaatggttcttagcatggatgtttcttagcgtggatgttgagattttgctgtggaaggggaatgctctccacacaggttttgggacaagtagacgagtcccagccccatcccagctccctttctgaggttatttcccatggcctattgcaagccaatcaattggtagtggctgcctggaacactgtgttgagaaggattctgatgtcccatctagactcattagaatgaatatcatgattgattagcaatgtctgccatggctgcgtgaggggtgtgctggcactttcctgctacatttgttgtggtgggtgaaaccctttctacaacctactcccatcatccctttcctaacacctcttcacctccttttctcattccaagcctctgtcctcatcctcttttaattcccacaaccctgtggcaccaggacagaacaccctggcctgcacacacatgcatacctccctggtcacacacacccccagcccctgcacaccaccgcaatattcctaccacctacatgatagaacactctgggggttttatcctggcaattacagcaaattaatattcataagtgagcagaaaaggtccctggcagcaaattccctggtgtctgtgtgtcagagatacacatctgatgagtgctatctgccagaggggtgtgcagggcacagaaggcgctgctatctacagagagccgctctcactggtggggcaagagcagagattagcaccacctcacgcatgccccggtgctcattgttgcaaaggagacaagattcctcataaagatgcatgctgggggctttggacacattctaggataatttatttcatgcataattaaattatcaatgggggctgcagggagctgagaaaaatggcctggattaacaggagcagtggggggaagggagggcagggctgggccaatcagagccatagcaaaagcctagtacattgaaaccagggggtgtggctgaaaaatggaatccagcccctgcccaagagttgaattctgctgtctgtgtcccccaagaattcttcctccagcttctttccatctgggttgcctctggggtgcagtgctgcaggttggaagccctcctgagtgccaggaagagcacccagtacagtacagtacagcatcatcccaggaatgtctatcaacgagatggacattctggagagagccacaagcccagggaccttccttcactgcctttgggggtcgcagagagggcaagtcaaaaggtatctctgcctcctgttccactctgtgtttaagacttgaactcaggccctgggggtcccagtccagggtgcttccctccaggcactagttaaagcagagcccaaaatctcagtgacttcacaccatagaagttgagttcttgcccatttattgttgttgtttttgtttatgtttttgttttgagatggattttcgctcttgatgctcaggctggagtgcaatggcacgatctcagctcactgcaacctctgcctcctgagttcaagcaattctcctgcctcagcctccagtagctgggattacaggcatgcaccaccacatctggctaattttgtatttttagtagatacagggttttaccatgttgatcaggctggtcttgaactcttgacctcaggcgttccacctgcctcagcctcccaaactgctgggatgacaggcatgagccaccgtgcccagccccatttaaagtcctaccatgatgagaggcaggagttttgccatcatcagcacacaaccttccaagttgtcctgctctgccagagagaaagggggcagacatgaggatcgcgcaggaggcgctcatggtccaagcttagcaacggtgcacatcccttcctccatatcccactagttcagcctcactgccccacctggatgcaagcagagatgcaaagtctgtctctggcttcccagccactgcagtccatgacacaagggaagcctgagactgaggtgggcagcggccatctctgccatcttaatatacactctacctaggacagaccatgtcaggcatggcgctcttgacatctggggcctgatcactcttccctgtgagggccttcctgtgcaccacgggatgtgtgcttaacaacacccccggccttgacccctattgttagtggcgctccccgagctggcaaccaaaagttgtccagacattgtcatccctggagggcaaagtcaaccctggttgagaaccactgacccagaaagcttgatcatgatatagacaaaatacagtgaaaggagccttcctgatcaagaaagagatgaaattggaggtgggagccttcttggagaccaaaagggtcctaagacaggtgggtgaactggaacgtgggccaagctgtgcccagtgtgcccactggaggcttgaagctgcttctatgatagtcatggatgtggcgtggctgggggagctgggccggcatggtcccggcacatagtgctcatgaaaatcctgtcagccctgaagctggccatgtcccggtctgcggggtgggaagagacaggtggcgggctgcagggctatcttgggcctaatgaggaaacaacagaagcagcaacaggaatcagaatccttcaacctctgggctggaagaaatctcacagaatacctgcttccacccctgcacagaggaggaaactgaggcccagcaaggaggaagctgcatgccctttagaggctagggccagagctccattccagagctcaccccgtgccccagccagagccctgcacggggaggacccctcctccaactctcagccaccctcacatgctatacctaaggacaagtccctgcaggaaactctcaggtgggaaaatgaccactatccctgtcttattttaagcttttgaaatattttcgcctggctctggccccacctcctattgcctcattagctggaggttaaaaggactctcctgttttttgtttcttgtttttttgtttgtttgtttgttttgtttttttgagatggagtttcgctctgttgctcaggctggagtgcaacggtgcgacctcggctggccgcaacctctgcctcccaggttcaagcgattttcctgcctcagcctcccgagtagctgggattacaggcatgcaccaccaccacacccggctaattttgtatttttagtagagacagggtttctccatattggtcagtatggtctcgaacccccgacctcaggtgatccacctacttcagcctcccaaaatgctgggattacaggcgtgagccactgtgcccagccaagagctctccagaaaaaaaaaaaaaaaaaaaagaggtgggggggcatcattagggtacccaggaattgggggcaggagggcttggcttcctgcttcccagagctgtgccaagagtgtgattctcagcatgtgaagcaccaaaaccaggagagagtggggcgaaaaccagcacagccgggctgggagagtgctgggctggagaagcattagtggggatgtttatttgagagcctgtttaaaactctgtaacattcacctaatgggaaaatttgaaaagaattcaactggatttgtccttgttaaactaacattaaggatgtttaacagctgtctcaggcccatcgcattaaaatccagagatatacttgacaaactaatggctttgtttgtcattgggagaatgggtggagggaggaagagccggtgtgggtggcgcttctggctccattgcacccacattccatggagcctccagcttcctgcttggacaagccccttttccctgccagaagacctggcctgagaaggggctgcatgatgggatcccagcaaaggaaaccagctgaggtaaacagcccatcaccacaccccaaaacacaccagcctctttttccctcctaaccagcccacctagtcccactcttggttatgagcttcaaagaggtagaaactccagctgggtacagtggctcacacctgtaatcccagtactttgagaggccaaggcaggcagatcacttgaggtcaggagtttgagaccagcctggccaacatagcaaaaccctgtctttactaaaaatataagaattagcccgggtgtggtggcatgcacctgtaatcccagctactcaggagggtgaggcagggaaaaactcacttaaccgggaaggcggaggttgcagtaagccaagatcgtaccattgcacttcagcctgggtaacaagagcaaaactctgtctcaaaaaaaaaaaaaagactgggcacagtggctcatgcctgtaatcccaacactttcggaggccaaggcgggcagatcacaaggtcaggagatcgagaccatcctggctaacaaagtgaaaccctgtccctactaaaaatacaaaaaattagccaggggtagtggcgcgcacctgtagtcctagctactcgggaggctgaggcaggagaatcgcttgaacccgggaggcagaggctgcagtgagccaagatcatgccactgtactccagcctgggcaacagatcgagactgtctcaaaaaaaaaagaggtagaaactgatacccagaaaggggactgaagggagacaggacttccagaagttgatgtcaccaggtgacctgtggcctttgagtccatcaatcctgaacagatttaggattagggttaaggcatggactctggaatggccctgcatttctaaattcattagcattcatttgtcatttacttattcattcaccgacattcactaatccatgctgagaacatttcttcagtgtctggatgtacatcatgcagaaataaccacacacagccatggaggctgtgacctgggaaagggcagaattccaaggggatacctggaagccccttgcccagtcttggggtaggggccagggaagcttcctttgggtggcctcggcgtctgggcatgaacgtgctgtctctgggtctggttgacagcatcagcaccgtgtttagcattctctgcaaactaaacgtggcgggatgtaggcagtaagaggttggggagggggtggcaggaggggccctgggaggctggggactgggagatatggtcgggcttcccccttagggtttccactcccactccctggaggttcagagccccttaggcccctgtcagaggaatccttttcctcttcccagagccatcacgctggagaacacccttgtcatcctgtcaacggtggcccctgacgcaggtcgctactatgtgcaggctgttaacgacaaaaacggggataacaagaccagccagcccatcacgctcaccgtggagagtaagtacgcacagggccgggaccgatcttggagcgggccattaaatcttagcaatggtgctccaggggatcattgggaagatggagtggcagaggagggggacagggaagctaggggacggccggggggagccttcccaaggaggacgagacacagcagagccaggggtgcctgggcaggaaaggagcagctgaacgctggagcccgttcccatgacacgcctgagatcctgcatcggtagagaggatgcttagcacaactgttagcagggctaccagggacccagggaggggtggggcagaggaagagcgtgtgcatgtgtgagttgcagccactatcggggctcagatgctgaccaggagggcatgtgggtgattgcagggctgaagcttgtttttacagaaatatactaactgtctctacttggctgtcacataagaagtgctgtctatattgggagccaggtggtccctgctgatgggaagacaggccctctgcccaggcacccacctaaaacacctccatcctcagacacctccagctccctgggcgaaaagggcaaagccctccctagaactcaccacacagtgagacacacacaaaagcgtgattcccttggtgtgctttggcaaagagacgcttgtccagccgagactgaagccagttttctttggagggacgagatgctgggatgttctttctggcctggttctccctactggacgagcccctccctccatactccattcccaagacagagaaggagggaggggtggacagcccaggagcagcgtaggcccaaatcccagagtatgtggggcgaggcagagcttcctcctcaggagcagctgatccatcatacaagctgggggaggcagatgttagttgcctccaatctgtacactggtgttcctatgtaagcctcctttatcattgttggtaccgatgtttttgccagtaggggcatgttatgagtgttaacacgttggtggtttttgttacttattttttgttgttagtttgtcgttttattttaccttatctttttttaaagtttttgatttcttatatttataatttactnnnnnnnnnnnnnnnnnnnnccatcacacaagctgggggaggcagatgttcacctccctccacatctgtacaactcctgctcccaaagcaagcctcatttatcatccttggtcacgatggtacttgcccaccagcggcaagatgagggtgtggaccagcctggggcctttctgtgctcttattctgatcctagcctctgctgtccatgtccagagggcccaggacattcccaggccttgccatccccattccagggcctttcacacttcagcaggaaccgcttcccattatcccagggatctccttcccctactcagcatccagtctgcctagaaggaaatctgaatgcggggaggagagtttcattctggagactgacccatcggcgtcacaagtatatctggagactgaccgtcagggttgagggtgtaacctctgacatcgagtcagggtctcagtcaagtctcagcagcctgggccccagcccataccctggggctgctgtttctataggagaaaggaatttagtcatcaaagagagatgcttctccccatatattttctagtgatcagattccctggagtctcatggaatcccgtcatttggtaagagacaatgtcaaagacacaggagtggttcatggtccaagtcaaagccaggcatcctcctaggtgactcagtttaccctgagacagagtcggggccttcctgtctgttccccttctccggcatccagctcctcctcataggcgttaaactaggctactcttcctgtctgactttgggagtcattcgctctctgctccatcccaaaccacccaaccctccagctggccccagggaggtgggcaggtcacctctgaccccctgtacccacccaagccctgcctagtcacctgcttctcccaccccactgcctcttggcctcctgccatcacacgctgatttatcctgaattcagagcagaatccgctgatttttagctaatttctctttccacaagtgactgcacttgaaaaccctcttcctctctgtgacacaaatccccagcctgcctgcctgcctgcctgcctgcctgccaaccaatttgtgaggagcaattgccgcttcgcccaccaccagcaccagctcccctcattcctctcctgggcctcacccctccgtctgctctcccctccgcaccgcttcctccatccctcctggactccaggaagtccagctttctgcacctctttatagggaccctatgctcttcagaaccagagaaggaaagagcaagtctggtgaccccagaagttgccccctgctcaggataaccctggtgacctcattcggactgtcacagctcctgaaaaccccatgcttgggtggataccggggatcagggctacactgtcgaaaggaaatagaatgtgaaccacatgcgaaattttaaattttccagtagccccatttttttaccaagtaaaaagaaatcgttgacattcattttattactctattttatttaacccaacataacaagaagttatctttttaacatacaatcaatgtaaagaatattaatgggatatcttccattggttttttgcatactaagtctttgaaatccttgtgtattttacgcttatatcacatctcaatctggatgtgaaattttcacccgaaatacgtgatctgtatttagatttcacaaaatttatagctgaaaagtagagtcgtatgcataagttgttccgtacatgcttaaaagtgttctaataactgaattggggatccattcttaattaaatgtaaattagttaaaattaaatcacattaaatcaaagggacaccagccacattgcaggagctcataggcacgtgtggctcatggcccctgcattgggtggttcaggtcacagggcctggataccctggctcctgggcagctggagaacaggcatcccagaagcctgcccaagagaggggagcagctcacacccctgccccaccgctcaccgacctgtggcccaggcgagtcccatggtccctgagcctcagtttccccatctgtaaactggtgcctatggcaaagttgggaggactaaatgaggtggcacaggtgggtcacatggtctctgagcctcagtttccccatctgtaaattggtgcctatggcaaaaatgggaggattcaatgaggtgattcagggaggatggatcacgttagatgtcccttgtcctggctgttacgcaaagcgtctggggcagtgagatccagtgaggccccccgtgtggggagccccgtacacttcctcccaccccagggcccaccctatgccaggagctcaccgggaagacacccctcctctttgctcgggctcacctgtgattttcatggtctggcctttggagccccatttaccccaataacccacttgtgctggggtgaccttcattaacagtaaatctgctccaggactcacttctctgagacccactcaactcccgctgtctcccagggagccacgccatgaaatgcctgaggccttgcccggtaccctgcagggcttaatgtgcgtccccgagcctgcgactcccacctctccatagcctctgagtctgtcacttggactagggctagcagggagagctcttccctgcacaggcaggcaaatctccaggaggggaggctgtcatttattgagcacctactgtgtaccaggcactctgcagtcaccccagaccagcttagctgcccccttcccggcaaccatcacacgctctttcattcattaaccccacgagcattggttcgacttcctctgggacatcaccctccatgaggacagaccctggccatctcgcttggtggagaatctctggtgcctggaacacagcctggcacgtgtcaagcattcacctaggaaagatttgttgagctggggcctgaattcatacaaccctgagaggtagtgactttcatccccatttcccccgtgagaagactgaaactcagtaagatgaagtcaccaggatacctgggggcagagctaggctttgagcccaggtcttcctcacccctgggaccctttctcactgtgccagcatccctggccacctcagcccccatcgagccctgcaggctgccacctgggcctgagcacatggccatctctcctccattccttccagagccaacgagccagccctgagccctggggcagccctcgtatttttaaactcagaactcgccttccttgagctctccctgtttacctggctgtgccatgcggcgctctggcttgggctctaactgtctgtctcttacttgtgccccattaatctgagccgtggtacctgcgcgcccccgcatgtgataaacaacttagagcacacttttatggattcagctatatcagcagctttcaatccgatcgctcgttatggcacctacatgaggcttttatattgttgcaattattttgctttatatgcttcctttctttcccccttcattttactttattttttacattttatgcgcattcttcctgggccttttctagcaaggcctggagtcaaggaaggaaaacctgcccagggctgacaaggtggcccagaggggcagtggggccactgtgcaccctgcccctaaccccataaagaacagcctgtcactgtcaccgcagggcccagcatgtcatcatggcctactacctccagaaccttctggaaaggggccaactggatagatttgttgtggagaaaaagtcctcagaggttgtattttcaggagccatggatcaggcatacacagaatattggagtttatgccaatatcgggcctacactgacccatcaagatgaaaatctggcctctactttaaaaaaaaaaactcaaaatataaaaaaaaggaattgctaccacctctattagaagaggagtttggagtgtttctctctctttttttttttccaataaaacccacttacaggaagttcttgttcatttcaatcatcgaccctgggagttggatgatggtaactctagatccattcatttgttcacttaacacacgtatttgagcacttactgtgtgccaggcatccttcttcgtgctggaggagaggtggtcgtcaagaccgcaggagttggccaggcgtggtggctcacacccataatcccagcactttgggaggccgaggcgggtggatcatctgaggtcagaagttcaagaccagcctggccaacatagtgaaaccccgtctctactaaaaatacaaaaattagccggacgtggtggtggcacctgtcatcccagctacttgggaggctgaggcaggagaatcacttgaacctgggaggcagaggttgtggtgagccgagatcgtgccactgcactccagcctgggcaacagagccagactccgtccaaaaaaaaaaaaagactgcatgagtcagctcttggtgccataacaaagcaccacagctgggggcttacaaagcaaatgttctggctcccaccatcctggaggctggaagtcccagattgggaagccagtatggtcagcttctcttctcagcttgcagatgtctgccttccagccgtgtcctcacatggcggagagagagccagctctggcctcttcctctttttataaggacatgaatctgaaatatggaaatatacacacctaacaagtacctggaaacctgctttctgagagtttcatccttaactctttcatttcattcaatgagagaattaaagtattacatgcttttctaagcaaaagttgacaatatgttaagagaacatttttctttttccttgggaccctcattggccctcatgaggcccggccctcgtggcctcatctaatcctaatcacctcccaagggactcctccaaatgccatcactttggaggttaaggctcaacatatgaatgggtgggggacacagctcagtccacagcaaagacccatgaggttcctggtcagggagaattttagtctcttatggcctgcacaacaaagtactaccagctgagtggctcacaacagaaattgagcctttcacagttctggaggccagaagtctgaaaatcaaggtgtcagcagggctatacttctctgaagattctagaggagtctcatttcttgccccttcctggcttccggtggtggccagcaatgcttggcattccttggcttgtggccacatctcttcactctgcctctgtcttcacagagtcttccaggctgtgcatctgtgtctcaatttccctcttcttacaaggacaccagtcgtattggatcttgagcccaccctgatccaatatgacctcaccttaactaattacaaacctgtaatgatcctatatgcaaataaggtcacatttacaggtgccagatgggcatgaattggcgggaggtgtgttgggggagggggccggtgactctgtttgacctcgtacagagagtttgcattctggtggaggacgtggacaatgcagaactaaaccaacaaggtcaacccgggcagagggaaggatttgaagggaatggaacaggacagggtggtggtggggagaggggggtgtggctgctttacaggaggggtggggaaggccgtcaaggtcagcgatgtctctccttggaccctggtgtggtgactcatcaacagaggaagtagagggatcaggtagtccctggggtcagtgtctggaggtctgctctggggctgcccccatggccacctgctccactcggtaaggacaaagacctcccagggcatcagcctctaatgaggctgggcagggataggatttccagcctcgcccccagctaacatctgatctctctccagatgtaggggggcctgcagaccccatcgcacccaccatcatcatcccacctaaaaacaccagcgtggtggccggcacctcagaggttaccttggagtgtgtggccaatgccaggtaggtagtgcatcttccctcgctcccgcacccgtaactccagctgctgctcccaaactgcgggctccagggagagcagccagaagccacatcacctgaggatccaggacaggggaggagggatgcaaggagacctgctggctgttgtcagagggttgctgtgtacaaccagggctggcttgttctctgtagtccaagaagagaaaaccaggccctggatggaacttacagggaaggggacgtcagcctgggacgtacaggactggagggagggtggactcacttctaacccttggaggagcccagagggagtgggtggcctctcaaagcgagccctcttgcatgcagggttgtgcaggagggaagtgtgcatgggaaacgattcacatggtggttaagagtacggctttgggcgcgatggctcatacctgtaatcccagcactttgggaggctgaggcgggcggatcacctgaggtcgggagttcaagaccagcctgaccaacatggagaaactccatctctactgaaaatacaaaaattagccaggtgtggtgtcacatgcctgtcatcccacctactctggaggctgacaggagaatcgtttgaacccaggaggcggaggttacagtgagctgagattgcaccattgcactccagcctggtcaacaagagtgaaactccatctcaaaaaaaaaaaaaaaagagtatgggctttggagtagggcagatcaggggtcaggagccacccgagcccttcccagccatgtgcggccctcacctctcccacacaggaaacaattatgaaacccctgagcctcattatgtgtggctaagtgccttccgtgccctgcatcctgctaagcaccttcccacaagacctctttcctcccaaaacaatgtatggcataggtgtcaccacttcagaacccagagagggcaagtggcctgcccaacgtcacccagctggatgatagctgagttgaaatgcactgccccctctcccccaggcctgtactcactgccgccctctgggcctcagtctccacatctgtaaaatgggaatgatctgagcaccaaccccagcggaaggcgcataggcagcgcgctgacccagcctgacctgacccttcctaagtgcactataaagttaaaccaatgggatgggcagggggttagactgatgatccccctgaggtccccttgacctgaaacttcctggagagggagagcatgtcctgtagcagcattttttttttaagacagggtctcactatgttgcccaggccggtatcaaactcctgggctcaagtgatcctcctgcctcagcctcccaaagtgctggggttacagatgtgagccaccgtgtccagccttttttgttgttgttattatttttggcagcatttctaaaagtatgctcctcccatcccaagtttctcacaggcatggcgtattagcccatttgcattgctataaaggaatacctgagacatggtaatttacaaagaaaagaggtttatttggctcacggctctgctggctgtacaagaaacatggcaccagcatctgcttctggggaggcctcaggaagcttccaatcatggcagaaggagaaaggggagccagcgtgtcttatggcaagagagggaacaagagagaggggaggaggagctaggctcctttaaacaaccagccctcacatgaactaacagagtaagagctcactccatcaccaagtgggtaacaccaagcattgtggatcacaattccacatgagacttggagaggacacacatccaaaccccaggacttgggcaaggccaccagggtgcaactgtgcagtgaaagccctgagaagcccctcgatgaagaaactgcccagcgtcacctcaagctactgtcactcaagccgcagtttcccagacgtatgcggccacagaactccttttccatggggcccttctgaatacccccatggcactagcaggggcccactttggaagatccgtcctcagggacccaccaggtgctaaacaggagtgtctggacagacccaagtctcgggggcttgggggtgcaggggttggtgatggtggaaagccaggccagactcacacccttgctcttctcttgcagttggggaatgggtttttctgtctgtctgtctgtctgtctgtcttgtctgcccttatttccccttttcaaactctgggtgtttcatgtttctgtctgtcacttgccctcaccttcatctcctccgtgtcactgatctgtggtcagatggggcacagcacacagggaagaccagaaaaaagagctgcaagccaggctgctttcctgctttgcctgagctgccaagccctgagttccaagtccatcagcaggccctgttccaagcacttcactggcactaatgcattcatcttggctacaaccccctgggcgggcacagatgcgcccactttatagaagaggaaagtgagacccagagccctgtgggaacttgcccaagatcttgcatctacaaagtggcaggaaggtggcaaacccaggcagcccggctcccaagcccacactccttaccaccccctgccctgcctctcaggcctctgggagtcctcatggctgaacactggccttcccttgccctctgcaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctgggtgagagagggtggggctgctagggctcccctgaggggtaggggcagcacggcgagggtcctccttaagggtgaccccctacagtggctggatcaaagcgagcatggctctgaccccctcccctggtccttcctcctgcagaaccgcctcagtttgtcaaggagccagaaagacacatcactgcggagatggagaaggtggtggacatcccctgtcaggccaaaggtaatgaggtggcaccgctggagggggacaaagaccccagatcttcagcctctcccatcctcattgtggacatttctaaattccagcttcttctcgagaccatgtcactaggcagagagtctgtctggctgtctgagcaggcaccccaggaaacaaacaggccaaattaccataatctcaggctggaaatcaacctttacggtaccaaaacttgagggttacaaatgaacccaacttacagtaatttcaggacaggtgacagacccaaatttcccaaaatttgagagctgtagacaatgacaaattaccgtaatgccagaaccagcagcccccgggtgcatctcacctgagatgtgtcttataagctcagcctgtttcctgggccattttgctccatctcctctgccagctccctccgctattcctacttaaccccccttgaaagagttcctggagaatttctactttccccttccccaccgtccttccttctgattcatttccgccaaaagacagcccgcagccagggtgaaatccgggatgataaagagagaagagcgtgcacagtgggacacgctgagcaaaggggcaaaatgtgtctctgcaggaatgaggactgtgctggaggggatgagtaatgacttcccttctgagactccacaaggggaaggcaaagatccatccattcaggcagcaaatattttttgagggcttaccatgtgccgatagtgtcctcaggagtggggagatacataataaaccaaacagccagatccctgctcgcgtagaatgtaacattctcgggagggagatgggcaagctgataaacaaataaagagaacttatttcatctcatctaaaatgccatgggttgtaagatgccccattattttatggaccactaagaaagaaaaaaggcagccaattaaattatgacatgctgttgattataagacacatcctgatctcggagacgtgaccatgggaaagagagcgcatggtggattggatgaaatgtggcatcacaggctgtcaggatcaaagggtgccgggaagggaaggcaagcaggcttagtggggacagggccgtggggtgctccttggaatagggtgtggccaactcttctggggaagtctttttttttttttttttttttttttgagactgagtctcactctgttgcccaggctggagtgcagtggcacgatcttggctcactgcaacctctgcctcccgggtacaagtgattctcctgcctcagcctcccaagtagctgggattacaggcatgcatcagcacaccaggataatttttgtatttttagtagagacagggtttcaccatgttggtcaggttgatctcaaactcctgagctcaggtgatccacccgcctcagcctcccaaagtgctgggattacaggcatgaaccaccacgcccagcccagctgggggaacttatgaaaacaatgtgccaggctgagagcgaggagaggagcctcctcctttcacctccatgtgcaaagccggtatggggggcttccaagtgccccccagggaacactggaccctctacgtgctcttcgacacagggcgccattcgtttgggaaagcatcccccacttggaggttcccagagcacacatacatgtctgctaagtactgcaataaaaaataagaaattaggccaggtgcagtggctcacacctgtcatcctagcactttgggaggctgaggtgggaggaacgcttgaaaccaagagttctagaccaccctgggcaacctagcaagactccatctctacacaaatagaaataaaaaatagaataaataaattagtttgtccaatccagtttccatgctaaactgattcccggatctttactctgtcccaaagactttgagaattaccactcaaagagcatcttcctcctctccctagacccaaagtggcacctctgagaaggttctagacaccaagattcaccagggaccccctcgcagatttccgggcccggcctcctcccaagcacccctcctaggcggagaggaggcaggaggcaggttgacggtgggcccacgtcttgcccacaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagtaagttgggccttcccttgtgctgcccgtgagcccctcttcccaggacgcagctttcttccaaggtcttccgaggggcctcttgtgcatagcacgttccattaagcagataggatccccaaaggccgcctgctgcccagcagcctgggggcacagccagttaccgctgctgcctctgcagccctgagtccagagccctggaggaaatctctggtccctagaagttctctccaatgtcctggggcccaggttgcgttcacggctttttgagaaaaggagctatgaaaccaaccacgggtaccagctctggcactgcgactatccctgggttcccaggcagggctggagtaaccccattccagaagacctgctcatgtttccaaagaagaaaactggtgtttttctcttagttctcctgctcgcaaatccctttctgcccttggagtctctgtcaggggttgtcatagttgccctggccgcttcccagagctgtttttagcaatcaaaggtgataactgtgggccgggcacagtggctcacacctgtaatcccagcacttcgggaggtcgaggggggtggatcacttgagcccaggagtttgagaccagcctgagcaacatggcgaaacctcgtctaccaaaaatacaaaaaattagccaggcagggtggcacacacctgtactcccaggtactagggatgctgaagtgagaggaccactcaggcccaggaggcagaggccaagatggcgccactgcactccagcctgggtgacagagtgagaccctgtctcaaaaaaacaaaagaaaaaagatgatactgtgagtggcccataagctcaaaggtctgtgtaaatgcaaagcactggtgggctcctcaggaagaatggggatgttcaggggtctccttgagctccacggtgttcatcacccagacccacagaggccgcggacagggcagctgtggggcagagagcttgtaggtgtgccccaaaggtggctaccaaggggctgccgtcttgcttctggcttccaagtgcaggtgaacttagctctgttcccacgcccatctggcgagctccttccttgagggctgggatggggcaaggagagtgcaaagccaggaggctgccccaaccctaaacggtggccatggccgaatggagctcctggggcagggccacttagaaagtggcagaagtccccctcttggctgtggctgtttttcttttaagaagccagagccttcctttcacttttggcttgtaaaccccaacaaccttgtcagggaggatgggagctgcctcctggggtcttcagtttcccccaaatgcaggcctgagaatccaagcagtgtggggactggtgtcacctgggtccttccacagggcaggtggcataggggagtcctcatgacccctccgggcttcttccaaacactggggctccatcaagatgcctacatccttcctcgtggagggcccctcaccatggcagggggaggatgagggcctggccctcggtgggcttggaggcccctggccctctggcttgggggacatctcccagggtgtggctaaaaggccccacttctctgtttgcaggcatcgcccctaacatcaccagaggccccctggacagcacggtgatcgatggcatgtcagtggtgctagcatgtgagacctcgggggcgccccgaccagctatcacttggcagaaaggtagatggaacacaccttcagagagtgtggctgggtgatagcctagaagagtcttcagaactaggctctggagccagccaggttgggttccccacgtacacttgtgaaggtcatacactgtacaacccaagagagcatctctcggccgggcgcggtggctcatgcctataatcccagcatcttgggaggttgaggtgggcagatcaccctgaggtcaggaattcaagaccagcctggcccaaagtggtgaaacccggtctctactaaaaataccaaaattagccgggcatggtggcagttgcctgtaatcccagctacttggggaaggggctgagataggagaatcgcttgaacctgggaggtggagcttgcagtgagccaagattgtgccactgcactccagcctgggagacagagcgagactccgtctcaaaaaaaaaaagagcatccttcacatcccagccttgccaggctcaaggtccagctcttcatcttccaagacctgccatcctggtgagttactaactcactctgagcctcaggttccccatctgtaaactggtgacaataatatatataccccagggtgatgtgaagactagactatagcgtgcatgtgagggtcctgcattatgcctgggagtccgaaagcccaggaaacgataggtgcttgatgatgaatattattctagtggtggctgctgccagtctcctaccccaggcagctcagagggctccagatggcggaaccagcaaagcccaagccacctccctaaggccatctgccctgtgtgcttcctcttcacctctgtgtgtgcacactcaccttcacaactctcccctgcacacacacacatatgcacacacacgcatgtgcacacacatgcacacacatacatgcacacgtacatacacatgtgcacacatatgcacacacatgtacatacacatgtgcacacacacgtacaaacacagttgctccttcacaccggcaagccccagctcagaggtgcctcctccaaggactcaccctgccccagcccccagccctcccctccagccctacctccttcactccccaccttctcatgcatttggtcatcggcttatttacctagctcatggcctgtctccccacaaagtcaggggtgtcggttttgtccactgccgtctcccaggacctagaacagagtctggcacacggtaggcactcaataaacatttgtggggataataggggcacacctaggcacgtgcttacacatggaaataaacacatccacccagcacactcagttcactgtgcctgcacgcatgtacaaacggacatgcgacccccagatggacacatggagattcccttccttacgggggtggggggttctttaaaatagacatagtcacaaagacctgcattcccaggctcactcctgcaggtgcacttgcactctctctttctccccctctttctctggccaggaccctcccaggctgggccccaggctccctgggtccccctgcagaaggaggtctgtcctgaccagggctgctgctgggggacagcgtgtccctctctaccccacccccactccaggcagctcccgtcacttcccttcactctcttgaaggtgactctccccagaagcatcctgccgcaggatgcccgtcatcaccttgtcagagctgtccccccgccagctcccccaacccgggtgccagctgcctctgagggctgtgccgggctactgctcaccgtcatcaggaaactgcgcccccttctctgttgaagggcacgtggtgtggcgggcacaggagcatcaggggacctgggctctaggctgcccgctctgagaccctgtgccctcgtgtccgtccctaagccagaaagctctccaggtctctcagcccccaccccagccccaccgccatctgtcctcattccttccagcatttccagagccaggggcctgtggggggaccatgctgccctggagcggccagggaagggcagggtgtgcccttgggggctacaggctgacccccaccctgttttgccctcaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttggggtgagtgtgcagagccacagggctttatacatttgtgtgtgcgtgtgtacatccctgtaggtgctgaggactcaggacagctacggggcacaggctcataccaccagtgtctccatccccagtgtctgtcccagtcagggcccttctcatcagagggacagtgacaaagtggttcagaggccagggactaggaagattctgccggtgatgctatgcttggccgacttgagagaacattgaagttataggagagctgccttcatatattttagggcagaaatcggcaaatattttcaagaaagggccagatcataaatattttaagctgtgtgggccagacggtctctgtcacaacgactcaactagcttccgttttatctagaaagcagccacagacggtatgtcatccaatgggcgtggctatgttccagtaagggtttatttagccaaaaaggccacctgccggatttggcccccagcctgtagttagccgacccctgctgtaagagagcttctcaagccacttccaactttggatccacacccagcatacctgtgggccacttgtctgggctgagcccaggggtcctggtgcatgaagcactagactggaaatcagaaagccctatttttaccctggctggaccactgatatgctgaaaatatggtcctgatcgtccttagagtttggtctctccatcccatacatggtttgtgagagcaaaatttaatgagccccaactatgacgtggcttccaagaattaaagtaccagggagctcattgttctttttaaccatttgggggctttcatatggtatccacccagagtccagccacacagcccccacacctcttctcaccatgctgtctccgctgtatctttcagctcggacccgcatcaccaagcccccccaggatcagagtgtcatcaagggcacccaggcctccatggtgtgcggagtgacccatgacccccgagtaaacatcaggtactggctctgctgttgactccaggcaagaggggagggggagcctctggcaatagcttgtagctgggcgagtgtccacattagggaggtaacagctgcagagccacgccttctcctgggcagtggcatttccagagctgagtgcagggctgagaggtagggggtatgaaataaacacccgggaactgagctaccctgaattgagttaagccagtttccaaggtgggaggaaaagaggaaggggtgcagaaagatgaagtaagaggaatggaggagggggtgagggaggggaaaggaagaggcttgtgggttagtgagcatggaagggaaggagctgctgtctctggccctggacgccactgctagtgtcccccagcccaccccaagtctttggccctctggcctctgaatgggcagcagaggggtctgggcaggcggatatgggatcagctataggggtggggcaggagatgacccctggggggaccctgcaagagaagcacatgtgggaaactgagcctccaaaccgaggtcaccccaccatcttccatggccaagccgggaccttggcaagggacttggcttccaggtaactcagtcccgcctctgtggaagccactaaaagggctgggaggaagcagccaagaaaggtataaaagccgggacccctcccaagcacctgaaccaaaccctacccccacccccaaggctttggaagctaaaaccaggaggagattgtccctgccttctcttccttgagctccagaatgctgagggaaatgcaactgcttccttagaaataaatattccctgcgtgttgcttctctattttatgagcaatatcactgtcaaagcaactggcaccgaggctagaaggggccggcgctcctgcactgggagaaatggcctcctcctcatgccgaaggcagctgcgtcctggggcgccatctggtggccactggacctatgacagtctgtacagccacccccaaatgagactccggggagcccaggttggtacaaggggctccaggcttttggccaacactgattctcagagaacatatcagcggccccagtttgagaaacacctcatgaagtgttgaccacttaaggcagtcatcacatgacgctagcacaaatgcaaaaatgtacgtagatgtattaatagttagaagatttttgactgagattccagaatatgcttatttctgggtttaatagatttttcttaaaaaattaacataccaactgtaaaaaaggtcctgggagagaacccacatagaatactgctgtgtatctcgggcccattcattgtgtagtagctatacttttagcattcattaatagggaaattctgaaattcagtatactttaaatcagactttatttataaaaaagatgacttacttataaaaagtgtcaacttatttgagaaagacatacattgtattcattctctagacagttactgatgcataatgggattcgggggtctcttgcaaagtaacctgcagacccactctgtaggcccttccagtgaactgcaggtcagaaatccctgtaccaggttactgaagggaggtcctcgccttaaacggaattaaccatctaggaccatcttttcatcaaagggatgattctggggagcagaatcatccctttatcccccccaaaattggcaaagtctatgcccaaggccaccccagcagctcccaccccagtctgtcttccttggactggggggacggggacatcccttctaccctccgtcttgaggtagatcttggggatggggtgagacccagacctcagcaattttaagaagctccccaggtgattctaatgtgtcaccaggattgaaaaccctgttctatctgcaaaacacagcagggttccctaagcagactattaggtgggtgcaaacgtaactgcggtttttgcctttgaaaggaatggtcaaaactgcaattacttttgcaccaacctaatagaaaggatctcaacaaccaaaccagactaaagtggtgccgctgaatcctgagtgacacgtcctcagagcaaagccaggtgcaggggtgagggcctgggcgggtgcaggtttctagcatgaaaacctccaaaatagttctagaaaaaaacactctggccaggcgccgtgcctcacgcccataatcccagcactttgagaggccgaggcgggtggatcatgaagtcaggagatggagaccatcctgtccaacatggtgaaaccccgtctctactaaaaatacaaaaaaaattagctcagcctcccaaagtgctaggattacaggcgtgagccactgcgcccagctggattttggccattctaatagctgtgctgtgatatctcgttgttgttttaatttgcatttccctaatgacatatgatgtacagcatcttttcatttgcctgttggtcttctgtgtaccttctttggtgaggcatctgtcaatgactattttttaatcagattgttttcttattgctgagttttaagagttctttgtagattttggatagcagtgctttatcaaagatatcgtttacaaatattttcttctagtgtgtggcttctctttttattctcttgaaagtgtctatcaaagagcagcaatgtttaatttaatgaaatccagcttatctgttctttctttcatggattgtgccttgggtgtcgtatttaaaaagtcattgccaaacccaaggtcatctagatgttctcctgtattatcttctaggagttttatagctttgcattttacatttagctctgggatccaatttgagttaatttttgtgaagggtgtaagatctgtgtctagattttttttttttttttttttgcatgtggatgtcaaggttttccagcactgtttgttgaaaagacttcttttttatttttatctttgtttttgttttgtaattgatttgttggagaaaccaggttctagaagacagaggtcagcaatctttgctgtaaaggaccaaaaagtaaacattttaggctttaagagagccatatggtcttgtcatgactactcaactctgtttatagtgccaaagcagccatatgtaaacaggcactaagtaaacagatgggcatgtctgtgttctaataaaactttatttacacagacaggcagcaggccatagtttgttgatcctgctatggaatattcaacactctggattggcctggctgctgtctcacagtgttgttaacctgttcttctatcctctgtatttataattcaatttcagtaactgctaattagattcatgttcaattgttttggcacaaatacttcacaggcagtgatctctgcttcctaaagcaccacattctgaagcaaagaatgtctgcttgccataggctatttcttttttttctttttttttatgagatggagtctcgctctgtcacccaggctggagtgcagtggcaccatctcggcacactgcaagctctgcctcccgggttcacgccattctcctgcctcagcctcccgagtagctgggactacaggctcccgccaccacgcccggctaattttttgtatttttagtagggacagggtttcaccgtgttagcaggatggtctcaatctcctgacctcatgatccgccagcctcggcctcccaaagtgctaggattacaggcatgagccaccgcgcccggcccccataggctatttcttacatgggaattactctctgcaactaaatttgcttttaagtaaaattctgcccatcctgtgagtgctggcaagtcctttctaaataaagggatgaattgaaggtgattactgttgttgatttgtaaataggtattaaaagacttaaaaattaactcaacgatttcactgctgagaatttgtccttgaggaaatgatttggaatggttgtaaacattttgccataaggaccacagctttaactataatattagaaaccaaggagctaaactggatgtccaacattatgggatcggttaaattacaaaacagctgtactgacacatgtgcatccaataaaaaatcatggtgtggaaatatcacatcaaaaagagtttatgatatttttattgagtcaaaaagcagctttaaaaacaggatgactggtcaggcgtggtggctcaagcctgtaatcccagcactttgggcggcagaggcaggcggatcacctgaggtcaggagttcgagaccagcttggccaacatggcaaagccccgtctctactaaaaataccgaaaaaaaaaaaaaaaaaaaaaaaaaaaaaaaaaaaggcccagcatggtggtgcaggcctgtaatcccagctaccagggaggctgaggcaggagaattgcttgaacccgggaggcggaggttgcagtgagccaagatcgcaccactgcactccagcctgggcaacagagtgagattctgtctcaaaataaaataaaataaaatataaaaataggatggctgaatagattgctgtataccattcatgtaaatatactgtatcatttaaaatatgtaacaaaggctaactgttactgaccgcttgccgtggttcaggcacttctctattttatattagcttgcacaatcctcacagcagtgctatgaggtgggtggtgttagtttcctcatattacaggtgaggcaactgaggcctagcaaggttaaataaactcacccaaggccaggcgtggtggctcacacctgtaatcccagcactttgggaggctgaggcaggtggatcacttgaggtcaggagttagagaccagcctgaccaacatggtgaaaccccatctctactaaaaatacaaaattagtcgggcgtggtggtgctcgcctatagtcctagcaactcgggaggctgagccacgaaaatcacttgaacctgggaggtggaggttgcagtgagtcaagaccgcaccacggcactccagcctgggcgacagagccagactctgtctaaaataaataaattcattaataaattagctcacccaagatcacaaagctggaaagtagcaaagccagcatttggcctgagagtctgactcctgaatgcagcagtgctgcagtgcactgcctatccgggcggggaagaagggtctggaagatatgcacacattcaaatgttaatcgtggttccctagtatcagaaaacttctgagtgttcattcactggtcccatcctggtatacaaggcttacccgaacttattactcttctgttggttctgcttctgttttatggggggctctttgtgtgtttttgagatggagttttgctgtgtcgcccaggctggagtgcagtggcaccatctcggctccccgcaacctccacttcccgggttcaagtgattctcctgcctcagcctcaagagtagctgggattacaggcactggccaccacgcccggcaaatttctgtatttttagtagagacagggttttgccatgttggccagactggtctcaaactcctgacctcaggtgatacacccacctcggcctcccaaagtgctgggattaccggtgtgagccatgcacccagcctggttctgcttttgaaacttaggttaaaaatattacagattcactctccctagttatctgacattatgtaaacccagatagtcctgggagccagcagctcaggcccccaccctgtaccccagctgaacggggctatttgcaaagcatctcagccaccaccgggttcctcacacttgtactgagaaccaaggccaacctcgcctggggtcattgtgtggcatcctgccctccagggctggcactccctgtatgttgatgacaatgataatggttctatttcctcaagaacaaattcagagaagatattttttattgtcaagcactgatgcgtgtgtaatttctcaagccccatttgtattgactgaccgaagctaaagggatttttttggacactatagtcaatttgtcacactgatgcattgatataatgattcccctcataaaactaattcagaaatgtgactatgaggaaacttgcattccttttttcagctgtaatctttcagcctcttcagaagaatacctttcactggctgttttgcaagcgcttctggccagaagcaacaacgctttgacccaacctgaactgaaggtgtaacgaccaataatgactgaatgcgttcgctctcccactctcctgcaccctccccgcaggaacgatgggcttccagactgcttggccttcaacagtgtcccgctccccgatcccagtgtcctgcctggctgttgcctgcagttgtcctctgcccagctttggagctattttctcgggacaagcttcaggctaggcccactcccaaggtaccttcctctccctctgtacttacgggttcttcttacttttaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggtaagggcagccctcccaggccccggcagaggcggtccaggcaatagcaactggcatgctcagagccagccgagtccctttttcagatccccaggccacgtgtgacctgaactgttcagctttgctcaggacatacccccagcatccttccaggcctttctctcagctctgttaggccctccgtcaagagcaggggggtgtgaggatggctttagcaggagggctctggttccagagagaaaaatctccaggtagatggcccgaaggccacattttacgtctaagcatgcggtatcatggaagctcaaggcctacacaacctgtgtccacagcgcccccgtcacctgcctgcagaccacatagggatgcctgaccacgtgtctcttttccaggcaactgccccacgcgcccgagcacccagtggccactctcagcaccgtggaaaggcgagccatcaacctgacgtggaccaagccctttgatggcaacagccccctgatccgctacattctggagatgtcggagaacagtaagcttcccgtggtcacctccaacacctcccgcccaagcttggacttaggagtcagccctgggctggggtcccagctctcctgcttcctagttctgggcctttgagcagatccttccctctggcagcctcagcgttcccatctctgaaggaaacacaggcatctgcctgtcaggccctgttacagttgaaagagatgactcacaaaaggtgcttaactcagggcctggcacagcagaagccgcaaagaaaatggccagtatttatttattatttatttatttatgtattccccaagtcaaatgagcaggcataattcgcgttgcattttatttatttattatctatttatttatttatttatttattcatttttgagacggagtttcacacttgtcacccaggctggagtgcaatggtgccatctcggctcactgcaacctctgcctcccgggttcaggtgattctcctgtctcagcctccgaagtagttgggattacaggcatacatcaccatgcccagctaattttgtatttttagtagagatgggatttcaccatattggtcaggctggtctcaaacccctgacctcaggtgatctgcccgcctcagcctcccaaagtgctgggattacagacatgagccaccacacccagcctgaatggcattttaaacacagcttgcctagagctcatcaatttgtggggggtagtgggggagacaaatgcatctcagttcccataagcccttactttcctccggcaccctccaccgtctcctccccagggtcgtgtgagctaatgggacctagaaaaatggcatggcgggccactcctgcaccaagctggggaggctctctcttgccagccccagtgaagctggaccctgctgggagtggggagtaagaagcatgcttcatcccacccaagatgcccacttctgccccactcactgtccctgcagatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagaggtgagggcactggcgctctacaggggcgtcgccaggactccaacaggcaggggctgcagccgaaaccgatgtggcagattctggctcagctcctcctggccccctctaggcttccgcctctgtagaaggggagagcaatcctgatgagtgcctcaccaggatgttgcaaaggttaaatggggtgctctgagtagggcactggggaacgcggtgagcaccaaccaaatgtagtcatcccagttactgggagctgtgcaagcaaaaaggctcacctccttccactccacatccgcatgggctgctgtcattgttaaatggatgcaaaattccagagatacaggatctacacagatctccatatccatgtcttgcacgacgccaggccctgctagggttcccgcaaagcttttataaaatgatggaaattgctgggcacggtggctcacacctgtaatcccagcacgtcaggaggctgaggcgggcggatcacctgaggtcaggagttcgaaaccagcctggccaacatagcaaaacccagtctctactaaaatatgaaaattagctgggtgtggtgggcgcctgtaatcccagctactcgggaggctgaggcacaataatcccttgaatcagggaggcaaaggttgcagtgagtcgagatccagcctggatgacagagcaagactgtctcaaaaaaaaaaaaaaaaaaaaaaagatggaaattgaataaaagctacagatgcttcatataaaaacatcacacggtgatacccatctatgtagaaggagaattctatcctctccagctccgtagaacaagcagccacctctagcaagaaagatgtcatgggagaggtcagaacaaccgtgatacaaatcacgtgcgcaaagccttgcacttggctctttgaaagacgcctggggcttaaatcaatcatggtggttttgccacagttgcaatgagcttgggtctctctggcttgtactaaggtagcaccactggggtcaaacaatctcacgggagggagcagtggcaggtggcagcccgtgtggagagcagttacagggggatttacatactcactgtttactgagcagctaccgtgtgccatgccacgtttggaccactggagggaggacagggaatgaacagacatagccccagtgcatctggagatacacaatcccaacaacagagaggctgaaagtgtaggggaagctaccctgcaacttctcctgccctgcggctgcaccgcatcacactgactcaccttcctaatgtaccttcatgcaaaccgccctgagtcaccaagaaaaaggccaaatcctcacgcttgtaatcccagcactttgggaggctgaggggggcggatcacttgaggtcaggagttcgagaccagcctggccaacatggtgaaaccccatctctactaaaaatacaaaaattagccaggcatggcggcacgtgcctgtaatcccagctattcaggaggctgagacaggagaattgcttgaacccgggagacggaggttgcagtgaggtgaaatcgtgccaccgcactccagcctgggggacaagagtgaaatctttcctcaaaaacaaaaaagaaaaaggccaaatcacccttaccccagcctctacaaaaacacaggagcgggccaggtgcagtggctcatgcctgtaatcccagcactttgggaggcagaggcaggtggatcacctaaggtcaggagttcaaaaccagcctggccaacatgatgaaaccccgtctctactaaaaatataaaaattagccagccctggtggcaggcacccataatcccgctactcttgaggctgaggcaggagaattgcttgaacccgggaggcagaggttgcagtgaggtgagatcatgccactgcattccagcctgggcgaaagagcaaaactctctcaaataaaacacgggagcgagcagcatgcttaggaaagctatccatcaaaaagcaaaaacataaacaaaaagggaaagtcatccatcaaaaataattaacttttgtttggagtggacacgtgtccgtgatgtgaaaagtacacttaggcagaacacagcgtcccccagcaatgccagagaaagacgtgctgtcgcgcttggctccccgaggcagggtgggtgtccttggctctctccctcacacgccatgcccgccctgctcctgcctggggctcagctggccagcaaaggaggcctagttaaggtacaccagcagctgaccagtgggatgtgaccaacatttctgcttatagaacacttggacactcatgacctcatcagccccaacagcagcttccttgacaaataggaaactgaaacttacatccctcaacggcaccaaaaacatgtacattaattttttttttttttttgagacagggtctctgtttcccaggctgtagttccgtgatgcaaacacagctcactgcagcctcaacctcctgggctcaagccatcctcccacctcagtctcccaggtatttgggattacaggtgcaagtcaccaggcgggagtttttttgggttttttttttttttttttttggtagagacagggtcttgccatgttgcccaggctggttttgaactctggccctcaagcaatcctcttgcctcagcctcccaaagtgctgggattacaggcatgagccacagcatctggccttatagtttttaaaagacatatacatatatccacatatacacagagactatatatgtagtatcatttgagcctcaactagtctcataaggcaggcaagtagagctttattataattcttttatagaacaagctcagagaagtcaggtaacttgcccagatgcacacagcagttgtaccgaattatccagagtcagagcaggccagggttcagccttctcatatcccattcaactcctgtgtttgaccccaagactaagagcattggtgttttgtgatccagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtgggtgtccaccctggggacaggagcccagtcccaaggggaaaggcatgggggaagattgggagtggactggaaaacagtgcaaattcatggcaggcccttcgccatctaggaaggactaggtaacaagaaatgcctactcagtagtaggaaggatttaggttggacacctggtagaacttccagtggcaagacccctggacaccagcgaggaatgcttgagaggggaggctatatgggctgacataggaacaggcctacaaggagacaggagaagaaagaagtaactttccaaggggcaacgctctgggaagccgcgaatattccatcacaggccagaattctcttgacccgtgagtggagaaaccagctggccgaagaattgatggaaaagtgaaagttctttctttggttattactggaaatgaagcccagttatacagacccttatctttgcatttgactgagggactactcttctagtaacctaaatgggagtcattaagggtcactaaaatgtggtattcataagttcaaattcataagttatctgaggttactgagaactctcattgatattctagattctggctacaaaatgctatgcaacttcgtgtgtctcattcctgcatgtacacaccctcacaggggtttaactgctccactattggttaattttgttgtgggtttttcactaatcctgaagggcggtggttctcaaagtgtggtcccagcacccatagcatcagcctaacctgagaactggtcagaaatgcaaattatcaagtctctccaagacctaccaaaccagaaactttaaggataggcttagaaacctttgcttttaaaaaaatctttcaggccgggcgtggtgtttcacgcctgtaatcccagcaatttgggaggccaaggcgggtggatcacggggtcaggagattgagacaatcctggccaatatggtgaaaccccatcttcactaaaaatacaaaaattacctgggcatggtggcacacacccgtagtcccagctactcaggaggctgaggcaggagaatcacttgaacccaggaggcagaggttgcagtgagccaagatcgcaccactgcactccagcctgggcgagactccatctaaaaacaaaaaaaaaaaaaaaaaactcatctaggagactttgatgcatcttcaggtttagagaagcagtgttttagggcattgtaatgcatcagaatactttgaggtccttaattttccaataattagatgctgaattatatatgcatcgtgtttctcaaatgaatgacccatcctttgtgtctgacccccaaaatttgcttgtacacatttacttctttagtgctgtgagttctttttgccagtggaggtagaaatgggtcgagtaggtagcccaggtgtttcattccacctgggcgagtaactttcagaagagggagccttgtatcctagaggaggaaagaaaatgagcccaggcttcagggacagctctccagtccatgacccctccaaggctgagacctgcaagttctgccctgggacctctcagtgcccctggttagcaatcctcccccatcaaatagaatagtccagacacatcccctagacctctgctacccagtaaggtaaccattagctagctctggttacttaaattacagttgacccttgaacagtgtgggggctaggggtgctcaccccctcacggttgataatccatgtataatttattttcttttttttttttttgagacagggtctcactccattgcccaggctggagtgcagtggcgtactctcagctcactgcaacctccacctcctgggctcaagtgatcctcctgcctcaaactcccgagtagctgggactacaggcatgtgccaccannnnnnnnnnnnnnnnnnnnagaggatcccctagtagagaaagatttatctttttagccaggctggtctcgaacacctgaactcaagaaaaccacctgcctggacctcccaaagcactgggattataggtacgagccaccatacccggcccaatccacatataatttttgactccccaaaaacttaaatactaatagcctactgctagccagaagccacacctataaccagtcgattaacacgtatatttttatgcatttatgatataactttttcttaattttttcaatgtttctaggccatgtgattcatctgcgagttttttcaaattgtcacaaatctctaaaactttttctgatatgtttatttttaaaactctgtgtagctgggcatggtggctcacgcctataatcccagcactttgggaggctgaggcaggtggatcacgaggtcaggagttcgagaccagcctggccagcatagtgaaaccccatctctactaaaaatacaaaaaataagccaggcatgggagcgcatgcctgtagtcccagctacttgggaggctgaggcaggagaattgcttgaacctggcaggtggaggttgcagtgagccaagatcatgccatagcactccagcctgggtgaaagagcgagactccatctaaaaaaataaaataaaataatagttctgtgtgtacgccaacctgtacagttccaacctgtgttgttcaagggtcaactataagcaaaactaaaacaaattctaattcaggccaggtatagtggctcatgctataatcccagcactttgggaggctgaagtgaggtaggcagatcacctgaggtcaggagttcgagaccatcctggccaacatggtgaaaccctgtctctactaaaaatacaaaaattagccagtgtggtggcacatgcctgtaatcccagctactcagggaggctgaggcaggagaatcacttgaatctgggaggcagaggttgcagtgagccgagattgcgccactgcgctccagcctgggtgacagaacaagactccgtctcaaaaaaaaaaaaaaaaaaaaaaattgaattcatttcttcggttgcactaaccacatttcaagtgctcagcagctgcatgtgctggcgggcaccctgtcggacagcacaggtgcagagcacttccgccaccaccggaagtcctattggacagcgctgctctggacaatttcctgggtacgaggccaaggaagctgactctgactccactgtgcctcgcctcttcccctcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggaggtaggtagagactgtggtctcagaccaggcgcggtggctcatgcgtgtaatcctagcactttgggacgccaagacgggaggattgctcaagcccaggagttttaagccagcctgggcaacatagggagactccatctctacaaaaagtgaaaaaaattatctgggtgtggtggcatgctacatgctacagtggcacagctactcaggaggctatggcaggtggatcgcttgggcccaggagtttgaggctaacctaggcaacatagtgagaccctgtctctacaaaaaatgaacagaactagctcggtgtggtggtacatgcctgtggtcccagctactcgggaggtccccaaggctggagcctggggaagttaaggctgcaatgagctgagatcgtgccactgcacttcagcctaggtgacaaagtgagactctgtctcaaaaaaaaaaaaaaaaaaaaagtgaaatgaaatgaaaagagactatggcctcagaggagcaggtgcttccccttctcccagtcccatgcctgttgggttctgtgcctgtccaggcccgagagccttggctgtgtggcctgttctcaccaggcccctactattgcaccctggggctggaatcaccaccccaggccaatctaccccacagggtgggaggactgaggggaagaggaagaggaggctggcttggacatggtgaagggcagaggctccaggcatatggggaccttctgtgaatttcatgttaagtagatcatgaaacagcttacttttagcattccacctgaaaaccatgccagagcatttttcatccgcacccctcttatttaccagtaccctgtgaggtgggtcaggcaagtttttttaaacgcaaactaatccagagagaatatgaaggcctcttaagtctacacagcgagggaggagttggggtggggtaggggggtgcaaggcagaggctatagcccccacccctgcgttttctctactgaactgggcaagagagactgactgggccccctccaccccaccccgttctctcatctcctctagttcccacggtccctccgggcaatgtgcacgcggaagccaccaattccacgaccatccgcttcacctggaacgcccccagcccccagttcatcaacggcatcaaccagggctacaaggtacatgaggcatctcctcacccaagaggaggccctaagatcttctggagggggtggggagaggggacagagtgggcaggaggaaatcccccctctgtttctgaagtcattggctcgagtcaagctagggacacacattagaggaaaagagttccaggccttccccaaggctacatgtgggccacaggaagtgcagacactgccctgactgacactcagtgctacggtccttcccagcgagactgggttatacacaaaacccaggttatttcaggctcagaaacacctggtgtaggggccgggcacagtggctcacatctgtaatccccaatttgggaggctgaggcgggcagctcacctgaggtcagaagttcaagaccagcctggccaacatggtgaaactccgtctctactaaaaatagaaaaattagctgggcttggtggcaggggcgcctgtaatcccagctactcgggaggctgaggcaggagaatcacttgaacctgggaggcggaggttgcagtgagccgagattgcagccattgcactacaccctgggccacagaatgaaactctgtcccaaaaaaaaaaaaagaagagagagagaaaaaaaagaaaaagaaacacctggtatagccatggccccatgagaaaaatccaccattcacttcttaccgtggctcttgtgggcttcatgctcaaacgtatccccaggctgtactcgactccacgtagtgtgtggttaatggcacaggattaggactcagacagacttggtggttaaagtcccagctttgcctcttgctggcaacctgcgcatgttctttaatatgtctcagcttctgtccttcaatcaatatttattgagcagctactctatgcactgctcgcaccgctgaataactaaaataaactcagttttctcatttgcaaatgaagatgataatacctgcttcttggagttgtgtgaggattaagtgagataatatttctaatttgttcagcacaatgacaaacacatgataaccacttggaaagtgattttagtggtcgtagaaatgcatttgggctgctataaccaagtaccacagactggattgcttaaagcaacagtccccaaactttttggcaccagggaccagtttcatggaagacaatttttccatggattggagtgggaggagggatggtttcgggatgattcaagcacatgacattattgtgcactttatttctgttactatcacattgtagtatataatgaaataactatacaactcaccacaatgtagaatccatgggagccctgagcttgttttcctgcaactagatggtccgatctgggggtgatgggagacagtgacagatcatcaggcattagattctcataaggagtatgcaacctagatccctcacatccacagttcacagcagggttcacgctcctgtgagaatcgaatgctgccactgatgggaggtggagtttaggtggtaatgtgagcactggggagcagctgtaagtacagatgaagcttcactttcttgcctgccgctcacctcctgctgtgcagcctggttcctaacagaccacagactggtacctggtggtccgtgggggattggggaaccctggcttaaacaacagaaatttatttttgcacagttctggggattagaagtacgggattactgtgtgggcagggttggtttcctctgaggcctctctccttgacttctaggtgtctgtcttcactctgtatctgtgtccaaagagatcttggctcactgcaacctccacctcccgtgttcaagcaattctcttgcctcagcctcccgagtagctggggactgtaggcatgtgccaccatgtctggctaatttttttgtattttcaatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgaaatcccatctctactaaaaatatatatatatacacacatatatatatacacacacacacatatatatatgtatatgtatatgttccaggatatatgtatatatgtatatgtgtatatgcatatacatatatgtatatgtgtgtatgtgcatatacatatatgtgtatatatacatatatacgtatatatacatatacatatatacatatacacatacacatatatacgtatacatatatacgtatatatacatatacatatatacatatatatacgtatatctacatatatatgtgtatatatatatatacgtagatatatatatacatatatatatatacacaaacacacaaaaattaactgggcatggtggcgcatgcctgtagtcccagctactcgggagactgaggcaggggaattgcttgaacctggaaggcggaagttgcagtgagctgagattctgccactacactccagcgagactctgaccaaaaaaaaaaaaaatagcagtaataatagtagtagtagtacatttgctctccttccaactgagctaaaggtcaggacttctcagtcctcccatcctggaacacagacctcagagcccaggcccggttctctcgtgtcattccacgtgggccccgtgcctgtcctccccacggaggactaaagacagagcacagcatgggggatccacactatgttttaaaggggtaggacctgcccccagcaacgtggggcagacggaaggatgccgtccactccctccagatgtgggaggggaggcagagcatttgaggggaggccagctgtgaagcggagagcactgcaggccctgagcttcagtccagggaacgcatgacctcgaggtgaccactgacacatcccgaaggttcctgcacccctctgcactgtgcttgccacaactaagattaattctaggactcgctgccttagcggttcttcctccaaagtgggggaggctggacaagaagggactgggatgaaataatgaagaggagtttctgctagtgttgcaagcaaacaaaggagggatggtccagaactggaaatgacccagcttcactccggccttggccctctcaatcccaggaaggcagtgaacccaaggtcgagcagagctttgcagggcagggagcagcagctgaattcttggagcactcgctgccggaaaactctcctaattgggaccctggggggaggcagaggaaggaaggggaggccggcattgctgaagagcagaggagctgaactgggaacaattagcttcttgctaccaattctaagcacaagttttattctacatatgggagggctgagctacaaacttttaaggcaaacagctcccccgagggccaggaaggccagcccatggccaggacaattagggcagtggcccatggtgacccagagcaagaggaggtggcagaggccactgaattcccaggtccagtcagtgcccagcccccagtagctactcgataaaggtcagcaggagtgaattgcccagatgttttgagcacagaaactggtggaggagtaaggagacctcacacttacagggccctttctctgggccaggcagtacactaaatgcttcgctcacatttatctttcatgcaagcagcacagggactctaagaagcagcattatcggccaggggtggtggctcatgcctggaatcctagcactttgggaggtcgaggcaggagatcacttgaggtctagagtttgaaaacagcctggccaatatggtgaaacctcgtctctactgaaaatacaaaaattagccaggtgtggtgacacacatctctaatcccagctacagacataggaggccgaggcaggagaatcgcttgaacccaggaggcggacgttgcagtgagctgagatcacgccacttcgctccagtcagggagacagagctagactctgtctcaaaacaaacaaacaaacaaaaacaaaaacaaaaaggaatattatcatcacaccattttacagagaaagaaactgaggcaccagagggaagttacttgttcaaggtcaaacacagtgtcaaggtcatgcaaagctcagattcaaaccagagccttcacttttccttacattaaaaagaaatgtcaggctgggcaccgtggctcacgcctggaatcgcaacactttgggaggccaagacagggggatctcttgagcccaggagtttgagaccagcctgggcaatatggcaagactccatctttacacacacaaaaaagttagtcaggtgtggtgttgagtgcctgtgatcacagctactcaggaggctaagacggggaggattgtttgagaccacgattcaaggctacagtgagctgaaatcacgtcactgcactccagcccgagtgacagagtgagaccctgtgtcaaaaaaagaaagagagagagagacagagacagacagacagacacagagagagagagagaatgtattatttttaattgtagataacattttcaataccaatgaataaaagcagcagagatttttttcctctgcttctttagccttcagcatatcacaaggagaaaaaagcagtgtttgtcccttgtatacctccaataagaatgagcatttttccccttttgtgttttttttttcttccttttttttgagatggagttttgctcttattgcccgggctggaatgcaatggcgcaatctcagctcaccgcaacctctgcctcccgggttcaagcgattcttgtgcctcagcctcccaagtagctgggattacaggggcatgtgccaccatgctcagctaatttttttttttttaagacagagtcttgctcggtcacccaggttggatcttggctcactgcaacctccacctcctgggctcaagtgattctcctacctcagcctcccgagtagctggaactacaggcatatgccaccatgcccggctcatttttgtatttttagtagacatggggtttcaccacgttgaccaggctggtctcaaactcctgacctcaaatgatccacccaccttggcctcccaaagtgctggcattataggcgtgagccaccacacccggctgcccccttttaattgtgaaaattttcaaacatccacccaagtagaggaaagactgcagtgaacacctgtatccccattcccagctttaacaatgcccaactcccagccaggtatgttccatctctgccccaaccctctgcctttcccttggaacattttgaagcaaattccaggcattgtatcagttcatccatgaatgtttctggaaagaaacagtatagatgagatctctatttaaaataaaaccacagtaaccgcattatcattatgatagctaaaaatatcagcaggccctgtaatatcatcagatatccagtcagccttcaaattctcttgattgccgcataatctgttactcgtggttttatttgcttcaggatctaaatgaagttcacacaattgcagtcagttgaggggttttttttaggtctcagtcgatctatagattctttctctctctctctttctctctccctttctctttcttgtaatttatttgggaagaaacttagtcatttgtccaacagaattttccacagtctggatttcgctgattgcatccctgtggggtcattcaatgcattcctccaaacaatatagttacaatgaattgtaacttaaagctagaggctaatctgattcaggtttgattttttgttatttgaaatattttacttcggggtgtgatggctcacgcctgtaatcccaacactttgggaggccaaggcaggtggatcacgaggtcaggagatcgagaccatcctggctaacacggtgaaaccccgtctctactaaaaatataaaaaaaaaaaatagccaggcgcagtggcaggcacctgtagtcccagctactcgggaggctgaggcaggagaatggcgtgaacccgggaggcagaggttgccgtgagctgagatcacaccactgcactccagcctgggtgacagagcgagactccatctcaaaaaaaaaaaaaaaaattagccaggtgtagtggtacatgcctgtaatctcagctactcgggaggctgaggcagaagaattgcttgaattcttgaggcaggggttgcagtgagcagagatcacaccattgtactccagtctaggcaacagagccagactctgtctcaaaaaaaaaaaaaaaaaaaaaaggaaatattttacttcctagatggtgttatgtattttgatcagaaagcacaaagtccggctgtctctcttactgtgaagtcaaccactgacagtcatctatgagctatcatttcaataagggttataatatggggataggcaaatattatcatttcttcttgacttagtagctgaaatgctttcaaaaacaagaattttccctttatcaactttttggttacctgaagtttcagtttatctaggaaaagcagggtaagcatttaattattttcccttacttaccaaatttttcgtacaatgaattggttctggccaggcatggtgtatcacacctgtaatcccaacactttgggaggatgaggcagaggcttgcttgaggccaggagttcaagaccagcctaggcaatatagtgagactcccccgcccccgccatctctatttctaaaaaacagaaaaaataaagactaaattgattccttattgtcttatcaggtaacagatgagcttgggttggagggggacgtctttctgttttgttttgggtttggtagtattattagataaccaaggattttttttgttttgttttttgttttacaaatctgacatgtttcaatccattaccattattatgcttcttaaatggtactgggtgctgccagttcagtggtacaaatggacccatcattggcctcttcgacttgatggtgagccctcttgacgtggccccagtagtctctgatagcttccttgcaatttggtatgacaagatgttccagactattatatatacattcccctcactgtgccaggcatcggccatttctttaaggggctcttgttgctttcagtgagaaatgatagttagataccacagttttagcacttgcattgcatttattccagaaatggttgttgtttctaggccctgttaatggctagctaaacaatattttttaagatactatagatactcacactttcaattccatttcatgatgacagactctttaataatctcattggtcttttgtccatactgaaaatccagttcctacaataccagcattttacccacctacgttattcccacaaacacacacaacactttcagaatagtcatatccacactatgattactgaacgtagtttccaattattgccattcttcttgttcctgaggtatatccctctagggatggacttcgcactgcattgctaagtcttttgaagtcatttctctctgtaattttaccacagctcaatactctattagttcatttgcttcattgtggttttgatttttagggattgattttttaatttaattttattctataattacgttgaatatttacataataaagtcaaatccacaaagcaaattcagagaaaatcagcttcaatccttgtcctctcactcccctataggtctgattgttttctgttttcttggtttggttttttcttccatttttttaatataaacaagtacaggccaggcgcggtggctcacgcctgtaattccagcactttggaaggccgaggcgggcagatcatttgagatcaggagttcaagaccaccatggccaacatagtgaaatcccatctccattaaaaatacaaaaaaaaaaattagctgggcgtgatggcaggtgcctataatcccagctattcaggaggctgaggcaagagaatcgtttgaactggggaggcagagattgcagtgagcggagatctcgccactgcaccctagcctaggcaacagagcgagactccatctcaaaaaaaaaaaaaaagagtgtagtaggcccttcttagccatggattccacatctgtggattcagccaatctcataaggttctgaaaatattcagacaaaaatgcatctatattaaacatgcacagagttttttgtcattattcccccaaacaatacagtataacaactatttacatagcatttatattgtgttatgtattacaataatctaaaggtgatttaagatatataagaggaggggccgggcacggtggctcatgcctgtaatcccagcacttcggaaggccgaggcaggtggatcacctgaggtcaggagttcgagaccagcctggctaacatggtgaaaccccgtttctactaaaattacaaaaaattagctgggcgtggtagtgtgcgccgttaatcccagcaactcaggaggctgaggcaggagaatggcgtgaacccgggaggcggaggttgcagtgagctaagatggtgccattgcactccagcttaggcaacaagagtgaaaactccatttcaaaaaaaaaaaaaaaaagaagaggctcttaaactgacccctctcctgctagtctgtttgggtgagtgtcccacacccacctgagtacccagtcctctggggtacccctgcctgctgccgtcttctactacgaatcagtcatggagtcccaggtgggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggctggagtgcagtgtcgcaatcttggctcgctgcaacctctgccttccagtttcaagcaattctcctgcctcggcctccagagtagctgggattacaggcgccagccaccatgtgcggctaatttttgtatttttagtagagacggggtttcacatgttagccaagctggtctcgaactcctgacctcgtgattcgcccacattggcctcccaaagtgctgggattacaggcgtgagccactgtgcccggtcccctatattattatcactatttagaatgtatattggaggtcagtccataaaagtatagagagacatcccttgttccttttgacacctgtatcctctgctatcatatggatctcccatagtttaatcaagcagcccccaggtgatgacattttggttgtttctagtcttactataactaccctttctgtggtgaatggttttgtgcatatatctttttttttttttttttctgagatggagtttcgctcttgttgcccaggctggagtacagcagcgtgatctcggctcactgcaacctccacctccaggttcaagcaattctcctgcctcagcctcccaggtagctaggattataggcacccgccaccacgcctggctaattttttgtatttttagtagagacggggtttcatcatgttggctaggctgtcctcgaactcctaacctcaggtgaccacccaccctggcctcccaaagtgctgggattataggcatgagccaccgcactcgacctctttttttgttttcacagtataactttggactagattcctagaaatgagattgttgagtcaaagggaaaatgtgtaaatacttttgctacaattgccaaatacccctcattcaatttatttcttgatcttttaatttttaaacctaaaatatgtgattcaaaaaaccaaaataaagtaaaaaatagtaaacatatagtggaaggcctccatcccaccctagtctcccacctgcctggttgtgctgtgcccaactccaaaactctcctcactccaggtggccaccgttgttggtttctcacatctccttccaagttgttttttgggagtctgtgcgtgtgcaaagagatagagggagagagacagagagacaggatttctccgactttttctttttttttcttttttttttttgaggcagagtctcactctgtcacccaggctggagtgcagtggcgccatctcggctcactgcaacctccacctcccaggttcaagcaattctcctgcttcacctcgcaagtagctgggattacaggcatgcgccaccacccctggctaatttttgtattattagcagagacagggtttcaccatgttggccaggctggtctcaaactcctgacctcaggtaatccacccgccttggcctccccaattgctgggattacaggcgtaagccaccacgcccagcctaacttttattttctaactttagtagctagatgccatatacatcatcctacaccttcaaccctgtagagtactgcctccaccagggacaggagacatttcacctgctcctccctgaaacccagcaaggcagctgtttctatcccctagaatagcctgaggctcagagtggtcaagtgactttccgtgagtcccacagtaagtgacagagctgggttcaggttcaagtgtgccagctgcaaggctgccctcccccgacaccctccatcagcagcactgctgctcagttacaaggcttgcctccctgggcctctgctctctaagggggaatttcatatcccaggaactcaggtctaatgctcgttccccagaacacacccgagccttctcaggggagccccgtctacttagaacctgagactaaggacctagtatggtaaatcaacactgaaactgactaacaaggagaaggcacagagatgtcctaaagaacactcatctcagcagctctgtgtacctttgagagacagaggtcatcatgaaaggtctcagggtccacaaactgagccagctcttagtaggtccatgtgcaagctccttaaccttcctgaacctcagtttccttttctgtaatagcataggacaatgatttccatctgctcctcatcgtgatgattaaataaggccaggcacacggtaagagttcaacaggtggaagccctgttgtgtgttgagctgagcactgaagttccatcccacggctgcccagagcccaatccctttagggcaatgaaggacacaaaaggcaattttactgtctctctccctggacctgaggcagggaggcctcctatccccaagcctcctcctctccacgtgcagctggagaaggacaagtggctcacatcccagagtaaatattttgaaacagccacaggaacccatgaccctgctgccatcttggatccaggcgtcaagctgtaggataatgaagtcaagagcgtgactccacaaaccacactgccattaccctgtgcacttcctctgggtcatttttgtgggtaaggcccggtgatattgttttaaggcacatgtaaagacaccctttttcctttatttaaaaaaaatggtagagcttataattggcctaagcccaggaaaataatatttacccagattttatacttgctggggaacacaccacacaattaattctaacagcataattaatttgaatgtacattaattaaattaaattaaaacattaaacttgtttcttaatctactccaaagaagttcggcaacataattgctatgaaacaagataatcgaaatacggaggatatttaacacacttattaaatgccacttagtatttctgtttagtattttgagggtctaattagtgtctaattaacttgctataggctatcttttcacaataccaattaaatttcaaaacatcctttataaatacacagccatgaaaaggagaagattaagcattgttataggcatgagttaaccgggagacattggcgtggtattgttttatatctataaatacccgtgcttattaaaactcatcaagtgttgcttttcaccattaattgctatttaatcaacttcaaataaatgaggaaatctctgaaaccagctgtcattattggagacagatgaagggcctagaaacaggagcgtgaggtgagagcaggaggcgagacaggcgggagggggcgggggccaggtgtgatctgcagagggcagatgagcaagaacttgagggatttccagatgggactttcttgccgatgccccgcctctacttgatatttaagatggaaatcccaacttagaaggagtgtaagaggataatagttacccacaaactgaagttcccagctctgtaggaagtaacccttggagagctccaaagacgaagctgccccagctcacatggggcaagatgtaggagctcagggcttggaatcccagaaccagcttccccctacctgtgtgagcctctttgagcctcagtttcctcatctgtaaaatacagggttgggctgggcacagcggctcatgcctgtaatcccagcactttgggaggccgaggcgggcggatcacttgagatcaggagttcgagaccagcctggccaacatggtgaaacccccatctctactaaaaatacaaaaattagccgggcatggtggtgcatgtctgtaatcccatctactctggaggctgagacaggagaatcacttgaacccgggaggcagaggttgcagtgagcctagatcttgccactgtactgcagcctgggcgacaaagtaagactctgtctcaaaaaataaaaataaataaataaataataaaataaaatacagggctgggccgagcatagtggcttacacctataatcccagcactttgggaggctgaggtgggaggactgctttagcccaggaggttgaggctgcagtgagctgtgatcatgccgctgtactccagcctggacagcatagtgagaccccatctcaaaaaaggaatacagggccggcttcatgggtgtgccacctgtgcagtcgtccagggccccacgtttggaaggaccccacacttagttaaatgctctgatgctatcatcttaaaattcttagtcgtttttgaacaagggctaaatttttcattttgcactgagcctgcaaattatgcagctgttcctggtgaaatgcctccctcctgggtctctgtgagaattgagtacgaggcgattcctgggaagcacccagcacggtgctttgcataaagtcagtggctcaagaagtggagaagcgccccaaagtgaaccccagtaccccgcaggttccctgcactgcctgtcccttccctcggaggaggcaccacagggactccggtccccggacaccatctgttgattggcccagcctgtgggagagggcttggcctcctctggaaccttcctgctgccctgtgtgacttgctcgcctctccgcagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatggtaggcaccccccagccctgctctttctgcccccccccgcccaaggccaggctgggcgccccaggcagaagggtggcccaggcttgtctcccaggctgagatacccccagattaccacaggctatctcacagatggtggtctctctctggctctaactggccttggggggtgggggttccttttggggtgcagtgcctgggcccgtgggacacctgagcttcagtgagatcctggacacatcgctgaaggtcagctggcaagagccgggagagaaaaatggcatcctcacaggtaggcactgcagtgtttctgaaccagagggcaggacagggctgggaaaggtcagagctggtccatcccctgcctttgagctacttttcacccaaactcttgaagccaacccatgctttcttagaaaccactcacaggaggctcttggcacctccacttcataacacatcccagagtctgcagccccacaccttctgccacagatctcagtggctgccatgatgactcactatgtcccctgcaattccctaaagtgctggcatcccactgaggcgacacctgagacccagggcatgatgccaacagctcccacctcccttggccccattgctcccagcgtggatctaattgccagcctagtggagaagtgagaagtggagtagtgggtcaggccaacttgtgatcacagccaagctcatgccaacatggcggctctccccagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccaggtaagtgcccactctcaaggcaggactctttgagttctcctgagcagcgtcccattcaagaggccccttgtcggctgggcgtggtggctcatgcctgtagtcccagcaccttgggaggctgaggcaggcgtatcacttgaggtcaggagttcgagaccagcctggccaacgtggtaaaaccctactaaaaatacaaaaattagccagctgtggtggtgcatgcttgtgatcccagttagttgggaggctgaggatggaagatcgcttgaacccaggaggtagaggttgcagcgagccgagatcacaccactgcactccagtctgggtgacagggccacatcgcgtctcaaaaaaaaaaataaaaagaggccccttgtctttcaggaataccagcgttcttcccacaggctctccccttcccttgtgctgtgtgggtctgggtcccctcagagcaggcggaatccctgggatcccaggtctctggacaggggctcccctggctccctgctgcatcctcccacagctctcagaaaagcagaggccccctgccttgtctcatttccccaccagtccctcccttcacccatttctcaccagattccacaccaggcaatggtatctgtgattcaggggaaaatttcccactgtcgcccagagggtccaccttggattccagcgtgtggaagggttggttgggaggtggcagagcacggtggggctactcctaggcctggcacagagagcaagccgaggtccactctcagctctgcttctgccaagccctacaaccttgagcaagttctgtgtcccctctgtgcctcagtttccccatctgtatatatgggaagttggaccagataaccatgtggtcccatccagatcagtcaggcagtgcttgtttgacctgccagcatccctccacctgctgcgtagatggctgggctgcctgagtctcagccaaagcccagtgataattacagccatgctggcaaataggtatgtagtgttcacggggcatggtgctgggagctttgctcacgttgactcatttaatcctcacaacaaccctgagggaggtgttgctattatcctcttcattaccaaggaggacatggaggcacagagagttggataacttgtgcaaagacacacagcctgtaagtagtggagttagatttaaactcattctgactccagaatctgtgttctttctgttgttcctgagctccaagagccccaggattcctggccggaaaataagcttccccctgtccccacccatcctctcaccttcctgagctgtaattaggcgtaggaggtgtgcaggggtctgggcggatggaagggaggatcggtcccgtttggtttctttctcagcacagcttggttttaatgcagctttcagctgccttatgattacctcactcacatccagaactgccaggaagaaggtggcatcccggcccctgtttcctggccctgagagcctcctctcagccctaggagatcccctttgacccccaactctgtctcagcctcctggcatgaacatggttctccgtaagacacaggaacaaagactgtgggtggagtggggccgtggctgtgcttctcctcagacatttccaggaaaagcgtgacacacagccccctccatgcccaacagtcccgttcaacatggggggccattctcaccggatctccttccccaccctgttctccttttccagaactcccagggccccccaccaacctgggcatttccaacatcggcccccgctctgtgaccttgcagttcaggccaggctacgatgggaaaacctccatctcccgctggctggtggaagcccaggtagggcaggcctggggcctgaccagcagcccccgccagggcaccccgtgcccttgagtgcaaaatcttatgtgtatttcggcctgtgtgaattttcatgtgcagctctcaatggcccattatactccaaatgctcacacttgccaatgttgtctccaactccccctgcccctcacctgtgtacatggaaaaacacacacacactacagtcccctcctgggtcggggggtgcctagaaaaatacccagttgctggaatataaaaatatccgccttggctgtaccctggaatcatcaggggagcgttcagaagcgccaacacctgtgcccctaccccagaaactctgattctgatttagctgatttgaggggcagcctgggtctctggaagtacccggggtgttcaagagaatcacctgggctgcttgttaaaagcacagattcctgggcagcactcgagggattctgtaagtagtggagttagatttaaactcattctgactccagaatccaggaatatattgatcacaagcatcctgagagattctaaggcaggagggttgagtcacacttgcagtcatgtttaggggcctggaaagatggtagccccatatggtgccctccagatgagccctgggttctgaaccaacttcttccctggcagggcttgtactggggctcggagcaccccgtgtgggccctgtaggctggacaggcctaagatcctgcccttttccaggtaggcgtggttggggagggagaggagtggttgctgatccaccagctctccaatgagcccgatgcccgctccatggaggtgcccgacctcaaccccttcacctgctacaggtaatgagactggcccggggagaaggcagcagcctcagggctgggggtgggtgggggctatggcccagaccaggacagggttgagagttgggtgagctgcccttaccatcttgctcatctctccccaaccccagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatggtaaggctccctcgagggcaggggtgggacctctccatgagcttctggtcattgcctcctagaaggtgcacatcagaattcctacagctcctttctcctctctttctgttttctgatgagatgcctgataatcaacatcttagcccaacgaacaaatgcccccccgcccgccgatgagaggaaggagctcaaaaatactgtttactgagcatcgccaagtggcaagcattttaaattttcatcccatttgattctcccaataatcttacaaaggatacatgatcatcccaatttacagctaagaaaactgaggctcagagaggttaagaacttgcccacagccacacagctcccaagcggcgggtctggggttcaagtgccactgtggcattcagagagtgtccccagatccgggctgtgtgttgagggtcctgaccgtgggccatcctgcacgaggtagtgacagtaacacaccgaggcttcctctcctaccaggcgctgttctgacaacaagcctgtgacagcagagtgatcctggtcccccttttgcagatgaggaaaccggggcagaagagaggtcagatcactcgcccaaggcctcccgtatcctcccacgtgctttcatgaacagcagggctgaggtcccaacccggggaatctttacccgcaagtccacagccctaaccatcgggcacactgccgtctcatcctctggagaacaggccacttctccccaccaggccctctggaacatcgtttcccagcacgtgtcccacagagcagcaatcccaggaggcgtgtggagcaaacaagaattcttagacaaataaatgtgggaacagcaccacataccacagctccatagagaatccaggaacactagcatagcaggagccctcttgaccctgcttccccaggcccatctgaccacacaaaccctttgtttccacgtaagatctcactcattgtgcaaaacacaacttgcaaacacaccacactgtgaagtcattattgccgttcctgtgcgcggacagcttgatgctagcggccatgaaagcgcttggcgccgtcagtcctcgataaatatgagttattgattgcagttcccttcccagagtggctggtgcctgagcagagctgcagagctgtctcggcccacctcagtgccccgtgcacagtgtgactatacccacctcctgcctctttgctcccaggcatccccaccccaggctggctccctgcttccttcctgaatctcactttaaggtttgcagctactaaaaggttagagcctgatgccgagggcagggactgcatgggggaatagaaaggcagctgccatgtggcacagggccctagacacttctcaggcccacgcttaatggtgcgtggtccattacctttcctcagcaggtaaaggaacttgcacttaagccccatctccggctctcaggaccatcgattgctatcttaatggtctttggtcggcttcactaagtgtctgcaggagggaggaagcgtgtagtgagcaggggaggttggggccgaaggtgaggagtggggtaaagtgggtcagcctagggtgagcctgtggaccaagggccctccagagcccctggggaagcagaactgggggaggtgagggctggagatgcccccaccccagctctgtgcccttcagagtagtggaggccaggccctgggctcccctccctgtgtgcacacctccactctcaccagcactgcccatggtcatccacacaaccttaagctggtgaccacagccccatcagcctagtcctaaggccccaaagaaatctgacttttcttttctgtgagactcaaacaagaaggaggaggctggttgggcgtggtggcttgtaatcccagcactttgggaggccgaggcgagcagatgacttgagctgaggagtttgagatcaacatggcgaaacctcgtctctacaaaacttagcaggcatagtggcacacgcctatagtcccagcaagagattgcttgagcccaggaggtagaggttgcagtgagctgagacagcaccatggcactgcagcctgagagacagagccagaccctgtcttaaaaaaaaaaaagaaaagaaaaaggaggctgaaaatgcagcaggagaggctgaggtttgctggacagaaggacttcctgactggcaggtgccccactcatcctgctctctgcccatgctcactcaaaggcaggcatgagctgagaccaggtgcggtaggcaattaagtgtgtgctggcagcctgagtgacagaggtaagcagcagagacagcagagccaaaggtggcggtgctatcggtgtgtcagacacacagcctttgtggctcctgactcccttggcagggtaatagatttgtcacatacacaataaagaaaggatgctgcttctctgtcctccctgcaggaagataagagcccatcagaaacacagtcacacaacctaagccacactcgggtgagagagcctcatgtggacactgaccgggtgacagtgggatggatagccctgaaggcgccctggaggagagggtagcagggcagttcctccctgcacagtggggggcctggctcatagcagctttgccacccctgccccgctgcagcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcaggtaccaacccctcacacccagccaccctgctgcctgtcccctccttggtctctatgccctcagggtcatccaagcgcgtgccaggctgaaggtgttgttcaaaaacagcctgagctcatttcctctgcttatgctcaatgtcacaatgatgttgccgcctctcccagcacctgccacttctctgcaactgtgcctgctattcccatattcccaaggggggcgggggtatccctgcctctggaggacagctgggtaggctccaccattcatactgcccactctcctgccctcagctttaaccctgaaacccagtggtgcctgaaagaccacagtggaggggtcgaggaaagggttagctctcaggacattccagaatcactaccggaagctcctgggggcctgcccaggggtgacccacagaatgtgagcccagcattcaggcaactctcatccatccacacatggttcactgctctgtggctttttcctggcaccctttaaatgacagacagctctcctgggccaccctggtccctctgccagccctctctgctgtgctagcaggaaatgcaagctcatctaatcctaacctgagcagagaatcctgtgaggaggctcatctgaaaccggaaacggcatctgcagcattccaaaaccaaaggccatcttagtgggattgtttgcagtttggggaccatgtgtgccacgtttcttccatagagaggcaacatcgagctggcccctccctcggccccctgtcctggtccacttcccttgcacagtcaacgttgggtcctgagtgccttctctccactccctttcccccacagttccctcttccggccccaccaatgtgtctgcactggccaccacctccagcagcatgctggtgcgctggagcgaggtccccgaggctgatcgcaacgggctcgtgctgggctataaggtgagtcccgggatcccaggaggtggggtccctacactggcccctccagcctctccatccaaggggccttgtccttatcaccctctaggtctctgcctcctagagtggatacaggggatctgcctggcgtcctagccaatggtcaccatggcaaccatgagtcatcccttgtgggtgaggaggcacccagaaaggacccagggcctagggctgctccatctctcccgggaggccacgctggatgcccccagcctcactcagctctgttggacccagttttgcttttcattatcttttagaattccttttaaagctgtgcctagccacatggtccagccctggtctggaagttgggagatgtgtgacacacagctgctcatcctggggatgagactcgggaaaagtgtagatgggtgagatgcaggcctgaggccctcaccctgtgctgggccctgacaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatggtgagtccgtatcccagcaagcttggggaaggctgggaggagccgcccttcctcctgcccatctggccttgcccttctggggtcaggctctgccccacagggagccatggcctcagatgcctccggtagggatgggtcacccagagctaccagccccactgcaggggatgctaattacagcctgtgtatccctgaggacaatgcggaggcagtttgacgtctgattcagtctcttggtctctctgcaaaacaagcatacagaatagggacttgcacccgttttaatttacttttctttttttttttttttttttttttgatagagtatcactctgtcacccaggctggagtgcagtggtgcgatcttggcccactacaacctccgcctcccaggttcaaaccattctcttgcctcagcctcctgagcagctgggattacaggcgctggccaccacacccagctgattgttgtatttttagtagagctggggtttcaccatgttggccaggctggtctcgaactcctgacctcaggcaatccacccacctcagcctcccaacatgctgcaattacagatgtgagccactgcacccggccagttttactttatttttcaactggagcaggttcactttgagtaaaggtctgtgaaagtatttttcctggacgcacgaacctcctggtcctgtttgcaaaagaatgtcaccagtgggctgcaggcattcatccctgtagcaaaactccccatcagaagctcaccaatgcatcccttgccccctcctatctccccgcacacgcccccacctactgcccaccacagacatttgcaggaaccggaccagagtgcagaaggaagcccaaataccatatgtttgcatatgctaacattattcatcaagctaatgaaccgttaaatatgttctatcctcctgccttgacagatatacccttacaacgatctggaaggccaggttcaagtttagaaatctcaggctgggcgtggtggctcacgcctgtaatcctagcactttaggcagccaaggcaggcagaccacttgaggtcaggagttcaagaccagcctggccaacatggtaaaaccctgtctctaccaaaaatataaaaattagccgggtgtggtggcacacgcctgtagtctcagctactgggaggctgaggcaggagaatcgcttgaacccgggaggcggagcttgcagtgagctgagattacgccactgcactccagcctgggcaacagagcgagactcggtattaaaaaaaaaaaaaaagtttggaaatctcagacatcttattctgttctgcagtgcggcaacacaggaagagtgcccctccccagctaccctcccccaccccctgccccattctctcctcaccctgtcctttgacccactccattcaatcttcatctccacacctgcaaaatagctaccgcttggccttccctggagccaggggtgcatagcctaccctcaggagggtggatgtggggacgaggcccatgcagcctctggaagcgtgcttaggcctctctgggcagggaattccggggtcccaggattccagagcaaggtctagagagagagaggagtggtgcaggctgggggtgggcatttcccattaccccacggccacttcaccccatgggtggaaggaagtcagaacaggaccttctgaagcactgacgcatccatccagggcccacgcgcccagctctgagggcagcccggttctggggcgtgtatacagacaatgagcagaggaagctggagcctcaggtcgctgccaaatgatgcctattttgagggcagaaagcccccttggttccacgttcttgcccctggctcctaacacagtgtcaggcacagggcagtactccacagaaattcactgagctgggcggccccttccccctccaccctgccaggctgctctgcccgagctgggctcatccccagctgagcggcagcctcatgggtcggcctcctctcctttgccccctccagtcccaggaccacccatgggcatcctgttcccagaggtgcggaccacgtctgtgcggctgatctggcagccccctgccgcccccaatggcatcattcttggtaagcctttgcccttcccgtgccccggctgcaggaagaaggaagaggcatgagctgcaaaggaggccacttcgttaccagcttgagggagagtaggtccagggagcctccacatcccctctagaatgggatctgggtgttagtcctcctgctagaaattccagtgtgtaagattatcttccggagggcaagatcagagttgaagtcccttaagagtcatgggttggctttgcgtccccaaatgtccccaggcccccagcctgccggccatctggtaaacctcggacgctgttccttagcatggccaagtgagggcacgctggcaggctcagcacagctggaaaagagtctcaaggcgcacaggagggaggctacagatgggaagcttcatctcacatttagagttcccccaatacacacacccagggttccggtcggcagctgcgtgaacttgagcaagtctactcccctctgcggcctcagtgccctcacctttaaaatgggggcttggactacctgtacctgtcccagggttctcagtcctgacctcacgcaccacctgccctagagcaatgccacatccccaagacagagtgggggcaggaaggacaagtgcattagcccagaaagacctgggctgggattccagctctgtcacttaccagcaggtggtctggcctctccgggcctcagtttcttcacttggggctgttacgggggtcacagacactgtgcatagagtgcctctccatgccacccacagtccaccctccccaggtggcagctgaagactggagagtgacccagagacctcaggcagacagaccacagccaaagggaccacggcaaggtggccatgtacagacacagctgtggctttggacggaacaacccttcccggggccctaggagcggcttgccttgcttgccataatagccatgtgcttccttcccacagcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagaggtgactgcccacgggggccagggaaggcttgggggcagctgagggggggccagccagtgctctgagctgttcctagtggatggctggtatgagctgcagtgccctggatgagaatggaaggtgggctccaatctctgaagtcaaagtcagcaaggggtctaatagactcccagagatgagccgcaagttcacacccaaggaccctactctggtctggtcttctaaagggaaagtttgtggccaggcttagtggctcacgcctgtaatcccagcactttgggaggccaaggcgggtggatcacttgaggtcaggagtttgagaccagcctagccaacatggtgaaaccccgtctctactaaaaatacaaaaattagccagcgtggtggcacacacctgtaatcccagctactcaggaagctgagacacgagaatcacttgaacctgggggacggaggttgcagtgagccaagatcgcaccactgcactccagcctgggtgacagaacaagactctgtctaaattaattaattaattaagggagggttagtgaccatcttccctctcccctccccactcgcagccctggccttgtcaacacagatgggcgcaggatcagggctgcagcctggagccccggctgccactgcactgctgccctgagctggcaccttgcctgatcttggactccccaaaagcaagcctgggaccccgactggcctgatagggatatattagaaactactctcaacctgggccacatagtgagacaccatctctacagaacatagaaatattagctataggccgggcatggtggctcacacctgtaatcctagcactttgggaggccgaggcaggtggatcacctgaggtcgggagttcaaggccgtcctggccaacgtggtgaaacctcgtccctactaaaaatacaaaaattagctgggcatggtggcacatgtcagtaaccccagctacttggaaggctgaggcaaaagaatcgcttgaacctgcgaggcggaggtcacagtgagctgagatcacaccactgcactccagcctgggctacagagcaagaccgtctcaaaaaaaaaaaaaaaaaagaaaggaatatcagccaggtgtggtggtgtacatctgtagtcccagccattcaagaggccgaggtagaaggattgcttgaatcaaggagtttgaggctgtagtgagctatgatcgtgccactgcactccagcctgggcaaacagatacagaccctgactgtgttttaaataacgaaagaaaaaggaaggaggggaaggggaaggggaaggggaagggaggagaggtttaaccttaaactagtgctattttctcctgagcacgaaaccctcttgcctaaggccctgggtttcaggaagaaccacggctgatgctttagagaaagatcaagggttggggcatgcaagcagcaggaacatgtctggtgcacgggaggacgacagacgcaggtgactaaaactgctgtcacctccctccaggtgtggggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgctgagcatcctgcattgcataggatgcccccgccacagagtcatctgttctgaattcccagtactgctgaggtttgagaagccctgcagaaggggcggggcagcgaggctggggagagaaggaagccaagctagggcctggaatgaagcagcgcttctcgtagggaaacaacctcatcctgctcaatcagggacagcgcagggcccggctcagcctcatttcaggcaggagcaaaggagctgggtgggtgtttgtccctcctcaccgtcaatccttgcttagggctgccctgaggagctgtaagttcccaggccctggggctctaggagcctgagggtgggcctctaaccaggagaggggtgctggctgtacccaggtgtgagaacctgcaaggatcctgcgtgcatggaattgggatgggaaggggatgccaggcctgagcccagatcacctcctttcctccctcgagaaagtccagccccctccaccatggcctggcccactcacctgctcctccccttctgccacctcccagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggtaaggctcgggtccatgccagcatccccactgcccctctccccgccgggaccagcggtgctcctccactgggtagggggccttctgaaaacacctccagcctgcccccagctctcctcctacatgcaccacccaggcggcccccgcgtccactctcaccctcgcaaatcagctctatcctgctcttcctcactctgttccctctggaactctgttaggttgcctcttaattatctatttctggagcctagaagtccccctttagtgaagtgcctgtcatccttcattagtgattcttccagccgggcggtatcttcctctccagctttaataggggagtggagcgtcactccgaaattctagcttcaatttaattccgagtgggttgaattttttatattccagttgatgtgaccgggagttttgagcaatactttcttccccacctctcccaccccccataaatctaaaagagagacgtttgctcccagaggaaataaggcttatagagatgaagtactgcttaactcttgagaacctcagctcctccctaatttactacatttaaaaaagagaggccaggagcggtggcttacgcccggaatcccagcactttgggaggccgaggcgggaggatcacttgaggtcaggagtttgaaaccagtctggccaacatggtgaaaacctgtctctactaaaatacaaaaattagccaggtgtggtagcacatgcctgtaatcccagctattcaggaggctgaggcacaagaatcgcttgaacgcgggaggcggaggttgcagtgagccaagatcgcaccactgcactccagcctgggcaacagagtgagactctgtctcaacaacaacaaaaaaagactccatctcaaacaaaaaaaaagaaagagatggcagtttgttgggggcaggggaggagtttgttccgagtggaggtattggtgcttttgtgactgcatggttctgcgaagtggggaagctgcagacatttccttctcgggatgctatggcttacaactggggctaaaggcaccccaagctggcatggtctggaggacctggtctaggtgcttgggacccctggggccgggtcccagtttgtcctctttgcagcaaagctcctttctgagcctcagtgtgcccttctgtgtagtaggctggcaccctgccccctttcccgagcagggccagatcagggagactccttggtgggggcatggggcgaggcctttaaggagcaccttggctcattggccctgatttctccctacaggctgaagcccttcacgtcctacaagttccgagtgaaggcgaccaatgacattggcgacagcgagttcagcgaggagtcggagtcactgaccaccctgcaggctggtcagtaccccttccccagcagtctctctctcagcccactggctgcttcctgggcatggggcattttcttacggggggaggggcctccaaagatgagagaggcgtgggacccactgggcccttcagctcccggggtagggtctcagggaggtttgggccagagacacttttgccaagggctcagggtcccaggcccagcctggcctgtggcgtattcctcctgtcccacaagctgccagtgagcgggacaggagttctcagcagcagcagaagtggtctatggctctgaggagcagagcggagggggctctgggacccttgggtttgggctgagtcagctcacagtccctccctccctcccctttacaccagccctttgttctgcagaaatcgggccagcaggcatggagggcgatgcgatctggacctgccccgcagtccagtattagcagaatctggtctcagtgggctcctggggaacttgaagctgcggcccccagaacccacctgtctgcttctctccacagcccccgatgaagcacccaccatcctctccgtgacgccccacaccaccacctccgtgctaatccgatggcaggtatggcccagcgggcaggaaacctccgtgaagacccagacgagctctgctctgggactggaaagccagcagtccccaccagggctgcgtggagcccccaagttctctgcccccagagcgcctgggaagccatgagaaatccaggcatgtgcatgtcacagaacattctatacaccgtgtgcccacacatacacactcccataacacgcctcattacactctctagatagtcacatcaggcaggtgctgtcatcctcttctgcagacaaccactgagactcagggaggggacccgaatggccccaggtcacatagccagtgagtggcagggccaggtgtattagccttaggcctgctgagtccttgggctgaaaagtgcttgtggctctcagggcccccagagtctccatgaagccccactggtcggtgaagggattccttgcagagacctatgcccgtcatcatcactgtgcaagtagagagaaatgccccccttcgtccataccccttccagatgcccactcttcagtgggcactgcctgctctgccatggcctggggaagaccatgggcaaacctcagcgaccaggctgctcatgggtcctgccccgcggagccctcctgtgccctctgaagttcagccttgcctcagcaggtcacccacatgagagggacccctggcaaaaccccatctctactaaaagttaaaagcactgaactcccatcaccacttctccagatcaaaggggcaggcactccccttcagccatctgccactccacaaagggaaagcccttgaagacaaagccaggagggtccccccagcctgagacacacagctcaaggagaggacgctcccgtagataaacatgacttagtgcacctgtgaccgggacgaggctggagcaacgtggcagagggagggggcagggaggtgcccatggcagccggggaaaccattaaggagctaacaaaacctgagctgtttcagcaggtttttggttttttggggtttttgttttgttttgttttgagacacagtcttgcgctgttgcccaggctggagtacagtggttcaatcttggctcactgcaacctccgcctcccagcttcacacgattctctttcctcagccttccaagcaagactacaggcacatgccaccacacccagctaatttttatatttttagtagagacggggtttcgccatgttggccaggctggtcagaccattcttcataagcagtatcattaagaagtagtttccaccttctcccgaagccggttctgcagctaagctgtagacgggagaggaagcaaaggagaacttgatgaaggggtgaggggcacactcacccttgcatgtactaagagtaggagagggctcagcttgcaggaaacaccaggaagtgttatccagatgctaaggcagggaccagcaggcctggggaggctggtgatcaggtgagggcagctcttgaagacaaaggaggtgaacaaggagcggctctaggaaaacagctgtgtgctccaggccccaatgatgctctgtgatcttgggcaagttccttaacatctctgagcctcagtttcctgcttggataaaaggcgattactgattcctgcccttccctccttctagggaatgctgcagggatgaaatggcctcatcagaagtgctttgtaaatttaaaatgcccaatattatcttgatttcttttcctggttaaaacatagtccctgctctgtggctgcaggaggcatgatgagagagcgtggggaggggtgggtggtggtccaggtgccctccccatgccctactcccttcctgcagccgccagcagaggacaagatcaatggcatcctcctgggcttccggatccgataccgggagctgctctatgaaggactgaggggcttcacgcttcgaggcatcaacaacccaggggccacatgggctgagcttacctgtgagtgacacttgggagccagaggaatgggtgggatgggggcggtcaccctcaccttcccgctctggagctctcagcttcctggaaccactctaacctgaaaccttgcctccctcctccatgtgtgcctctccctcctcccatcccattcattcatttactgaatatttactgagcaccttctatgggccccgagtcactgtggggcacaccaatgatcaagacagacagggtccctgccctcttggagttgcaggctggaggaggagccaggcgagctgggaaggaaacattctaggaggacctaaagccagggacaggcaaggcttccccggcaccagcactggcgctaacacggaaggatgatgccaagttaaccaggacaaagggacggggacagcccggtgcatgagaaggagcaccctgcccttgagggaccagaagcctcacctggtcacacccctagagcagtagtcctggccccctctttttcctgggggaagccactgccctgcctgtcccctggagcaaaggaaggaaagaggggagcccaggtggaaatgtcagggagagccgatgcccagaagaccacggcaagggaaagacgtgtttggacttttgtgttaggagccactttggtggcatgaggatgatggcttggccatggtgggaggatggagagccagaggcaggcgcccagatagaggctgttgcagtcacgtggcaagagagcaggaggttggaaccgaggcacagactcggggtggaccgaggccagtatgggagatgatatgtgatgggcgcagatgctccaggacttgaggtttttttgttttttgggtttttttagacagagtctcgctctgttgcccaggctggagtgtaatggtgccatctcagctcactgcaacctccgcttcctgggttcaagtgactcttgtgtctcagcctcccaagtagctaggactccaggcgtgtgccaccacgcccagctaatgttgtcgttgttgttgttgttgttgttagtagagacggggtttcaccatgtcggccaggctgctcttgaactcctgaccttaagtggcctgcccgctttggcctcccagagtgctgggattacaggcgcgagccactgtacctggcctgtttttgatttttcaaagtaaatcagccactcgcatcataattatttagtattccgcattggcggacagttaggtgcatttacgacagttaagggctttggagaaaatgctgcaaagtggtgcaaccgataaaacacgttacagcacagcaggtagcaacgataattagaacaccttggtacataatgaaagaaaaaactgaggttttcccagtggctcaaaactgatgttcatctacacctttggcttgtttgggtctgaagtgcttgcgttcacctaagatttggactcagaccactagagatttttataaagagcctccttccctaaatatcctctatccacccacctgggactccatgactgattcgtagtagaagacggcagcaggcaggggtaccccagaggactgggtactcaggtgggtgtgggacactcacccaaacagactagcaggagaggggtcagtttaagagcctcttcttttttttttttttttgaaatggagttttcactcttgttgcctaagctggagtgcaatggcaccatcttagctcactgcaacctccgcctcccaggttcaagcgattctcctgcctgaggcctcctgagtagctgggattaacggcgcacactaccacgcccagctaattttttgtaattttagtagaaacggggtttcaccatgttagccaggctggtctcgaactcctgacctcaggtgatccacctgcctcggccttccgaagtgctgggattacaggcatgagtcactgcgcccggcttttgttttttgttttttgtttttttgttttttgttttttgagacagagtcttgctctgtcacccaggctagagtacagtggcatgatctcagctctgctgcccaggttcaagcgattctcctgccccagcctcccaagtagctggacctacaggcgtgcaccactatgcccagctaatttttgtgtttttagtagagaccgggtttcactgtgttggccaggctcgtctcgaactcctgacctcaggtggtctcgaactcctgacctcaggtgatccacccaccttggcttcccaaagtgctgagattacaggcatgagccactgcgcccggcccagcctcttcattttcacgtttcctcccttagttctctcaagccttttgtgccttgtcttctagtgagttagcagacaacaaaatgatgagcatgtagcaaaggaatattaatagaaaaactctgaagtagctgatccaacagcttgcgtttttggtggactttttttccttctttttttttttgcccatatgtgcttgtggttgtgattttatattgcctgtgtataatacagtcatatttcctagtagtaaaattgtttctggttcatatgaggaaattaacgactccagtatttcatgctggtttccaggagctctgccctgaaacaaggaagagaattggggtgagagggtcccccagagatgtccctagagatgctgggctacaaagagctcacatcaccttgggccagtgcacaccagggtggggcagactgtccagggagcctccaccttcccctgcccccacaaccctgttatcctggcccgtaactcagcattggaaatttggaaacactcttcctgtctgttcacgccgtcagccccgcctggccggggtttctttgtggggtggggatgtgtgagcactaacctcctctgtctgctgtctccctctgcgcccccgccccggcacccccaccccatagccatgtactccatgcggaacctgagccggcccagcctcacgcagtacgagctggacagtaagtctccttgcatggtggcttcatcgcgggcccaggcctcgcaggggattgggagtggggcctccttgagagacctgatcacaggttgagggggtgtgcccaccccagggggcttaagaaacgggactaccctgaacacaagtgataaccctaaacacacggaaaagtaggccgatgacagggaaagtctccttcaagcctgccctctgttgggtgtgggctggaaaagggaagtctgtaaccctgtgctcggctgggtcgggggacagtgacagcggggccgcagcagaagctgttggacgctgctgggtaggtgggcaggtgtccacgtggttgctgccccatctagtcccatcgaaggcacttctcggcccagctgggtcttacagtctggccccacacctggagggaggtgacagcagttttagtcacctgcgtccgtcgtcctcccgtgcaccagacatgttcctgctgcttgcatgccccaacccttgatctttctctaaagcatcagccgtggttcttcctgaaacccagggccttaggcaagagggtttcgtgctcaggagaaaatagcactagtttaaggctaaattctcttcctccttcctccgtcaaccaatgaccaacccaggctgcatagacagctaggcaagggtgacacccctctcacaaccctgttaaagggtagacctacccaggggaaggaagcaggggcagggaacccagagagaagagtggagagggtgggagaaactttcagctacgggggacagtgactgcgcccgtttcttgcagctgcgtcccattcccaagttctgccaggcattctcagccaagcacctcaaacttggcagaaacatcaggtttcttagtccagaattcacatccaatgcgcccctcccccctggagctgagccccgctgtgtaaagagttggtggatggggactctgggcatctgtcacggtggggaaagaggacaggctgggggtagggggtgaccctatgtccaggcatgcccaggacagctttggtttacactggttgtcccggtgtaaatattcatagtggttttcagtctcaaaagtgtccagttgaacaataaaatgtacggccaccctaggccaagaggccaaccagcattgccctatgtccagattggcacagagcgtcccctgggggccccgcctctcacctcctccttcatgcaccttcacagagggggctagaatggcgggggtgcctcattcctccccctgcagcctccaccctccctggggacaccttcccagcaatgacggtgacctcagtgtgcttcccctcccccactctcccccacagacctgaacaagcacaggcggtacgagatacggatgagcgtgtacaacgctgtgggtgaggggccctccagccccccgcaggaggtctttgttggggaggcaggtgagcagcgcccgccctgtccggccccagcatgcctttcccagccccacccagttcagctggaagaaacgggatctgggctccccatcccgcccagcccacctcccctcccaggtttactcgcatgctcactgcctaccctgcacgccctccagtgcccacagcagcacctcgtaacgtggtcgtccacggcgccacggccacacagctggacgtgacttgggagccacctccgctggacagccagaatggagacatccaggggtacaaggtagggtgccctcgggcagagcaaaggggtgcacggatgagaagccaggtcggaggctggggagtgagtgatatgtgggaggcaggcaggtccccaggccctccattcatccagccagctcctcggcccttcaggctctgtggtacacctgccaccttggctgtttggacccagttcgcagaaatatttgtacagctgaagctgaaccacatccatcccctccagcttcctgagggcaggctgagcttaggtgcaagaaactctagccatccctaggctcgtaccatctctgagcagcacacacatccctccccaccagcccccaaccccatacataacttaagaccctccaaggggcttttggccccataattacaatattgatattaatcagatagccagttagcaaagcatcactgcctagtatttggaaatctctgtttaaaaatcatttctaggctgggcgcggtggctcacacctttaatcccagcgctttgggaggccgaggcgggcagatcacctgaggtcaggagttcgagaccagcctggccaacatggtgaaaccccatctctactaaaaatacaaaaattagccgggcatggtggcaggcaccggtaatcccagctattcgagaggctgaggcaggagaatcgcttgaacccaggaggcagaggttgcagtgagccgagattgtaccactgcactccagcctgagcaatagagtgagactctgtctcaaaaaaaaaaaaattaaaattaaaaatcatttctagggctgtgtgtggtggctcacacctgtaattcccgcactttaggaggccaaggtgggcggatcacttgagctcaggagttacagaacagcctgggcaacatagtgagaccctgactctacaaaaaaaaatacagaaattagccaggtgtggtggcatgcgcctatagtcccagctacttgggaggctgaggtgggaggattgcttgagccaggggggcagagtttgcagtaggccatgatggagccattgcactccagccaggtaacagagcaagacactgtctcaaaaaagaaaaaaatcatttctagatttaggatgatgtcctgtgctataaggggattcaatttctccctaatattcacaaagccctttggaactcttgaatcttcatgaaaggcccacgaagctgggaggatatgggtttttatgcccaaatgaggaaactgagttccaatttagttgacctggtaagatcacaaaaacagcaggcaggccgggtgcggtggctcacacctgtaatcccaacactttgggaggccaaggcgggcagatcacctgaggtcgggagttcgagaccagcctgaccaacatggtgaaaccccatctctactaaaaatacaaaattagccgggtgtggtggcgcatgcctgtaatcccagctactcgggaggctgaggcaggagaatcacttgaacttgggagagggaggttgcagtgagccgagattgcaccattgcactccagccaagaggtctcaaaaaaaaaaaaaaagcaggcagcagagtcagattccaagtctggcagctctcaccccccgaggggtgaaaagtaagcactaaccaaccacatgagcactaggggaagtagatttaaaaaggaacatgggccaggtgtggtggcctacacatgtaatcccagcactttgggaggccgaggcagatggatcacctgaggtcaggagatcgagaccagcctgaccaacatggtgaaaccccatctctactaaaaatacaaaaattatccaggcgtggtggcgggtgcctgtaatcccagctatttgggaggctgaggcaggagaatcgtttgaacccaggagacagaggttgcagtgagccaagaccgtgtcactgcactccagcctggacaacagagcaagactctgtctccaaaaaaaaaaaaagaaaaaaaaaaaaggaatgtgtctgtctggttggaagagctggaacacataacccttagctgtgtctgcctcccgcaccagtgtccagttgactctcattcttggcggctggttgttactccagagaagagccccagtgccatggcttaagtggggagtaggagagacgcaaggcacctcatcccacaggtggggagtaggagagacacaaggcacctcatcccacaggtgggaggagtgtcagcaaaggggaagagcttacccaagtcacacagctcattaatacaggtagtcccgatttaggatggaatccagcataagagtctcattccatctggggtgaaggaggaggaaggaaggaggaaaggcatgttgccaaggaagccctaaagatggatgacacccctcaaggcattgcccaggagcaccagctgggaaaactaaatattgcccccctagcatatgcctcccatgggaaaagaaaggggccagggcagcgccagcagcagtgtggcagccaccagactgtcgaggcttgtaagtggtgagttaatagacagacccaggaaaatgtgtaggtgcacaacaccatacagaatacagcagaggcctacatgctccagaaaacatgacccgtacctgagcggcaactgtggatgtgaacggagaaagtgctacctcctggacctgtgataaccaaggtactgacatcaacacgcacgaacatcagtgacgcattaacttcatcaacccatgagcacaccgaagctgatactgcattccagtcagactgcacccaactggtgcgtggcaggcacattcatgcacgttctgagagctccagtctttcagttggtcaatgacacgtgtttattgagcagttattgtgtgcccagcattgtgagcttagatgttagggagggaaggccaacacggggcaaaataaataataccgccaggtggtggtaaatgaagcaggttaggggagagccaggtccacgaggaggtttgaatttttttttttttttttgacacggagtcttgctctgccgccaggctgaagtgcagtggtgcaatctcagctcactgcaacccccacctcccaggttcaagcgattctccttcctccgcctcccaagtagctgggattacaggtgcctgccaccatgcccagctaatttttgtgtttttagtagagacggggtttcaccatgttggccaggatggtctcaatctcttgacttcgtgatccacccacctcggcctcccaaagtgctgggattacaggagtgagccagcgcatccagcctgaaattttattttattttattttagtttattttatttctttctttcttttttttcctgagatggagtcttgttctgtcacccaggctgaagtgcagtggtgcgatcttggctcactgcaacctctgcctcccaggttcaagtgattctcccacctcagcctcctgagtagctgggattacaggtgcctgccaccatgcccagctaatttttgtatttttagtagagacagggtttcaccatgttggccaagcttgtctcgagctcctgaccccaggtgatccgccctcggtctcccaaattgctgagattacaggcgtgagccactgtgcccagccagggtttgaaattttaaatgggttgttaagggctgggctcagtggctcacaactgtaatcctggcgctttgaaaggccgaggtgggtggattgcttgactccaggagtccaagaccagcctgggcaacatggtaaaagcctgtctctacaaaaagaaaacaacaacaaaattagccgggtgtggtggcacatgcctgtagtcccagccaacggggtgggaggtgggaggagtgcctgagcccggccgagtgagggtgcagtgagccattgttgcaccactgcactccagcctgggcaacagatcaagactctgtctcaaaaaaaaaaaaaaaaaaaaaaaaaaaaaaggttgttaggaaaggacttaatgagaaggtgatatttgagcaaaaacctgaaggagaacagggcacaaatcacatggatccagaaagagaggaaaaaagagcaaaggtctcagggtagacaggtacttggggtatacggagagccttgtgtgtccccagagtgagttccagggagcgcaatgggagatgggaaagccggggctggagcacctggggtccttcggggctttggctgtcactcttgagtgaagtcctctgagtggaggactgggaccttcagagggtcccgctggctgctgtgctgagcagagtctgaaatggggaaagcccagaagctatggggaggcatctgaactatccgggtgggccatgaagggggctcagatcaggtgagagcagagtgagaagtggccactctcagttagtcccaacagcagagctggtagaatttgctaacaaatcaggctgggcacagtggctcacacctgtaatcccagcactttgggagcccaaggcgggcagatcacttgaggtcaggagttcgagaccagcctggccaacatgacgaaaccgcatctctactaaaaatacaaaaattagctgggtatggtagcgcatgcttgtaattccagctactggggaggctgaggcaaaagaatcccttgaacccagaaggcagaggttgcagtgcaccaagatcacgccactgtactccagcctgggcaacagagcgagaccccatctcaaaaaaaaaaaaaattaccgacaaatcgaacatggaatggaagaaaagggaggcaacaaggacagccccagggtccacaggatgatggagcaggaaaagacaaagctggtgaaggaggaggctagggaaatctggagtctggttccagatgtgtttggtttgagacgtctgttggacattcgaggggagacagaacagagtcagagatgcatgtctggagttcaagagagaaggatcaaaccagagatgtgaattatagagtcctcggcatatagatggtactgaaagctagagattagacaaggaaagataaagaacaaaagaagtctacaaattgagccctgaaaccaaaaactgagtgatgtctcagagctcatgggaagaacatgcttccagaaggagggagaacctctggaatgggagaaatatttgcaaaccatacatatgaccaggggttagtagccaaaatatgtaaggaactcatacaacaaaagtgaaagaaaatggggcaaaggacccaaatggacatttctcaaaagaagatacataggctgggcacggtggctcatgcctgtaatcccagcactttgggaagccaaggtaggcagatcacctgaggtcagtagttcgagaccagcctggccaacatggtgaaaccccgtctctactaaaaatacaaaaattagctggccatggcggcaggcacctggctgaggcaggagaatcgcttgaacccaggaggtggaggttgcagtgaacccatatcatgccactgcagtctagcctgggtgacagagcaagactccaactcaaaaaaaaagaaaaaagaagatatataaatggtcaacaggtatctaagaaggtgttcaacatcgctcagcatcagggaaatgcaaatcaaaaccacagtgagatatcccatcacacctgcaaggatggctgttatcaaaaagtctagagataagtggtggtaagcgtatggggaaaagggaacctttgcacgctgttggtgggaacgtatatcagtacagccattatggataacggtatggaagttccgcagaaaattaaaaatagaactccaatgatccagcaatcccactactgggtatttatccaaaggaattgaaatgaggctcttgaagagctatctgcaggcccatgttaatttcagcatcattcacagtagccaagatgtggaaatagcctgagtgtctgtgaatggatgaatgaatgaagaaaatgtggtttatacacagtggaataccatccagccttgaaggaaatcctgctgtttgcaacaacacggatgaacctgcaggatattatgccaaatgaaatgtaccaagcacagaaagacaaatactgcatgacctcgcgtatatgtggaatctaaaataatcaaactcataggaacagagagtagaacagcggttgccagaggctgagggagtgagggaaatagggagaaggtcccaggatacagcgtttcggtgaagcaggctgaatacgatctagatctaatgtacaacatggtgatgatagttaatgataccgtattgtacacttgaaatttgctcagaaggttctcaccacaaaaagatgatgaacatgttaattagcttgattgtggtaatcatttcataatgcatgtgtatatcagaacaccatgttgtataccttaaacacatacagttttttggggtttttttgttttttgatttttttgtttgtttgtttttttcgagacagagtctcactctgtcacccaggctggagtgcagtggtgtgatctccactcactgcaacctctgcctcctaggttcaagggattgtcctgtctcagcctcccgagtagctgggattacaggcacccaccaccatgcccggctatatatagatcttagattgtcaattatacctcaataaagctgaaaaaagaaatgaaagggcagagaattgggcatagtaaatggcaggttcgtgattataatggtgcactcccatgcttgcccctgtccacataaggcatttattcatccagcagatattgattgaggaccatggatgtgccagccatgattctaggtgtttgggtcccaagggggccacatggaccgagatgcctgcccgctggagcctgcattctggcagactcctggttacccatcaatgtgccccatgcagctcagcagtgtgccccatgggaaccaggatctgggctcagtccctttatgtcctttgcacgcgtgtcagtccctctcactgtgaatcatcagctaacaaaggtccgcagaatgcagcgctcacaaacaagatgcacctgccggagtgcctggtttgtgaagacagctgtccctgggttctaggccccgacccactcctcacccaagagcatgactgcagccattggcccttcctctcctccacctccccagtggatagctcccacgggcagggcagaaaagcattctgagatatgtttcctctttttatgccttttcctgacctcactttttttttttttaacggactctcgctccgttgcccaggctggagtgcagtggtgctatctcagctcactgcagcctccacctctcgggttcaagtgattctcctgcctcagcctcctgagtagctgggattacaggcatccgccaccatgcccggctaatttttgtatttttagtagagatagagtttcgccatgttggccaggctggtctcaaactcctgacctcaggtgatccacctgcctcagccttccaaagtgctgggattacaggtgtgagccaccgcacctggcctgacctcacattttcttccagttgtcacccatttctttggcccctttacagcagaattcctcaaaagaatcttctgtactcactccctccgattcctctgctctctttctcccttgaactcgctccaaataggttctcatccccgccaccccaccgaagctcttcctgccaaagttgttaataattcccatgttgctcatatcgagtcaaaccacaggcttatcctgcctgactcagcagctgtgtttgacacatggatctctccttcctctcaaaatgcttgctttcctcagcttccctcgctagctcttcctccccaccaaccactgaatgctggaggcccccagggatcaatccacagccctcttctctacctaagagaatccattcattctcccagtgtgcactcacggaagaccacctgtgtgctaataatggcaaacttttagcatcagccatgacctttccaaatccaacaggaactttgttaactgttgtacccccattagtatgaatgcatgagtgaatgaatgatttcatacatgactgcctctgctttcattcatctatccatatgagaagaatctgcttttcgttatttttatgttattttagagatggagtcttgttctgttgcccaggctggagtgcagtggtgtgatctcagctcactgcaaccttcacctcccgggttccagccatcctcctgcctcagcctcccaagtagctggaactgcaggtgcacaccaccactcctggctaatttttgtgtttttagtagagacaggggtcttgccatgttgcccaggctggtcttgaactcatgggcacaggcgattcccctctctcagcttcccaagtgctaggattacaggtgtgagccgctgcacccggccctctccccctttctaaaaaagaaatcactacaaaagaaatccccatctctacgaaagaaatagccaggtgtggtagcactcatgtagtcagagctacctggggggctgaggcgggaggattgcttgaacctggaggtcaaggttacagtgagccaagatcatgccactgcaccccagtctgcgtgacaaaatgagaccctgtcttgaaataaaataaaataaaataaaatgggagagagggccgggcacagtggctcacacctgtaatctcagcactttgggaagccaaggtggttggatcgcttgagcccaggagttcaagaccagcctgggaaacatggcaagaccccgtctctacaaaaaattaaaaacttagctgggtgtggtggtgcacacctgtagtcctggccactcaggaggctgaggtgggaggatggcttgagcccaggtggttgaggctgcagtgagctgtgatcgtgccactgcactccagcctgggcaacagagtgaggcctgtctcaaataaaaaaataataataaagggggagagggattggagaaaagcaaggatttcatggtaacaagatgtcctaactgccacccatacatgccagtggggacacttttattagctctttctcactttatgggcttcctccagggaaatgagaaattgaaaagccggtgacatgcagaaacctcattggccagcagggggcgccaaatgacctccaattttgcacgtggctgggcccagctggccgctatctggatggcctcagtcctggaactagcagaagtgttaacctgtgctacagaggaaatgattgaaaacaatggctgggcttggtggttcgcgcctgtaaccccagcactttgggaggccgaggcgggcggatcacaaggtcaggagatctagaccatcctggctaacacggtgaaatcccgtctctactaaaaatccaaaaattagccgggcgtggtggcgggtgcctgtgtcccagctactcgggaggctgaggcaggagaatggcgtgaacccgtgaggcggagcaagatcgcaccacagcactccagcctgtgtgacagtgcgagactccatctcaaaaaacagaaaggaagagaaaacaccagggagcatctgttgtgttcctggcctaaagccttctgcagccacggggttccttaggaaactggccaagtacctgggtgaaacccttagaacctgcacccctcacacggaccccaggaagtacgtgtccttaacctcactgaatgtacgacaaaactgcagctctgggaagtcagctggccaggtcccgctgctgtatgcggtgcagctgggattcagcctcccgctgcccgccgtcttggccgaggccttcctctgcagcaggccttgttcctgttaaccagcagctgctggtgcagcgggcccggggtggccctgagactctgcttccctcaccagctcccaggtgacatgaggccaccagcacttgcaccacactctgtctggatagactccacactgccttatctccccagctcagcctcccgtaggacggatttgctttattcctccaggaactgtactaagtgctgacgtgccagcgctatggtaaatcctccaggcatggcgggaaacacagacacttgggggccatgccctggagtttactgtctggcagagaccagggtcttggctgtgaaaaggaaggttccagaaaggtttctaaaacagttcttaaattctttttttttttttttgagatggagtcttgctctgtcacccaggctggagtacagtggcgtgatctcagctcactgcaacctccacctcccaggttcaagtgattttcctgcctcagcctccagagtagctgggactacaggcacttgccaccatgcccggctgatttttttgtatttctagtagaaacggggattcaccatgttggccaggctagtcttgaactcctggcctcaagtgatccacccacctctgcctcccaaagtgctgggattacaggtgtgagccaccgcacccggcctcttaaagacttctccgctgtttcccaggtgactcacagcaatgaaggtgtctctgagactacaggtcagcagggacaggagggactctcattgcccctgtccccctcactcccacatccttctgttcccacagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcaggtgggagagggggccctgaggaggggaggggtaggtcggccacggggggttgcaagaggacctacctggcatccgggctcttggcaggcatgggggcagctgccttatccgcctgaggatctggtcgtggtacccaggtccccagagacaccctcccaagtgggagagcccattctcagaaaagagaagctgtccccataaagccttgagaaacccccacacctcatccctgtcctccccaccgtttgccccgccttgcagacggacagtcagcacccccagcccctcccagccagcctacttctgctccctgccttcttcccacctgccttccctctgtctctctggctttgttcattccacaaatactgagtgtcttatgagcccgtgccatgctagatgctagggacacaacagtgagaccagcaaggtccccaccctagtgcgggggacagatcataagcaagttgatgaagtaaatgcagacgggggtcagcacaggtgacctaagagtgaggcaggagtgggtggatggctctggataggctcacccacaaagccctccctgaggaggtgagatttgaatgagaagaggccggcaggggccaggcatggtggctcacgcctgtaatcccagcactttgggaagccaaggcaggtggatcacctgaggtcaggagtttaagaccagcctggccaacatggtgacaccctgtctctactaaaaatataaaaaattatccaggcatggtggtacgtgcctgtaatcccagctacttgggaggctgaggcaggagaatcacttgaacccgggaggtggaggttgcagtgagccgagattgtgctactgctgcactctagcctgggtgacagagtaagactctgtcccaaaaaaaaaaaagacaagaggccagccatgagatgctctcaggaggtggcagagggtgctgggggctccaggcagagggaaccgcaggtgctaaggcctaggggctggagaggaacccgggaacgcagagaaagccaggtggcttgcaggaaaatggggcgagagctcaggctgggggattgggattgggattaattataagtacaatggaccacacatggtgtctcacacctgtaatcccagcactttgggaggccgaggtgggtggatcatttgaggtcaggagttcaagaccagcctggccaacatgatgaaaccctatctgtacttaaaaaactacaaaaattagctgggcatggtggtgcacccttctccaatcccagctactcaggaggctgaggcaggagaatcgcttgaacctgggaggtggaggttgcagtgagctgagattgtaccactgcactccagcctgggtgacagagcaataatctgtcttaaaaaataaaaaaatttaaaaagtatgctgggaagccatgggagggcttgagcagttgagcaacagggtctggtttacatttagagaaaagtgctccggctgctgtgcagaagatggcctggtggaggggagagagtagaggcagggaggggagatcgggaggctgaagggtggcgggtgcagaggagagggcgctggtgagaatcctgctgcctgtgtgcagagcgagcctggtagtcaggcactgtcacacttaaccctcccagaagccccgtggacaggcagggcaggcagcaccctcatctcacgatgagccggggtcacccaggaagttatactacttgtccagggttgcccagctggtcactggggcagcagaggctggaacccaggatttctgagagaaccaagtgttctgtcctcgtggactggaatactggccttttgccccggcctcccttgagcatcttgttcaacctgctgcttcctatgctgtcagtgacatgtggcttttaaagagctgcagagggcacacctgtggcatcagttcctcattatgaccctctctggggacaagccctggctccagggaaccctttccctccactacccccagggtctgacggtggccagaatgagcgtgagctgctgaatatacaagtctgtccgtccgcctcctgtcccggccactcttttgtcagtgccatctgccagatgcgaaccccagggaacccgaggcttccgtcactgcggcagcaggacaacatgttctgtcccacgtccctgtagcacaggggaggcaggaagggccccctgagctcacctccctccttcaaagacactcgctgactctgcctcctggggctggagccggaagcaggtccggattagctccagcgtggtggggaggcagcgccggacaataatagcctggtcatcctccctgggccagctggggatgccgcagattgggacgcttcctgcccttcctctgtcctccccatcaggggagcccccacccccatgattttggggttgccacagggttcttggtccgagaaaacatttctcccagagggtctgactgtccttggcgtggctccccctgactgcgtggggcctctgtgacaagccctggagccccaggaggagaggaaggccatctccgtctgctgtggttctggtgtcttctttgtttagcgcctaccgaatattctgaggcccagacacccccaccttctccacgaaagccaaaagacgaaccccgcaaagccaggaaatggccttgccccacgatgaccccgggggtgtgacagcttgtcccacgctcatagcccgggctcagagccacttagcagggagaagcctgaattctgcaacttgagggaaaaatcgagttctctttcttcccagttcttaggactctgatactggaaagttgagagaggagaggaagggggcctgatggcctccagtgacccctcctgcccgccctttctgccgagccccacgctcttgttcctcccgggctcagacccaatactcccgctagctccttggagctgaacccgaggctttgaacttccacagaagaaggaaacaaaaaccctttgctgtctcccgcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggtgagtggaccccccagcacagctccccagccccccactttgcaaaagctcgctctcatctcagcgcccatcacagccactacacatgagtgagattcggtgagagtctccccatcttataaacacggaaactgagtcccagacaagggaaagggcatttccaaggtaaaacaacagcaagttgagggcagagttggaagagagatccaggtctcctaacttccaggcagagaatcgttaaatatattcttccccctttggtcaacggaaacagggaggaaaggaagggaaacctgagtggacagggctctgttgagaccataaagaaggggggcagccaaggacggtggctcacgcctgtaatgacagcactttgggaggctgaggcgggtggatcacctgaggtcaggagttccaagaccagcctggccaacatggtgaaaccccgtctctactgaaaatacaaaaattagccgggtgtggtggtgggtacctgtagtctcagctactcgggaagctgaggcaggagaatcgcttgaacccggcaggcagaggttgcagtaagccgggatcacgccactgcactccagcctgggcgacagagctagattccatctcaaaaggaaaaaagaaaagaaaaagaagaggggagcccctgagggtcctactttgccctttcccaaaccttagggttctcagctttactgtgggttagtccttctttagctttggtgggagtcaggaaccccttggagaatctgatgagaatctgaccaaagcttcagagcctctccccaggaagatacacaagaccaaggaggtccctgcaccccccactgctatctgcggaccccagatcaagagccctgctctgcaaatgacctcgctcttgtccttaaccctgttcatctgactggtcttctgaccccttcctccgggccccagctgggaacctgcccatttctgggctcctaggctgggctgcgcagcccctgacaatgggcatctggtacctgccagctttctacccctggtaacatgccaagaaatccctgccattttgttatgaacaaccatcctatgaggatgggatttaggcaggaaggaaactgcgttcctcactgcctgggactagtcccagccaggtgctgggggtgtggctgacctctggagccacccctctcactctcaccccctccaatcacggagcctggcaagaacaaggggcagagacctgggaacatcgttgtgaccagcagttctcggtgagcctagggaacaatggccctcagtcttccctgctaccacctgggtgccagcagctcgttctgcaaaggggagctgtgtgttagaacaccaggggggagccaggccccagcaggagatccagtcaggtgcagggccggagtggggcagaggacagcagtccccgagacaaggtacagggggccagcacaagccctcttcacaggggcctcaacctggcctgtccaggaccctctcaacttgaggatgtgagctctttgccttccaattccacagtctggtgggatctggactgtgtggctcaactccacacccctacacattcccatcttcccataatagttcagttaataagtacagcaagacaaggccccgcctggacagcccagtgtccacaccccagttcatcctgggttcaggtcaatagcaaaccagcctcacaaaagcccagcagcccccactgtcctgtagggaaaaccaaggtccaggcagatgagggctttgttcagaattgtcaaggagcaggtagccagagtccctgttcctggtcccagggtcatttcattctttcaggaagcccctctgagcctacattgttccatcatttagtaatccacttagcggccgggtgcagtggctcacacctgcaatcccagcacttcgggaggccgaggcggtggatcacctgagttcaggagttcgagaccagcctgaccaacgtggcaaaatcctgtctctactaaaaatacaaaattagctgggtgtggtagtggacgcctactcgggaggctgaggcaggagaatcgcttgaacccaggaggcggaggtttcagtgagctgagatcgcgccattgcactccagcctgggcaacaatagtgaaaatccacctcaaaacgataatattagtaatccacttagtcaataaataggtcaggcacctacatgctctgttattttacttaaagctcatagcatccctgcctaagatgctgtggacaccctcactcggcagaacaaactgaagccaagttaagggacatgccggggccggcgccatcactgggtctgagcccagcctattggctgcaaggcctgtctttcactggtgactggcgtgctcgatggacatgggaaatgacactaaccccggctcccagggaggctggcagtcaggagtatttggattcgcgaagcacagagtgcaaacccccacctcctgaaagctggctcaagcgtcccctctagttgctgtgatttggggtgctgaggcatcctcacttttgccctaaaaagcttggtggactgggcatagtggttcatgcctataatcccagcactttgagaggccaaggtgggaggatcacttgaggccaggagttcgcgaccagcctgggcaacataatgagaccctgtctctacaaaaatttaaaaattagccaggcatgatggtgcacacctacagtcttagctacttggaaggctgaaagtggcaggacggcttgaacccaggaggtcgaggctacagtgagccatgattgtgcctgagcaacagagcaagaccttgtcttaaaaaaaaaaaaaaaattgtggcagatataggtgctggagggccatgtgagctcctggctgaaccccagaggtggagctggagtggggctcaggtggaggacctggtcaaaagtgtgtccccgcaactctgggcttttggtatttttatggaagcacttcctgaaaaaggatataattctagtcccatgggatgctgcataagggaatagcaatggagccgaaacatatttggggtgcagaggttacattaaacaggatggcgagtgttctcttttctgtagatgctgatgatggaccctgtggctactcagtagacacagacagtagtagcttttcccaaacatactgaaccatggagccgttctccctgagaacagcaggcaggaccgtgctgtgagaaacacagcatgggcaatgtggttgtgtgggctgggggtgcatttcagcctgacctcaaggagtgaggcccctacccagggtcccggggcccaggccacggccgcttccccttccccatggcctccagtgccctcggtgggccctgtgcccagtccccacttgctgtgcctcccccaggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtaggagagcaacggaccaggcatgtcttccacacggcggttcagcgtccccagtcagaaggggcccccggtgtcaagagctgtgctggaccctggaaacagagtggaggacagagctcactctttcccctggtgcccagtgacccctccccccgctccctcctcccgggctccacgctttgattaatgtgtcctcaggttcctcaagccacaaaccctggagcagcgccccctcctctcccacttaggcccagcccacaggcctggcctggccactgcgcctgcttcgttctttctctccctgctaattgcatggcctcctttacttccgtcctggaaggatgcagcctggcaggtgcccctgcctttcgcccagccagagccatcttcccacgcccctgaaccacccctaccctccaggcagcggttctcagagcagggcgcactaaaatgcacgttcccagggtggatgctccgaggggttgatttcctggggctgaggtgggacctggcagtctgcacttagacaaaagcccctggaggccgtgacaaagtggcaccttgagaaacacctgatggagcaggtcacctattcacagccagggccctgcctcccccacctcaccacccaccccctccgcagaacgcccttttgtgtgtaactgcccgcccctcaccccaggaagtcttccttaatctcctgtattgtttctgttgttgttgtttgggctttttttttttttttctggagacagagtctcgctctgtcatccaggctggagtgcagtggtgcaatctcagttcactgcaacctccacctcccgggttcaagcaattctcaagcttcagcctcccaagtagctgggattacaggtgatttctaccacgaccagctaatttttgtatttttagtagagacagggtttggccaggctggtctccaactcctgacctcaagtgatccacctgctgcagtctcccaaagtgctgggattacaggcatgagccactgtgcccaatcgcctcctttaaatgtcctcttcacctcccttcccctcccacccctcatccccccaggcatttgccatggtcaaggtttagccctccaaagtccctgttactggtcagtgtagaatgtcctgtcctgaacacaaaagtcacctcccagaccactctgctgcctccctccctaagaaggggtacagcccatcctggacttcccctaaaatcccatctcctcctctgcccacccccttcagccaagagtggcgcaggcctcccctccccagcagtcccaattagcctgactcaggaagagagtcttcccctaatggcttagtctggctgcgcttcactttttctttctggccagtcactttctattccccacagtctggttctgcaaagaagccctgtagctctagggcaaactcaggacaaagcctgcaggaggcagcccaggagccacccagccgctgtcctttcatctgcctccagccccgccccgcgctgcctctcacctgagccagcttcctgggaaacaaaagtaggagagagagctggcaagcaactgaggaccaagcgttggcagtggcctggggacaggagagggctgtgcggaggacaggctgttctatcctgaggcttgaagtgtcccaggctgagaggtggggaggtgggaggagataaagggcagagggttcagagaaggtagtggagggcactctgagaaagaaagaaccagccgggtgtgggggttcacgcctgtaatcccaacattttgggaggtggaggcgggtggattgcctgagcccaggagttcaagaccagcctgggcaatacagcaaaaccccatctctacaaaaataaaattatccaggcatactggtgaatacctgaagtcccagctactcaggaggctgtcgtgggagaatcgtttgagcccaggaggtggaggctgcagtgagctgtgatcgtgcccctgcactcccgcctgggcaacagagtgagaacgtgtctcaaaaaaagaaataaagaagccatcctcccacatggtgtgggtgcagggggcggtctgcaggcggggaacatgcagccaggcagtggctggactcgctggaagctcctggccccggagaaggtgcaggctctgtcctcagccctgagtactgtcctgtgcaggatgagtacagggtcctgagggctgcctgccctaccatactccctcaggcgtgtccaccccacctgaccccgcagttactctgcccttgtgctgcagacaggctgctccatagggaaggaaggaaatggtgccctccaatgctgtggggtgggcataggggccaggcggggctgccaggctgtgtgagcgatggggtgggcatagtggccgggtggggttgccaggctgtgtaaggagggcctgctggccctccagggccctgggggagcatcagtgtgatgctagactctgctccacagagaccccccaccaacaaaccaggtggccacccactcatgcactggttccctccctcatcccctaagcacagaggaagcacctactgtgtacccagctctgggggtacagagccccacctttggtggggagcaggattggaggtgacagcatgtggggtcgggattctggacgggcacccccaagagaaggggctcagagccccttgcagacagatacctggctcactcctctcattgctggagtcacctcctctcatctgctccagctcctagggccggctccctcactggcccacatcccaggctgctcctgacgtaccttcattccaggagcgcggcatggggcccagtccttcctccctcctcctagcagcacaggccccaaggcctcctggggcataaaccccctctccccttgtctaacctaataggaaatgcagttggggttgggggattttaggcaggaatgagggagggcggacatcatatcacctaccaggagggagaaactggactcttcagccccgctccgaccaaccccctcctctcatgggcccactctgccatcatcgcacccacctctattccccaccatccaggacacagccttcaagccttaccttccaaaaggcccttatagagggggaaacggaggcactggaaggctatgtgaattgatcaaaatcacccatctaacacgttctgggctggaacccaggtctcctggctctactccagggacctttctggaccattccatttgtcttctgccctgggatttggaatatggagcataggggtagcccagggggacaacagtccatcctggcaggcccagcctgagatgcactctcaggccgcgacatttgcagggcttcctggcggctctctgtccagggttggttttgtcacccagtgttcctcctcgagcccagggtgacgggctgggtggctgttctgggttccatacatccctcgcctctgtgtgctgtctgcaggtgccccaggaccgcctggcgtgcccatcatcgtgcggtacagctctgccatcgccattcactggtccagcggagacccgggcaaagggcccatcacccgctacgtcatcgaggccagaccttcaggtgcgccccgccctgctgggctgagaccccacagctcattatctcccttcttcctgggtccctccacttggggcacttgcctctgtcctccgcctgagaaggcgcttgtgctactacaggtgaagtcacctggccctgttgaggagtgggaaactgggttggggggctcctagagctggactcctagctaagtaacccccaggaggcccccagagaacggctgttagtgctaactgaggaccagcttgggttgaggattgctcaggaagccggaagcctgagcacgtggctcacgtgggtcacacaccgaatcctccacacgaccccactgatgggtgccccataactaagaagaccctggctgcctctcgaagccctgtctctgccatcatggctgtctcagtggctgctataatcgtaccagcctctcctgtcaagcctgaaattgaatcacaagaacttccaaagccatcaggagatgagtgacagataagtcagtcggggggctgctccccactgctccggtttcacccatcctgacacccgcttgctgggctctgcttactctcaggagcttgcagccactgccagctccctgcgttgctaggtttccaagttaatcagaggtgccagagtcagcaagagcaggaggcctgttctctgtatcccatggatccgcggttaggtgattaaaattgagaaggaaaacaagattttgttgctctagcccaaatagcaaataacaatcataatgggacgccaccaggcatctcggtagctagtacttctaatggggaatatggaaacatcccagtgatgaattgttaatacttcgaggtagctgggcactaatcatcccaatagcagagagttaataattctagtagctcctggaagacattaccaccgctcctgccttaatcacatgctaataatcgcagttgcatatagcgaatacatctagctgctcagatctgctgcgtggccgaaggatgcatgcggggctggctctctccccactccagatggtccctccctggccctctggtgccggctgctgagttggccaggagaccactacgtgcttctcccaaccagggcctgcacctgtttattccacccaagttggccagttggggtgccaggctgtggaatgttggcccctgactctggctctgttgattctcagtgtttcctgggaggcccagcgtgggactctggtgttccaagtttgtgggctgtgacttggtccacactggtggaatcaagacctgagcataaaaggaaggaccaagccagggccctgtgagaaaccaggactcggagcagggccagggccagagagcagaggacaggatcagtaaccaggcacagggaggagggaggagagggggcaaggggcatggtggtctgtccctaaggctgtttgagagcaggctgctgttatggggtgagcatctctcccctccatgccccctgccccttcttctgtgctccccttctcatcttcaggatggcatagcccttgtcatacatttgcccttgaattgcttgtgcttcgtgctaggcaggataaactaaatacaccccctttctataagccaggagctgccaggcgctgcagacccagggagaggttcgcccagggatttgcagccccaggaacccgtcctgcacatcagccaactcccggggctggcggctagagccccagcgtgacattccagcagcttctggcctggcccggttgactcagccccaccctttgtccctgtgtggggtggaacaaggggggttaaacagcaggcaggagatcccagcttctggaaggcagcagcaggggcctcaacgatcccagcccatccagcaaacacaggtccaacacctgactgcgctgggcagggaagttcggtgccagaaatgaggtggccccaggcagtaacaccagctctgctgctgacagcgtaggaccttgggaagatgagtgaagcttcctccaggccttggtgtcctcatctgtaaaatggggacagtagttcatccctctcgccattgctgtggatttgaaaaggaaagcacgtagacccaggatgcttgacagaggcgtaagtgccagctgttgtcaccgtcatcatcatcattatgatatcattcaaagatgagtgagagaattcagaggcatgtgaggaaaatggatttgtaccccagtactaaaatttcaaggcatgaagttccgaaactgggcagctaatgctatgaaaaggccagggaggaaaggttccatttatttattcaataaatgctgagaaggtgcctgtgctgggtgctggactaaggatgacttaagacgaattagtcatgatccttgcccttgagggatttcacagccagcaaaggggaaagagagaaagagagatattaaacaaaaagatgggtcaggcactgtggctcacgcctgtaatcccagcactttgggaggccaaggcaggcggatcacgaggtcaggagatcgagaccatcctcgccaatatggtgaaaccccatctctactaaaaataaaaaataaaaaataaaatagctgggcttggtggcgtgtgcctgtaatcccagctactccggaggctaaggcaggagaacccggaagccggaggttgcagtgagccaagatcgtgtcacggcactccagcctgggtgacagagtgagactctgtctctaaataaataaataaataagttagccgggcgtggtggcgggtgcctataatcccagctactcaagaggctgaggtaggaggagaatctcttgaatgggaggcggaggttgcagtgagccgagatcatgccatcacactccagcctgggcgacagagtgagactccgtctaaaaaaaaaaaaaaaaaaaaatatatatatatatatggaggtgtaggaggcagaggctcaaaaacaagtaagaccaacagtgaggccgaggttcgggaccccggagccttctgcaaggacagctctgatgtagactgggtccccatggccttccccaaattggaaggatccacactggaagtggggagacagccccctcagcagttcccaccactgggtccaaaattcagacaggacgccagggtgtcgaggcgcctctgctgcagtgctcgacttacacggctgggtctatgagaaagtatggtgaggaaaacaaaaccatcagccctggggaagggcggccttgaactgggcacacctctggcgggagagcagcttcaaccagagggtgcagaagcagaacggcgagaagaacgggccctgcatgtgagactggaggtgcttggttggggcaggctaggggaagttaaggccttttagtccctggtggcagcggcctggaagacccactgttggccactgggtgacctccctggagcaggccagacagagaggacctgcgagctggcctcactgacgtccttctactgtgaagaggggtctggctaggcccagggtggcttggatacctcagtttccaaatcagccccgcactgccaccagcaggaagacgcaccctctctcagggccaggctgaccccatcagccccacccagagcatgcagccagggcccctcctggccttcccaccaacatgatggatgccccaaggctatgtcaggggcttgcctcttccctgacccaggcagcacccgcaccgctctgactgaacagcatgaaggtgaattatgtcccacgagggcaaggcccagagagccacggataaagaggggaaggggatctgagggaagcgcaggtgcaaaggacagaggtggctgacgccagcacagggtggagaacagacaggaaacccaaatttttcctgttggctgagcgcggtggctcacacctgtaatcccagcactttgagaggctgagatgtgaggatcgcttgagcccaggaggttgaggctgcagtgagccaagagcacaccactgcactctagccttggcaaccgagcgagaccctatctcaaaacaatttttttaaaaccaaatctttcctgcagctgttactaaaaagaaaagaaaaagaccgggcatggtggctcacacgtgtaatcctctttgggaggccaaggcaggcagatcacctgaggtcaggagttcaagaccagcctggccaacatgatgaaaccctgtctctactaaaaaatacaaaatttagctgggcgtggtggagtaagcctgtaatcccagctatccgggaggctgaggtaggaaaatagcttgaacctgggaggcggaggttgtggtgagctgagatggcaccactgcactccagcctggatgacagagtgagactccatctcaaaaaaaaaaaaaaaaaaaaaattggccaggcacagtggctcacacctgtaatcccagcactttgggaggctgaggtaggcagatcacctgaggtcgagagttcgagaccagcctaaccaacatggagaaaccccgtctctactaaaaatacaaaattagtcaggcatggtggatttggaaagctgaggcaggagaatcgcttgaactcgggaggcagaggttgctgtgagccgagatcctgccattgcactccagcctgggcaacaagagcgaaactctgtctcgaaacaaagaaaaaagaaaaatagcgctcttatttttgtctcctgccaccattgtgtatgttttgaattaggaaagggggttagttaagtaaagaagggtattcccatatgataatgtcttaggcagtcacttaaaatcatgtttccaaccatttttaatgaagtggaagacagaatccatagtgttctgcttgcacaagtgctaattccttgagcctgtttctctggacggtggttctgtcattggttgtgacagtactttctgcacagtacgtatcttttaatgtagtacagatattttaataaaaagaataaaagagatgctccaaaaggtgtctttttttttttgagactgagtcttgctctgctgcccaggccagaatgcagtggcgtgatctcagctcactgcaacttccatctcccagcttcaagcaattccctgcctcagcttccccagtagctgggattacaggcatgtgccaccacaccagactaatttttgtatttttagtagagacagggtttcaccatgttggctaggctggtctcgaactcctaacctcaggtgatccacccacctcggcctctcaaagtgctggaattacaggcatgagccaccgtgcttggcccgaaagttgtctttttaagaaacttcaagggaggaccaaggcctgcgattcagtgtggagcagggaggatccaacaggcccagccctcagggagcatagtcagaacggggctgggagcgggatttggggcttcccctcacctcccagggcctccatctctgtgctcctgcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccaggtaccggcctgggggctgagggagtgggggagccccacagcagagcctgggggctgacactgggcagggcggaaggaggagaggcaccagggcaccaggagcatggggcgggaacaaaaacacattgtcccctcggggctgtgaagaggcaagtgctggtgcccaggcctgggtcagccctcaagaccagaggaaactagggatcttcatctttggggctccctttcaaggaactccagaagccctgggtaggggcagagcagagggcccaagatgcaaacttccatgcactcatcacccaggacattcatgggcaccaggccataaactatctttccatggaaacctccagccccaacgtggcagggtcagcagcctgcagagcagcagagacacaggtgggccttaggcctgacctagtgcctgggtgcagcagggtcaccacccctcccattttcctcccctcattcttcctatctggcatgtcttggagcgcacaaagggctctgctatctaaacccttgacccaaaatgttatcactaaccaccctgaatacaaaggccccttcccccaagcagaagcacaactcaaaggaacccagcctcctccccctgccacacattgcccacattgaagaaccaaatcttctcctttacccacattgataaaaccaaatcctgggacagaagtgcttcaaggccgaaacagagagcccatctcttgtccacacagcatgggtagtcctggctgggtgcagaaagcacagtctaggggttttgagaaaagggagctctacctggaagagacatcctaaagaccctctcaccacactctggtttttcttcagatcgtgtaaatctttcaccttttactaaagaacccctgtgtccatcctcccaattccccctgccttctgctaccagcaaaaatttcactccaaactaaacctcaggaaaagctctctcatcctcctgcaggtcagagaagcacctttccccacacagatttaggtatgcttatcaagatagctcctagacaagtacaaaagaaaaaaagaaaaggggccgggaacggtggctcacgtctgtaatcccaacactttgggaggccgaggcaggtggatcacctgaggtcaggagttagagaccagcctggccaacatggtgaaaccccgtgtctactaaaaatacaaagattagccgggtgtggtggcaggtacctgtaatcccagttacttggaaggctgaggcaggagaattgcttgaacccgggaagtggaggttgcagtgagtcaagatcatgccattgcactccagcctgggaaataagagtgaaactccgtctcaaaaaaaaaaaaaagggggaaaagtagctaacacactgccactctcccctcctatgtccctggcagacatcactaatcaatcttagcactctttcctattgagccaggtagccatctcagaactcatctgacatcagccctccaggcagccctttaccgactgatcagagcggatacttgaggtgaaactgtccttacagaggttctgcctcattcggagggtacagaccctgccttctcatagattgtagcagttagtagggtcccaactggagcaggagatttggagggaggagggggctgagcaccctatatacctgaccatctgtgctccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcgggtgagtgagctggcaccagccatgctggctggacttgacttttatgtatctcctttttggccagaacaggggtgatcaggtccctctcctggctcctggcagcgcacctgctctggtgggtggggcagcctagggtttctacacacaatctcaatctcttattttggtctcaactctaccaagagaaagaggggataacccagccaggtggagagtggtatgggagaggggaggccacacagtctaaagggtgtcaatctcccgccgacttcagggaacagtgccaagtctggagccctaggccacagcgagatgatgagcttggatgaaagcagcttccctgccctggaactcaacaacaggcggctctccgtcaagaactctttctgccgaaagaacggcctgtacaccaggtactgggccctctgcgtgggtggggggccaggcccagcagtgcccgggtggggggccaggcccagcagtgcccaggtggggagaatgctggggaaggccatagagcagggagtgcccacctggccataccttgtcctgggaaacaccattcaagccccagggctgggaacgatcagcagaaagacacagtggggcccaagcaggacaactagggtcccagtccccaccatgcccaatcacagcctggggggtgagggcgcactggggagaaatttacaaggaggtagctactaagagttcctgacagtgacagtggaatgcaaataactggcaaaatttttcaaaccaacctactgatgttcggagccaactgccagggaaacagccctgcagatcgtcactggccccaaaggcaagacaggcccagccaacgcagaccgagcaaaaacaccttagcgaaggacgcctgagcacccgcattatcgctatgccctcctgtcttcctccccatttgggaaaccctctcccccaggtccttatttatacctattaaaggacaacctcctatccccatcagcctcaaagggcagcatctgaaagcagcccatgaggacaggacaaggctcgtggcgcaagcacagctcctattttcttctgacttctttctaaccccagccccctcctaggccctactccctgtggccatcgggctgcccatttccaagggcaggagcagctgctggggcccacctgaccctcccctgatgtgtggcggttttctgttcccctgagctcaagaaagactgggccagagggctcctgtctccagcctcagccctattggcattcccagctcattggaggcggcagtcaggaggagtccagcctctctcaggagctcacaaagcttccctctgtctctgtcttagagggacgaagctatgtgtgtgttcatctagaggatggagggaggagctcccaaagccgagctcttatcctctgccaaatccagccttccaaagaaagagctgtttgaggcccccacagcaggcccagccaggcccagcatggccatagcagccccgccaggctggctccggggccctgctacatgtaacaagggggcatttcacacgtggcctcaccttcccctgcccttcccagcctctcctacccacagtgcacacacatccaggcccctgtgtgcccccaaagccactgtgtgtacacaaaaatcccgtttgcaccaaagcagccccaggatgtggggtcctgaacccagccacagtgacatcccccctacattcaccctgcatgttgccatgacagcattagccggtcaccccatttttccctctttgtcctcctccagattcctacctcccaggcccgggcccctggaaggcagacccaggaaggaggaggagcacagggtggcagggatccgtgttccccaggcccccactgtggtctccctaggccaggggaggccgctctgagtgagtgcacctctcagccccactcccccgctctctccaggtctccccccaggcccagcccaggcagcctgcactactcggatgaggatgtcaccaaatacaacgacctcatccctgcagagagcagcagcctgacggagaagccctcagaaatctccgactctcaggtgagggcaggagggccaggtgtcctgcagggggcagggagcagcgcctcccagagtggggcagtgaacgtagatgggctttcttcctttccttcaaggggcagcaaatattaaggggcccaagaaaccaccctgaagtcatatatgggccatttgtcccctcccaagttctgctcaaagtttgcggccagtgccaatggggtcccgggaaccttgatcatagggggtaccccgaagaagacggccctctctacgttcaggggtcaccccacaggcttagttactcattagggctgtcctgcaagagagcacgctgaaggtgcggagagggagactctggggagaaggttgacacacagccctgcattccaggccagagacctggaaaaatgctcagcttcactactcacgcatcaaaacagcttcagaaacaaagggctgggtgccctggagccccgaggatgagaagcagtgtagaccagggagacattaagctttggaggtttggacctgagtgtgaatcctagctttgctgctcgtgacctgggatgtcctgggtgtgccaagtaacctttctaagcctcagtttccccatctgtggaacaggcaggggtgatactaggctctgtccgaggctgtggggaggatctgctgagttagacactggtgaactcagtgtagagccaggcacacggcaaccattccgtaaatgtcagcttttatatgaagagggggtcggtgcctctggaagacacagagcttcagagagcggccattaggtgggtcacgtggggacactgtcccaggctgtgtggggaggggctgtgtgtattccaaccatgcagccttacagcttcccaccctcaccctctgcctcagccaagcccagtggttattgaggaaagggccacgaaaggccactgcatcccacgccctggacctttctgcccaggcctgggagaggaagtgaaggaagaggtgccagcagggagctgggctgctggctgtgcaggaggtgccaggaagcctgggatcacgctgtgggccccgtgggctgagggcctcccactcactgctgttttgttcagctccagggttactgatgggcttggcagagctgagaaggctggacctaactccctagctcaaagctggcagggacagagacccccaacttagcatggcttacccaggaacttattgtgggggacaaaacccacgtgatccaagttatgagtttttttgttgttaagccagggtcttgctctggagtgcagtggcgcaatctccacttactgagacctctgcctcctgggttcaagtgattctcgtgcctcagcctccagagtagctgggattacaggcatgtgccaccacccctcactaatttttgtattttagtagagatggggtttcactatgttggccaggctggtctcaaatgcctgacctcaagtgttcccccgcctcagcctcccaaagtgctgggattacaggtgtgaaccactgtgctggccccactgtggtccttatgaggctcctaaataagtcagtgctgctgccactcagccacgtgagaagcagctcggctaccaatcagcatctgcaatgcggagcccccaccattgcgaccttcaagtgggggctgatggggatgccactggtagttctcctgcctgtgacagtttgtgcaagggtacgtccctgaggatcagcagctgcacaggccagggcccctcggtttcagccgccaggaaaaatgactgcctctcttttcaaggacaccccttcccccaggtctttggagagtgggttttgcatacgccacctggtttatattctgagacagaccacccaaaacccactctccaaaattggcagaaatctgcccagtcgttttcctgtgatatggcaataaacaaagcatcagtttgacttataaacaaacacatatgatgtgatgtgagaaaggctataattcagctgggggtgatgggctagaggagagaggggctggctctcccgtagagggcccagggtgcaggagaagggggcaccaggcagagggcaggatgcacacaaagactggagatttaaaggcctgtttgatggaactttaacactgcagcctggctggacggcaacttcattttcaaaagaagagcccaagttttgtacaaaaaaaaaaaatgtatatacttagcacacaagtaaatctcaatggaaaagaaattccgagccaatggcacacaccatctaatcttgatcttcagttcttgcagtatcatggacagcctcttcaaatgcgttgaaatcaaattaagcacactttaaaaaggagaaacacagagcaaatcatgttttctttttctttttttttttttttcttgagacggagtttcgccctcgttgcctaggctggagtatgatggtgcgcgatctcagctcactgcaacctccacctcccgggttcaaacaattctcctgcctcagcctcccaagtggctgggattacacgcgtgtgccaccatgcccagttaattttgtatttttagtagagatggggtttcaccatgttggtcaggctggtctagaactcctgacctcaagtgatccacccacctcggcctcacaaaatgctgggatcacaggtgtgagccacagcacccagccgtgaatcatattttctgtactatttattatgcaccgatttataatagcaaacatttatgaagtgttcagtagaagccaggaaggattctaaggattgttcgtgaatgacaccacctaagcttcagagtcctctaggaagcactggtggcattaaggccatttgcaagtaaagatgatgaaaaagagagttgggaaggcccccacccctgacaacaagcccaaaatgcatcccgcccccattctccctattgacatctgccctgcataccagcacaggtaagactctgtgtggtacgtgggaggagtaagtgatgggtttgctctctatgaagctcattcattcattccttgatgcatttactcaacagctatttgttctgtacccacaaaatggaatcagacgctatataggaacgatggctacagtagtgggcaagacagactctaatgaatgttgcgttataatatgttatgatttactagggaagaccatacgtgtataaataaccacgttttcatttctcattcaaatattatggaaccacagcaacctgaggaagaaagtggtgaacaaaagtctttctctttttttttcttttttttttgaaatgaagtctcgctcttgtcccccaggctggagtgcaatggcttgatctcagctcactgcaatctctgcctcccaggttcaagcgattctcctgcctcagcctcccgaatagctgggattacaggcacctaccaccacaccaagctaatttttgtatttttagtaaagacgggatttcaccatgttggccaggctggtctcaaactcctgacctcaggtgatccgcccacctcggcctcccaaagtgctaggattacaggcgtgagccaccgcacccggccaagtctttctgtttctttcctgcgatgcagaggcagataaagcaccataaggagaccacttcccctggaggctcagagagggctgcctgaaggaggtgtcatttatttgagctgggcctcaaagtgtgaacagcactgggtcatgcctagaagggaagcgtgcaggtttgcagctggctggagcagggttatgttctgccgtcaccattctactgaacggctctgaccttttgcctgtgtttgcctcttttccatcagattgggccatgagtccaacaggctcagctgagacctcgttgatagcctgaccatcccccagatcctcgcagcccaaagttgtgccaaacaagaaacgctgtggggcagagacaggccggggagaggcaaagctacatactgtgtgccaagccctgtgctttgtatattctcatttaacatctagctgtcctgccatgcaagtgaaactatccccatttaacagctggggaaactgaggttcacagaagtgaggcagtatgcccttggtcacagagctcagaagtacaagcaactgggattcaaatctagagccagcttgcttggagggtcatgcctactgcagcctggcctcgtgcagctgcccagcacggagaggagattgaaggaaagaggccttcactgcctccaaccccaccccagtgacctcccttgagcctcctgaccacagacatctctgacagccggttgtgggtgtggggggagggatacacattggctgtcactttacctataagggcacaggtggcacatatgacattgcttctgagctgacatttttcaaaggacattcttgggagatttccagctatcttaacacagggagcccagagcctcgacaaaattgtgcctccaggggcacaattctgaggttcttcagagacacacaggagacacatcacccctaccccacctttaatccagaggctgcagcccctgcagagagaccctggctggccccccgggtagaggcatccaggggacaggcggaacaccccgcacagatgcgctgccggcttcaggctagagtcagtgcagagcccctgggaccgtggatgagggaggggctcctgcttccagtctcccacggagtttcacaaggtgacttctctgtcatctagggcaacacattcctcccagacttcatgagattcaacaagataagggtcccctgcctgaccccaaggtctcaacaccatccctaaggctgagtctggtgccagatcctttgggctggagatgaacaaaaaagcaaaagggctttgctttgcttcctcttttctccaggggtcctgcctccttctggccctccctccccactcccatcaccaggcctggagtctgtgctccccctccgcagaccccagtaattgctgattgagtggctttgaggagctgttaagagaccagggagacgaagcagtcacttgattgcctggcggcctggcaggacagcccctgaaaggccccctttgtgctgggccggtccctgggaagctgcattcaattaccgaggcccgtgagaattgaaagctgcaataggagcccctggtctccccctcgctttcttctcttctcgccctacccccactccgaaaagaaacagatgttcagggagatggaggcgggagcagcagtcgctgatgcaaagccctcctgccttggctttggaaggcggagcgggggaagaggcagaccagactctcgcctgcctggcccctcccgcagcgcgggctctgtttggctccctgctctcccttctagtgccttccatccccgagatgctgcccatagagtgcctgggatcagtaggcattctgcagatagtagctggtaggacggggatggtctagatgagtgggctttgggatctgggcccctaggagggctagagaatcccactccccaccttgcttccagtccggacatgcccctgtcttggagtcgggggttagtgggtggggtatcagctaaccttctactcccattccagctgcctgagcactgagtcagcctccccggcttcctggccccttctaatccctcccaggggagctttgaggcttctcactccatctcttccctttcccacccaggcccaccctcactgtccccattgataataccttttacagcattctctcctgggttagctcatttcaccctgtgaactatggaactctacccattttacagacaaggacactgaggctgagagagcctgagtgatggcttcctctgctggtaagagccagaacttccccgtgccacaagctcctccccccagagactcgtttcactgtgggatggtcccacagtcacccaggggttccttcctctgcaaagctggggcctggggctagccaaaattctagaacccctggagctgatgctaacaactgttcaagtcagttagtgggtggaaagaccgaacctgtagggaaaactgggggacatccctgtctggtcccccgcattcacagaccctcactgttcctgggcgggatggacccccagcctcctgcctcacagatccccgctgctccaggccagcctcactcggcccagcatcaggtgcccccgctcggcatatggagtctccctggcctgcctgtgccccctctttgttctcctgggcgggcagctgggcagtaggcacagaaaggggcttgtattgtgctgcattgcgtcatggggcagaccgagcccagggactttccattgtcttgggcagccggctgtgcctgccaagaggattgaggtcctggcgggggagtgtctgctgcaggggtggtaaggagagtggctggggttgtagaggggtgaggagagggaggggaggggccagagaacataaattagcagatggactagggagtatttaattcctgctgggagtcggggtggggggtttggggggagctctcgttcccatcctgtggtctccaggcaggagtgcaggagtgtaggagttaagaggtgtgtgggctttagaaaatcaggcagattggagttcaagcccggccggatcacttccccagcaaaaccctcacccttcctgtactttatgtgcccgtcagtacccaggcagcgtcggtgctcaggtagcaataggagctgccgcacagaggtgtgaaaactaaatacagttatgcatgtcagcgtttcagactgtctggcagagggcctgctccattagcggggatcattatagttctattcattgtagctacatccctcgagatgtatccccatgttatgaaggactccgagttcctgagaacaagccgtgcatctcatttcccaaagcccagaccctctggacaaaggtccccactccattttctttacctgtaaagcaggacacagctccccatcccaaacttgtctggattgggctaactggcttttatgttctacttggattgctgtgattcgctaactgcccccaggcaggggcattagctgggcaggactgaggaggcctgggtggggtcctctgagctgcagtgcactgatcgtgtgctgtgcgctaaaatcggagcacttctcttccagagagttctgagggggggcccatctgttgtcttattagctctcaaaacattgctgggagctcagggtaggggaaggggtgcaccatgtttttagctccacaattcagattttactttccaaccgagattgattcttgtttggggctgatgtccccaatagatagatgaagcctgtgcctaggacatcaaagtgtcaaaaaaaaaaaaaaaaagtcaggaataatttaatatttttatctttaaaagtaaaaaagaacttcaggctgggtgtggtgtaattatgcctgtaatcccaacactgggaggccgaggcaggagcatagtttaggcccaggagtttgagaccagcctaggcaacaaagagagacccctgtctcttaaaaaaaaaaaaaaaaacagaccagccacggtggctcacacctgtaatcccagcactttgggacgccgaggtgggcagatcacctgaggttgggagttcgaggccagcttgaccaacatggcgaaaccccatctctactaaaaatacaaaaattagccagatgtggtggcacatgcctgtaatcccagctactcaggaggctgaggcaggagaatcacttgaacccgggaggcagagccaagatcgtgccactgcactcaagcctggacgacaagagcaaaactccatctcaaaaaaaaaaaaaaaaaaaaaaaaaaaaactttaaggttttcattacatgaaaattctgaactttggtttagatttttctcatgcttagtttgtaaccaagtgttgtttttatgttggatcacacgtggacaggcacaggcatttttcactgtccagagcctctaaaggtcttaattaggctctggctttgtccccagtcacaaagtaaagcagaagctggaccaagatggtaacttagtaggttgtggttgaacctcaaaaacatgacactgtgtcagagaagccagacacaaaagaccacatattatatgatcccatttataggaaagtcccaaataagttaatccctggagacagaaaacagattagtggttgccaggggcatggatatagggagtgaccggtaggggcagagatagggagtgactgcttcctgggtacaaggttttactttggggtgatggaaatgattcagggctggatagaagtggtggttgcacaacactgcgacggtcctaatgcactgagtcatagactttagaatggttcactttcggttatgtgaacctcacttcaattgaaaacaaaggtagactgggcacggtggcccacgcctgaatcccagcactttgagaggccaaggcgggtggatcacctgaggtcaggagttcaagaccaacctggccaacatggtgaaaccccatctctactaaaaatacaaaaaattagccaggcatggtggcaggtgcctgtaatttcaactactccagaagctgaggcaggagaatcacttgaaccgggtaggtggaggttgcagtgagcccagattgcaccattgcatccagcctgggcaacaagagtgaaactgcgtatcaaaaaaaaaagaaagaaagaaaagaaaacaaaggtaaggtaaagtagctcacgcctgtaatcccagcactttaggagaccaaggcaggaggatcacttaagtccaggagttctagaccagcctgggcaacataaggagagctcatcacaagagaaaaatttttttaagttagtggggcgtggtggcatgcacccatagtcctggctactcagaaggctgacatgggaggatagcttgagcttaggaggttgaggctacagagaggatcacaccactgtgctccagcctgggcaacagagtgattccctgtgccccttccactccccgccccccaaaaaaaagaataaaaaggaaagaaaatttgccagggatagtggctgacacctgtaatcccagtactttgggagggtgaagcgggtggatcacttgaggtcaggagttcaagaccagcctagctaacatggtgaaacccctaaacataccaaaaaaattagccaggcgtggtggcacatgtctgtcatcccagctactcaggaggctgaggcaggagaattgcttgaaccagggagtcagaggttggagtgagccaagatcatgcccatgtactccagcctggcaacagcgagattctgtctcaaaaaaaaaaaacaaaaacaaaaacaaaaaaaaactcaggtcttctgattctatcaggtatctcccagctctgggccaaccccatagtagatccttccggttccggatctgctgtgaaggaagcagcaggcgggcacaaacgggcaccagacccccttggcagtgagggggctgggaggcccacagtccaagtcttgaaagaggcagagcagagttttgaaccagaatgccctgtgccttccggccccaaccacaatggcctgtccctacggggccactgacacaccctgattctctgtcctcccagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacatggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaagccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatgacactttgactgttctctttcttccaatccaggttccatccgtcctctctttaaaggggtagtcagcttcccaaggctggggagtggggcacagctgagggatctccctctgggcagacacgtcactctccactggatagatcctcaccacacacacacacacacacacatctcccatgcacttacaaggaacagggtctagggatcctctccagaacaaactcatctgggccctcctagccagacagcacactcactttcagatctgtgtccctctcgctgccacccggcagcctcctaagcacagaggcacaggagcccagaggggtggcccaagtccctggtccagaggctggaatacccagagtttgctcagtcagcctagcacccagtttacaggcaaaaaggcaaagacaccctaacccccagtaacagcttccaggctgggctccgcctggccagggcggggaggggaaggggcaggtcaggaagctcagtccaaagtggacccagcatttgaattgcacgcccagcaggggcaggtcagatgggaccaagtgacaagaatagctgatgggagggaatgcttttacacacacacacacacacacacacacacacatacacatacacaatctgctccaaggagtgttctgcaaaaagccacatccagtggccaggatcttcccgtccacttggtacttacggatgccagggtttagggagaagcctttctatctaactccatacattgtccaaggccctctgtgccctcagccagccctgtaaggccagccctgtaacacctgccccaccgctgagatgggtggcagatggcccacaggggcctgtctgattcagcgtgagccccttcgtggagcagggctccctctgtgcactgtgtacaggcgctgctggccctgcccaagagatgatgctctgttggggtgggtgagcagagttcaaggaagcccaagtaggagatttgggaaacatgccaaggtaagagagagcctggaccactctcctacagccccaagtcagtcactgtgctaatggtgaccgggaagggaagtcagggtctggggcccaaagaacgggcacacccagccatgagtttttcctgaagcacttgacccctgggaaatgtgaacggggagatgctggaagatggctcagcagacaggccagcccagctccagtgtccaaaaagcggtttctccaataaggaggcctgggaagggaagcacaatcttccccaaaggagaaccaagggctgaggttctgcccctccaggaagtaaggtgctctcggggcctccttggacttgtctgggggctgcagtggagtcagctggacacctgctccacccctgccacctccgcccccaccctctgcagcatctggcatctccatggcagcacatctgcagctgccggcctgtgatcgtgccgcacagctttcttttctttcctctcatcttttttttttttttttttttaaataacttcatccctttccctctctgctgagcatttaaccatttaaggaagttcccagtttgcattagggaattatttaagcccagcccagtgacggattatttgggaggaagcaggagtgagtaaaaacattgtgtctgtgtatatattgcacatgaggtcaattttcctttgcctttaatgaatcacctggtgcactaagatattccacccccccactccccacacgctcattcgcacccatgctgacacctacgtgtacatgcgggatggtgcccatgcacgcctgtgcttacacacatgcacacacaaatatgcacagaacacacatctgtatgtgtgttagcaaagagactcctgaactccctctgatggctgaagccatctctcccctgtgaggcacaggtggcctgggttgcttgcacttggggcgtggctgggatctattgtctgagagggtgaggacaccacgcaaatttagacaagcccatgagatcaggctgggcccatggtgaaagtcccacacttagtcaatacccactcatctggaatattgtctccacagccccagccacagctggaagcccaggcctgcagctgtggaactctagattttttcaggacacgtctctttgcccttgtttacatatctactggcacagccgaggctcccaaccgtcctcccagacacctggccacattagaaaggggtggtgggccctgccctttgtagaaagagtgggaccctttctggcctgtgattttccatgccagtgatgccagggcccctgcctgtgggactccacccaaagcaggttcacaccaggacacacctggcacctttggcattgcctccctgtgccctaagcaatctcccagtgttgcacccaggagcccatgctgggcacaccagggctttccccttcctggctgcgcctccagagttgacgtcagctccacacccacactgccaagacaaaccaaaaagatgctctgggctccagaaccaccatcctcctagggctccagagagtttgcaaacccaggctgcctccccttctgtccatccctcaccccccggcccccaaaactcctacccccaaacctggcactgccgtgatttagaggaaacaaggacacagcgggggctgcccccacctggtgcacgctgcctcaaggccttctgttgctgcccacgcctccctgggcagtgcttctaaaggtgccagagcctcaccacagtgccactctggctgggcaggggcttccctcagcttcccagagtgcacatctgaaggtgcctaccctgggtgaggggctggtgggcaggaaggtaaaggggagaccatctgagcagccgccacccgctccccagtgcctctgtatggccctatccagggacacccatgggcatgcgcacatggcaatcctgaccaccacctgagcacaggtgccccctcgggaccaccccccttctctttgtttccatcagaataaccaaaagcatttaaacgtgttacctttctccatccatctagactccagaaacaaaaatcaacacaaatctttattttttgatttaaaagatataacaaaaaattatggggagagtattcattatggcaggtgtctgtctgtaagaaaaaaatatatatctctatgtcatatagcgtgttagcaggtttattttttaaatgaaaggtaagaaagaaattgatttgaaatatataccacaagaagtcccgtgtcctgtcaaactgtcagtattttataaataaacttttttttttggagatttgaagcaacattcttttccttcctgttacatgaatggggtcacctgtcccagtatcatacccaagcagttcattccccagacagcaatttttagccatgctgtgcttttgcagagaagagtcaagggtctgacttatctgctctcttaatgcataagtgagtgccttccagtgaaatgcactattttatttattttaaacttttagaataagaacctacttgatgcaatgtgcaaattatagtgaataataataatagcaatagctaatatgtctatggcattcactctgtgccaggcacagttctaatcactttacgtttattaactcatggaatctttgcgacagtcccaaggaggaaacctgggacagggagactttaagtggcttgccctcggggagtggtggagccaggatttgtactaaagccttctggctctcaaaacataatgctgcctctctgatattttaaggcaagctccttgtccatttttattttaatttctacagagctagcaccccacttcccagtgatcttaatgccatgagaaatgctatgttgtttggtggatctaacccagttaatctacccagggttagagttagggcttagattgctgaatttatgagtacagcggtgttgcattataccacatttatctcacattacttaagtcatgtggactcaatagactcaagagaaacagagggaaaatctctctctgtctcctttttttttttttttgaaccggagtttcactcttgttgcccaggctggagtgcaatggcgcaatctcagctaaccgcaacctctgcctccagggtttaagcgattctcctgcctcagccttcccgagtagctgggattacgggcatgtgccaccacgcctggctaattttgtatttttagtagagacggggtttctccatgttggtcaggctggtctcgaactcccaacctcaggtgatccacccacctcggcctcccaaagtgttgggattacaggcataagccaccgcatccggccttttttttttttttttttttttttttgagacagagtcttgcgctgtcacccaggctggagtggtgtagtggcatgaggcatgaacacagctcactgcagcctcaacctcctgggctcaagtgatcctcccacctcagcctcccaagtagctgagaccacaggttcatgccaccacacccagctaattatttattttttgtagagatgaggtctcatcctgttgcccgggctggtctcgaatgcctgggaccaagcaatcctcccacctcagccttccaaaatgctgggattacaggcatgagccaccatacctggtagggaaatcattttaataggacatgtaatgccactcaatgagtacacttattttgcacagtgtacattattgcataatgcacatcagacattcatacagaggctgcttaactaaccaaacacaactaaagcagggaatttcatatatatatttttttcatatatatatattttgttgtttttgttgttttttttcttgagatggaatcttggcctgtggcccatgctggagtacagtggtacaatctctgctctctacaaccttctgcctccctggttcaagtgattctcctgccttggcctcccgagagctgggattacaggagcccaccaccacacctggttaattttttttttttttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatttttatatttttagtagagatggggtttcaccatgttggccaggctgctctcaaactcctgacctcaagccatccacccactttggcctcccaaagtgctgggattacaggcatgcaccactgcgcccggcctctaacccactcttttatttatttatttatttattgcaactttctgtttccaaaacattgaacataattttcagaaaaatagttattctccttttctactcttattttatctacttacatcatatttaattaaattatgtaattactataaaaagtacaactggcataaacaagttcagaaacaatgataattgactccttgtaaacatacaactcaattcagtaggagcagacgtatgctggcctgatagaaagcagcctactaccttcagcattcaggctactgtgtacatctctttgttttgcaaaaggaatatagggtatccatcagtatggctagttcactaaacgggggtcagatgagactgcttctggacatatcacgcacaaaccgtgtatacggtactttatgaccgattttcaagggtaattttgactacagataattttgatcttatacatcatttggaatcccacattacacataaccccatgcccgctgctctgaggatgtttggttaaaagataataacatagccgggtgcaggggctcacgcttgtaatcctagtactttgggaggccgaggcaggcggattgcctgaggccaggagtttgagacccgggcaacatggtgaaacttcgtctttactaaaatacaaaaaattagctgggcgtggttgtgggcacctgttaatcccagttactcaggaggctgaggctcaagaattgcttgaacccaggaggtggaggttgcagtgagccgagattgtgccattgcagtccagcctgggcaacaagagggaaactctaagaaagaaaagaaaaaaagaaggagaggagaggagaggggagacgaggggagcggaggggaggggaggggggaggggggaaaggaagagaaggaaaggaaggaaaggaaagaaaataacatggaagacattctggacctggagtcagaagagtgggttctgattctagaatggtcccttgcaaatggagagacttaaagcatcttttctcaggggaagtgagtggcccctgatctaccaccaatcaggttattataaagatcaaataaaataatgggacttggaggaaaacgctttgaacaccaaaatgtggcaggcacagaaggcatttctgttctagacctgccagaaggctcacagtgtcccttaattccttttttcttttcctttttgtttttttagacaagggtctctctgttgcccaggctggaaggcagtggtacaatctcagctcactgcagcctcaacatcctgggctcaagtgatcctcccacctcagcctcctgagtagctgggaccaaaggcacacgccactacacccagctaatttgtgtgtatgtgtgtatttttagtagagatgagctttcgccatgttgcccagactcgtcttgaactgctgggctcaagggatccacccaccttggcctcccaaagtgctaggattacaggcatgagccaccgcacctggccagcgttcggttccttaattccaatcttcctcttcattgattttgaatcccagactggctcctccctaattgtggccagtgaactttggccatctacagctctgtaaccggtcaaatacagtaggggggaagaaacaatgactacacacacacacacacacacacacacacacacacacacacacacacacacacacacacagtaaggtaaatctgctaagaagatgggtggtgaaatggcgctttcgaaaaccaaggagaagctgggcgcagtggcttatgcctgtaatctcagtgctttgggaggccgaggtgagtggatcacccgaggtcaggagtttgagaccagcctggccaacatggtgaaaacctgtctctactaaaaatacaaaaaaagttggctaggcgcggtggctcactcctgtaatcccagcactttgggagggagagctgaaccgacctttccgagtctatcagtcaagctggaaagcaatggcgcactcaacacaggcccatttcaggagtttcaggaagagaccattcaccagattgtgggtaaggacccggggtagtgagagctggggtcatcaccaccccaggcctggctggcaaatgcagggagaagtcactggaacctgcagacagagatggctggcaggagacagagacgcccaacagaggcagggagggtgctaggggatccatagctcccaacctcgctctcctaccgtcttccattctcctgggctttttctttctttccttattattattttaataatttattttttttttactttcttttaaaatagagggaagttcttgctatgttgcccagggtggtctcgaactcctgggctcaaggtatcttcctgcctcagcctccccaaagtgtgagccactgtgcctaccaccatgtctggcttttttttttttccctgagacggggtcttgctttatcacccaggctggagtgcagtggcatgatcatggctcactgcagccttgaactcctgagctcaagccatcctcctgcctcagcctcccaaatagctaggactataggcatgcatcaccatacccagctaatttttttttttttttttttttttttggtacataagggaactcaccatgttgcccaggctggtcctgggctcaagcaatcctcccgcctcagcctcccaactgcctgggtttcttatggtccaaaccaaatgagaatttggaagacactgagatgccatccacacggggcagcctcccagtggggcgcacagcaaggtcgggggataggaggggccaatgggaccagcaggcccacggcagtgcttccctgtgccttccggtgctgctgtccccatgaccccttaccctcttttacccagggcccatcatatgcacgtctcatatactcttttcttaacgcccataaagagtgagtgaaattggatccaaagaggtttgctgagcgcttctaccacaaagggtgggattttctagtgtgttgtagaaggtaagaagtctttgacgggggactgggcgcagcggctcacgcctacagtcctagcactttgggaagcagaggaaggcagatcacctgaggtcgggagttcaagaccagcctgacccacatggagaaacctcgtctctactaaaaatacaaaattagccgggcatggtggtgtgcgcctatagtcccagctacttgggaggctgaggcaggggaatcacttgaacctgggaagcagaggttgcagtgagccgagatcgggccacaaagtgagactctgtctcaaaaacaaacaaaaaaaaagatgccgtgagtggagaggtgaagggacctgccatggaagtgccagaaccagaatttgaactccggctgcctggcttcgttgtgccccctcttttaaccatgaagcagctttcacccagggttaagacactgcttgacctggaggagaaaagtaggggagacctccaaactctgggtgggccacagatgaggcaggaaacattgcttccaaacaacattgtcctttagctgggcgtggtggcatgcacctatagtcccagctactcgggaggctgaggcaagaggatcacttgagtccaggaggtcgaggctgaaatgggctatggttgcatcactgcactgcagccggggcaacagagcaagatcttgtctcttaaagaaaaaatgttccggccgggcgcggtggttcacgactgtaatcccagcactttgggaggccgaggtgggcggatcacgaggtcaggagatcgagaccgtcctggctaacacggtgaaaccccgtctctactaaaaatacaaaaaattagccgggcgtggtggcgggcgcctgtagtcccagctactccggaggctgaggcaggagaatggcgtgaacccgggaggcggagcttgcagtgagccgagatcacgccactgcactacagcctgggggacaagaggagactacttctcctcagaagaaagaacgaaagaaaaagaaaataagatggtcaggcaccgcgactcacccctgctatttgggaggccgaagcgggaggatggcttgatcccctgatgtccacacaaccctgggcaacataatgagactttatcactactactgatcaacaacaacaaaaataagatgaatggtgccgcagctctaattcttaatcatggtggatattnnnnnnnnnnnnnnnnnnnnaaaaaatgttcctggggtcgacagaactttcttttgttttgagacacagtctcactctgtcgcccaggctggagtgcagtggcatgatctcggctcactgcagtttctgcatcctgggctaaagtgattctcctgcctcagcctcctgagtagttggaattacaggcacgcaccaccacacccggctaattttcgtacttttagtagaggcagggtttcaccatgttggccaggctggtctctaactcctgacctcaggtgatctgcctgcctcagcctcccagagtgctgggattacagaggtgagccactgcgcccggcctcagcaaacattttccctaaa

SEQ ID NO: 1565 - DNA, 7037 bp, Homo sapiens
atgaacgtgctgtctctgggtctggttgacagcatcagcaccgtgtttagcattctctgcaaactaaacgtggcgggatgtaggcaagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccatgacccccgagtaaacatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacatggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaagccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaa

SEQ ID NO: 1566 - protein, 2041 aa, Homo sapiens
MNVLSLGLVDSISTVFSILCKLNVAGCRQAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVNIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 1567 - DNA, 52211 bp, Mus musculus
  misc_feature (1)...(52211): n = A,T,C or G
gagagctcagtcttgcagtcgtctctgcataaaaagagaaagccacatagaagaatgaaattatcatcaagccaagtgagtacaaaaagatgatatggtgccaacctcaggacacataaggtttaaaatgtctgctgggcttctacacgaaggtgcccagatttgtgggccttgtgttgtgtgaagagattcatgctggatatggaattatggtatcaccagcgctcagattgtacctgtcttagtcagggtttctattcctgcacaaacatcatgaccaagaaacaagttggggaggaaagggtttattcggcttacacttccatactgctgttcatcaccaaggaagccaggactggaactcaagcgggtcaggaagcaggagctgatgcagaggccatggagggatgttctttactggcttgcctcacctggcttgctcagcctgctttcttatagaaccaagactaccagccctgagatggtcccacccacaaggggcctttcccccttgatcactaattgagaaaatgccttacaattgcatctcatggaggcatttcctcaactgaagctcctttctctgtgataactccagctgtgtcaagttgacacaaaactagccagtacagtacctaaaagacagattaaatagcatgaaaataagaagaaagccaaagacggaggtatgagacaccccaatatttggaagccaagaagaaaagaaaatacacaaaaagagaaacgtaggagataaactagttgtgcatagtgttctggaagccaagagaaagagaagaaaatggttcacagaccggctgtattgtaactcaatgctgcagagaccaaccagccctgtttcatctctggtgatcttataaaacaacttaagattggttcacaaaggtatctaggaacccccagtaatccaagctctcaggaagaaaagagagggtgaatgctcaaagcagcctaggctacacagggagagtgtggtggtttgaatatgcttgacccaaggagtggtactattaggaggtgtggctttgatgggaggaagtgtgtgactatagggatggactttgagagaccctcctcttagctgcctggaagtcagtcttctcatgtctgtctgcctttggataaagatgtagaactctcagctcctccagccccacatctggacactgccacactcataccttgatgataatcaactaaacctcagaacctgtaagctagccgcaattaaatgctatcctttgtttaaaaaaaaagataataagtcaacagtccttaagtcctcggatctaagaaagaagtgaaacacaatgctagatggtggtgaagtccagactggggctataggtggtggcaaagtaggacaaacagagggacaggagtacttgtgccagaggacacagctgggagacaaagagtacacacaggacatgtgagactagtgagaagatgtaagaggcgagcacggtctttgccaaaggccaaagagcacagaggcacaaggtcttgaccatatatggagttcattttcccatctctgaagtcacagcatcaaatgttatgggtgttgagagatgccccctcccaagtcccacaaaacatcagcagcagtatctgttcttatgctcctgaaggaaaattcacactaagacccaagtaaaccaagctggcattaaagattgagttcagttggatgatcgacaagcctttaagaccaactaaacactggtagtaaggaaggttcatgcagggctgggcagagcaaaactcatgaaccaggacctttaatgcctgccactggtgatgctttctggaatggaagcctggtaaacttcatttgtgtgccttctcctaggcctggatatgttctagaagtttgttatccaggtactcctaggaacgcaggcctttaggatctgccaagtgttaagcctacatcagcctggaactcatgcctggtgctgactgccctgcccacaggatcttgcatcatgcttacatttctgagttttgagcagtgttagttaaagcagtcagctcctctccatgctaatctgacccctgactgggttctacccaaccctcacagcttcagtgacttgtccagtccctggggtacacagagtccccatatggcagctggacatgaaatagatggaaaccagagtcacttgcactgagcacaggcttctgactggtactgttctagagatgtacccggggaccactaacttggcaaaagctgtgctgcttgaggttagaggacaggtgatacagacggttccttagccatgaaggctgacactaaactggctcattctcactgtcatggaggtttatgctatctcataaatagaggagatatgtcccagacttactctaaagccagaaattatgagaatagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctatgaagcccatactgcacacaggtccttagtttctaccagcaccaagtctcagcatgacgggcctcactgggctccaaaacaaagcataggctagcttaagtaccccactccttagctcttctaccaagaaaaggaggcctaatgctattccagtggatgggtctatgggtattggtctgatggtagagggttccaggcatcttctcaatactgatggacagcctggaagtgagtcaaatctaaaacctgaactcagtcctccctccctcttgctaagtagcatgctggactgcctatggttgaagaagggatgttgcaggcaatcctttctgccttcttccagatgtcccttcatttccttctactacgtccttgatttcctcggcagctgtggcgaccatttggtgcataagcagatgttgaacttcatgcttccgtggggaggatcttctgtagtcaccatcttgtccgcctctgacactgcaatttgcagacagtagtaggatttccaaagcagaactgaggagacaaaaggagaatggacaggaagaggaggttctgagaaaaaccacacacaaaatctttgtaaggaaggggaacaaatatcacaaaggggaaaaaaagagtttggtttaacgcaatcctgctaaaagctatcaaaacctgaaaatgtttactctttttaaaaagctgctggtgaaaggcatttgctaattatttttataaaaacatatgccttaaatgccacataaaatgtctgtttctatgctgtaaatatcaaataataaagatatttatagcactttctgatgtatttgaaacaaggtgttttatgtaatgaataaacattttttatatcccttaatgccaattttaacaaagccactttaaatctcaccaaaggaagaataatcttataaaagttgatcccaaccttgccagcctagttctttgagaagaaacaacctatcatgtcacatgttaaattagactgcagtttcaagacaacccaagattctagtagctccacacacttgaatacattttctttcacttgtagatgtgttaaacacgagccagcctgggagttctgtggacccctgtatcctagaatgtgaaggccacaggtcttgccaggctttgtcaagaactggtgacctcgacacatccatctgacaccatcttccggccttcacaggaagctttacccacatgcacatagacacacatagacacataattaaaaacacaattaaaaaaaaaacaaagctggtgacttgtctataatccaccctcttttgccttcccctagattatgagtttcttatgtgatttttttttctttcaggaactggctgtctttcatgattcactctgcctgaatgttctttcccacctcctccacctactcacattctacctgctttctttgatgccctggaggattcccttcaggatgggttgactaaaatcgacagcgccctgctctgcatccccagccttttccctgggtggctccaaggacacatctcatgtcctatactgggtggtgatgacactagagcatctctgcccagctgactcacaacgtctttgcaaaaacttgccaacatattagaggtattcaataaccaatactgagaagaattcatggacaagtggaaatgaatgcacatgtgaatggatatgtgggtggagatctccagcatcagcttgaataagaccccattcctttccagatgagcccccaaaataatcctgtcccttttataatacctttcctggccctatgggtctacagctaatacaaagatggagcaactgtagagaggtcagagtatgtaagaactgccccaattaaaagaggattcatataggaatcttcgagaatagggggtacccagatgcttaaggaagtttagaagtggcttactgattgggccactgttagtaaaaagacctggtaaaacggctttgtatctaatactcatagagaaaatgaccattgtaagtgtggtcagatgagtctcactcatcaacagtgacagcagcatcccagcaagaaaccataggactggtgacccaaaggccccttctccttcaagtcagaacataacactttaattgaaagggaagagatgcaaggagggaggagaaaggagaagggaggacacttcaaagagagaagagggattgtagttgcaggaggccaatgcccgcacactcgcacgcatgcactcacacatggtatttcctgatcttcacaactttcttgtgatctgatagacaaagaatatttgtctatctgttcttggacatgaagaggactcatcctcggtacagcacatagcaagcaggtacagagaaggccttgcttggaccttagctacccctcaatgagtggctctttcagggtagatctcacagcctactgtgttgcagaaggccaagctggctgtggaataatagggatgaggggagctgtcatcttctcaagaccagaaaagtgcagctctagctagcaccactctgcacacctcagcctgagcctcagccacgttctagagccccttctttgaacctggagaggatctggctggcttccttccagtgggatgtgactcctgctataataaaagctgagaatccaggggtttggaaagaacaggaactgctgttaccatgctaccagggttctgagtgcaggctccatcctgtcatcctgttgccaatgacaatgaatatggggggggggcagggaaccactcatggagaacccatagtgggtttggaaactatatacccgtcccgcagttttgtctgttgggggaatatatgagaaggagagacaggaagtgggttagagaggcatgtaagcagacagtaaaacccttagcatgctgtagacaatcatgaagacaaggtcccaggggagtctgtggggaagcctttacaagaagaagtagctcttgcccacaggatatgagagctgcagtttggagtctttaaactcagtcaataataacaagagaacagcattaaacgttagacgggatcaacagaaaggctctgaagggcttgtcgctcctcatagttttagtccaactatgttccctcctaattccacactctcttcctgagttccatgttctgtccctggaaagggggtacatactggggcttaggtcaggtagttggaaggaaagagggaactatctggattttgattggtctgaaagatatggaaatatccttcacaatccctcaacagtcttgtaaatacagagaagtctggtgaccttccagaaatacaaactactcattctggaaatatttatctatgtccttgttgtttgctttgtaccaagccctgggaaacagccacgagcacagcagtcatttctcgtaaagtgctcaaggatctggtgaggatgggaggatgttagcagcggagtaaggagatggcttctcatgggaaatcagtagggtgagtgccattgatccactgcagagcctggagtggccacttgacctctctgtgcctggttttcatcataaatgaaaccacagtagcactgctgcccttgggatggtgcaagggttacatgaatgggcatataaagtgctgataactgagcaggacacgtccagtcagaagagtttgctcttgcaatattggcattactgtgactgtgttgaccaccagtgaggaagatattctttaaaagtgtgttttgccaaaccagagagccctcccagaggaggtaacccaacctgagcatgacaaatggctaggagcattataggacctggggtggggagaagagaaaggaaaggggggacagaggttgcatacacaggtggcatatggctgagcccagcaagtagaaagcagagaccagtttcctttagttgtagaggtgattttgaagatgaggcaaagggccaaagatacatcataaattctaatggctcgtgttaaggaatttggatttttaaaaatcctcttacaaaacaattatttctgagatgctctttaagctgtcataggaaaagtgagctgaacaaggaaacaaagaacagtctaccccatagtcagtttctgctaataacaatggagagttaagtgtatctgatgttcggaggcacaccttggctactgcagatctctggggtttggttgataataactgttctcctctgagatttttttcgttgctgctgctgttgttgggatttgaagtggctcccctcaacccacatgccaggattatagtctgcttctccagcagtcattgtcatatattctaatgatttgtacagctggtcacccaggggacggctcctgatgaactcaaaccatttgaataattctccacacttcccattgattggctgccgtaggatgtgcacttgccaaaactctcaccagagctatgagggaacaaaggaggctgctggaaaaactgtttctcactgaaaacaaaacacaagatgccatgatgttttctttctctctctctccacaatgactccaagcatcacatggccattacacaatcaaaatgtgtaagatattgcatatgtatataatatagctagtagttttgttcagttgaaaataaaagatttctaacaactttctaaaatgggggacgggttgtgacattttgagcagattagaaagctaaggcggatgaattggcatatattaggtcccccaaatgaacaagagtaaacatatataacagaaaagtctgtgcctctatggtgccatgatggttggactactgtagtagtgacattgcacatacccttttcttctgcatgatgaaacagaaaatgcctatgcatggtgttctgctcgccaacaatactgtggataatctcggaggaccaaatgcaaagagcatccctcagatggaacaactaatttctaaatctgtttctccatgagcactgcctactctgtcttctgctttgaattgattccatcttgtcattcctacgatagctatattctaaatgtaacctgatcatcccattgagaatatagtgctagatgcatgagactctcagaatggacaaaacagcagcacgctatcactaacataagtgacgtagcctggagatcggctgaccccaaatttcttgggataaaatttccttattaggaaaatgaggttccatgtggagaagtacacacagagaaaagaggcacgaggcatgtctcattacttctgcctaacaatattcactacaaatagtaaattttagtggctgtatgagcaattgaagacgatcataggacgtttaatctcaaaccaccggtaagcctaaagtatttgaaagtttagtcagagaattgacatttttttcacatgagtgaacttagctgaatagtcctttcaaaagaaaaaggacccaagagcctgagtctagcatttctgaaagcgtgcatatgcatgtgtgtgtaaagcttggaaagctgagaattagtcagctcacagtcccctcaggtcagcatcccctctgaagagccctactcacttcacctgctgtcagggcccccccaaacacacacacacacacacacacacacacacacacacacacactgagtgaagcataacttggtaagtcttcccccctaaacaattcaagctaccctgagacttgtaaagataccaacctctcaaggaagtatgcttacatagaaatatgctttggaaagctgaaataccccctttacatatctgaaattcagcagcctttgaatcaagacttgaccactgctattggctcttaaaccactattttaaagctaagacccaaaggacttttatcttttctgtactgttttccttgttgctgtgacaaagcatccaacagaagcaatttaaggcagaacgggagttattttggttcccagtttgagggtacagtgcatcgtggcagaaaagtcatggcggcaggatcatagaggcagctgctaacattgcatctgccatcaggaagccagtctagagacaggcttatagggatgcacagaggtttgtctcttagattccagatcctgtcaagtttacaatctgtaggaaccatcacaaggactgcgtgagatgaagtagaacagatcagagactatcttgatatctacgaagctcaaagaaactcatgaggctgtgcttctgagggctgtgtgaggctcctctatccttcttgctgttccagctggaatccttgacagcctagtgagggagaataagccctggtatagagactcctgaaacaggggacgactggctatgcttagggttgtagaaggaattgaggttacttggaaaatataggactgctttaagaagaattcagagcctgcctcctccctgttctccaagcctgtggaaactggaagccatctctcagtgattacctgcctggtgctggcagtttctaactccctaatatcaccaggagagcaatgtcctcctgttttgtctgatgaattcattttcacacacacacacacactcagcataactgcaacaggcgcacacattgcatgctgcaggaggactttcagtttgtgatattttgagacttgaatggtctagaagggaggcagggggaggtctcaccaatgtaaggaagtgagttcccaggctttgctcttgcaagcatccagactgagcccaacagtccacagttacaacacacacacacacacacacacacacacacacacacacactagggcttattcgaattctcaaagggaaatagatttcacttagctcttaacaagttatccaatactgtggctacgcagccctttcttctacttattgctagctacacacacgcttcatttgtttatgccttgggtatatttttggtttgtctgagtctctcacaatctttgaagagttaattcaaagagtgagagaaatagtaaggcaaacaccgttctctgttccgctctgctctgtgtgtgcttcagcaggaaatgcatttctgacacttttaaaatgagcaatcacatgtataatcaacttggttaaaacttccttcctggtaactgcaacacttcctctgcatctggatatgaagggagccccagaaaagaggaagagacgaggtgccccgggtaggtctagattcgttttttttttttttttcctaaagtaaacaaatgatcctcctccgcatcacctccagggctgcctcaggtacgactgctttctgttgtttgctctttgcttggtatgacttggaacagtaacaccttccttctcagctagaatctttttgtctggatccattgccggttcaagctgagccaacccccgagcgtctgagtttccttgtctcgccgcgcttagactgtgtacatccacaaagttccgtccagcaagggcttgcaggtgcactagttctttctgtttttgtttgtgcggaaaggggcggccacagagcccgtgacggacaggctccagagtcgaccaagtgcttgcttgggaattctgtccagacagtgtttttgtaaaaggacaaagctacttagtcccagccatgaggaaacccagtgagtattttggtcagccttttctcttctgtaccttgtannnnnnnnnnnnnnnnnnnnttcatgtcagtatcaaaatagtttatggttcttttctttgttggttattctataatataccaaaagaccaaagtgaatgctttaagctaccaagcaacagttgtttgggacagttggtttcatttatttactaagtatagcttcattatattttaaaaggagggagaattgacttttaaaatagtttaacccaagaattgtacataagttgagatccaatgtaacttgtcttttatagcttttaatcaagatctcctttggggtatataattaacactccactgttcttcaggaaaaactaattatggatctcattaacatcaattagagagtaaatgatattttctgaaatattttgtttcaatatttgaatgtggtttagaatataatgtagtaccaatgtagcaatgttaaatattaaaatcaaaatttttatgaatcatttttatggattattttttagttttggaactctgagcatttcagtcattagttgatgggttcatagttatgcttaaataccttgtagagggcaaatacctaaatataggtaatatgatgggaacaaatttgtaaattcctgctatggagatgaaaatattaggacataaggaaactgaattattgtttcgggtcatgggagggcaggaatcacgtcttctactgtgtcccctctaaagcagaggcaggccaaaccaactggctcagttaaaattacctaaaagttcatattgggaaagtccatgtatgttagcacctccccctgccctaatatagcagtgatagctggaatgctctgcattccatgaccaaaatggtatgtgtggggacacggctttgattacaatcttcaccagttttactacacttgagttttatgaatggaatgactagctttcttatatagaaagaaaaaatgaaaagaaagaagacaggaagttgactagggagactgggttcagacagtttgaaaatagagaagatgaagcaagattgggtgtctaggttagagaagtgtgagactgaacagaggaaatgcatcggcattggcttgttctcaaagtgatgttcagggtctcacgccgcaccttagggactcagcctttgccctccactgtactgtcttatgcatctgtgagtttcagggtacttacaaacagttgccattttgagccagtaaatgacagacactgtgctagatgagggtttaacatatttttgtgcacatgtgagggcggtatatgtgtgtggtgtgagcatatgtgtgtgcaggtgtgcaagtatacctgcagaggacagaggagactctctccaccttattcctttcagactgggtctctcactgaacctggagctaggctgggagacagacagcaagccccagtaagttttctcatctctgctctcctcccaacacagagagagagagagagagacagacagacagacagagacagacagagacagagagaaaacgttagagacagacagacagagacagaaagagagagagacccacccctggggttacaggtccatggggacaatggtaatgcttatatgggaggtagggtatgaactctgaccttatgtttgtacaggaagcacttttatccactgagccatctctccaggcccatggtgcattaaatgaaaacatcatacacacacacacacacacacacacacacacacacatacacacacacaaaactaaagaaacggtgtcagcatggttttttaaaaagctgcgctgccttatttaacttttacctccatcttctatttgtaaataatcaaattgacatataaaaatcaggctcggagattaggtaggctacatcactcaaacagtaagtagctggcagggattcatgttctgaccagcgctgctaaagtcagcgctgcctccatctttcttggtccctccaggccttgtgctcacatcagcccaccacaccttctctctgccatcatacaggaatgtgcaggaagcagtgtctcttgacaaagctctgtttctccactcccaggtcgcatagggcatggagctggagaactatgaacaaccggtggttctaagagaggacaacctccgccggcgccggaggatgaagccacgcagcgcagcaggcagcctgtcttccatggagctcatccccattgagttcgtactgcccaccagccagcgcatcagcaagactccagaaacagcgctgctgcatgtggctggccatggcaatgtggaacagatgaaagctcaggtgtggctgcgcgcactggagaccagtgtggctgcggagttctaccaccgattgggcccggaccaattcctcctgctctaccagaagaaaggacaatggtatgagatctatgacaggtaccaagtggtgcagaccctagactgcctgcattactggaagttgatgcacaagagccctggccagatccacgtggtacagcgacacgtaccttctgaggagaccttggctttccagaagcagctcacctccctgattggctatgacgtcactgacatcagcaatgtgcacgatgatgagctagagttcactcgccgccgtctggttacgccccgcatggctgaagtggctggccgggatgccaaactctatgctatgcacccttgggtaacgtccaaacctctcccagactacctgtcaaaaaagattgccaacaactgcatcttcatcgtcatccaccgcggtaccaccagccaaaccatcaaggtctccgcagatgatactcctggtaccatcctccagagcttcttcaccaagatggccaagaagaagtccctaatgaatatcccagaaagtcaaagtgagcaggattttgtattgcgggtttgtggccgcgatgagtacctggtgggtgaaacacccctcaaaaatttccagtgggtgaggcagtgcctcaagaacggagatgaaatacacctggtgctcgacacgcctccagacccagcccttgatgaggtgaggaaggaagaatggccgctggtggatgactgcactggagtcaccggctaccacgagcagctgaccatccatggcaaggaccacgagagtgtgttcacagtgtctttgtgggactgcgaccgaaagttcagggtcaagatcagaggcattgatatccctgtcctgcctcggaacaccgacctcactgtgtttgtggaagcgaacatccagcacgggcaacaagtcctctgccaaaggagaaccagccctaagcccttcgcagaagaggtactctggaatgtgtggctggagtttggcatcaaaatcaaagacttgcccaaaggggctctattgaacctacagatctactgctgcaaaaccccatcactgtccagcaaggcttctgcagagactccaggctccgagtccaagggcaaagcccagcttctctattacgtgaacttgctgttaatagaccaccgtttcctcctccgccacggggactatgtgctccacatgtggcagatatctggcaaggcagaggagcagggcagcttcaatgctgacaagctcacatccgcaaccaatcctgacaaggagaactcaatgtccatttccatcctgctggacaattactgtcaccccatagctttgcctaagcaccggcccacccctgacccagagggagacagggttcgggctgaaatgcccaatcagcttcgaaagcaattggaggcgatcatagccacagatccacttaaccccctcacagcagaggacaaagaattgctctggcattttcgatatgaaagcctgaagcatccgaaggcttaccctaagctattcagctcagtgaaatgggggcagcaagaaattgttgccaaaacgtaccagctgttagccagaagggagatctgggatcaaagtgctttggacgttggcttaaccatgcagctcctggactgcaacttttcagacgagaatgtccgggccattgcagttcagaaactggagagcttagaggacgatgacgttttacattaccttctccagctggtacaggtaggggctgctggttagcaggaactgctctctcagagagctcatttgcatgtacacaggcacccctttcaggagtcatccggtaccctttgttcagtttcatgatcagtcagcctagtgccgatgaagccacgtcaaaaaagtagtaaatgcttccattgaccttttttttttttactgtctttgagagtttggcagtgagcatttgaaagacaccagtgctgcccttcacgttttaggagaattgtcacagtggaaattacatagtcctcattaattattttaatgatagattgaactcgttgcaaacttccttgggccgaggctcatgatttacatggactgctgtgtattgtgtcatttgattccactattaactgcgaccgacggtggtcaagttagagtctggatttgcattttatacatatggaaattgagatacaaggacactaagctgtgtgtccagggccacatattttattttaaagggcaatgggtgaaatgaaagggctgactgactccaggctttgtcctttttacagcctcaaatatcttgcaggaatcaagcagcaggataatacaggctagagatattttaaatctttgtagaacaacaaattctgggtagaatcttttaaatacttgtttttaattcttgagtattatatataggtatacattgaaaaatgattatacatacctcctatttccacttcagattctcttcctgtccttattaatatgtctccctctcaagttaatgccatttccccctaataactgctaagtccaactagcactatccacatgttcatgggtgtagaaccttccacgagagcagaggaatcctaccagtagccacatcttcgaaaaaggatgattttttttctcctagcaactttccactgccactagctcctcaatgagaggtagggcctagagacctatctaccccatctatggcagaactttgaatgggttgatcctgcacaggtgaccacagttactctgagttcatgatggctttcaggtctactccacagagggaaatgtcacgcttggtaacgtaatcctcgtcaaaagcccatggctggggaggtcataggccctagggtagagcaagctattgctattttgctaaagaattgtgctgagtaggatcttggtagctgccctctttaaacaggcaggaaactagtttcatcagttcccatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcattttcccaaagaaaattgcagaattcaaagataagtaagattttccttagaaatattttaggtgaaagaggtcaatcagtcttattaactttggatgcgttggcttatatttgaagagtgatattcatttgtgcagcgatttgaaacattttcagctccaactaaatgactcattgctggctaaaatggtctctcggttgcgatctgcatcatttgttgtagaagtgaaacatgaagaaagaccagctatcagattagaaacctaaaacacatttaaagtgagttctgttgactgagtaaccgcattctcagaactcgactgacatgcagttctacggcacctacctgaccacacccaaaaggagtacttttggaaggagggctaacattgaaacattaaggtcagtactgatcacagcaaattagaaacccagagtgtgaagaaccatgaccataacaagacttcaggccccataatatgggctacagtggaaatgtcttctattctttggaggaaaagatcatttctatttataaaggaactgttctaagatagtccatattagacttatatacattacctatcttctagcttactattagacccacatatactacccaccttctagcttaatatatgcattgataattaaataatatttgtcgccttcaaaactattagctatttcaagcttattgaaaaataaaatatgaaaaatataccgggacccaccaagatttaatttattcttcttccattttattggctttcttcaaaatagagctgccatttcacttaagccaacacccaacccagaaccaacactgtgaatatgatcaagcactagcaatgaagatcgagctctgcctagagaagcatagaaaattagggatagtctgacacagcactctgtactgcagtgtggcagggtgggggctgctgtttacctacagtaagcagatgggagctgctcaaaagggaggctacggggttttaggatcttcacacttgacccgtttgcatctgctggtcttctgatatgtgctgttcatggtccatttgctttgtaacaaccacccttacctttcactttaaagaattagcatagccacatccacctctcccctatccccttccaataacccaagccattctaactcagaggaaaagccttcgcaacttcagttctgccatgatccagatcacagcgctgtgcatcacaagttctggcctccagccccagcttggtcctcacctattatagaatgctaagcaagtgcctcctcctcctgtcctcagtgcctgctaaacagggaactggatttgagtagctggggagattctcaccaccttagctgaaagacccactgaagcagaactgtgggtttcccccattgcctttcttctgactgaccaccacagagcacagaccttcaaatgtcaatgtgctcttcctttaggctgtgaaatttgaaccgtaccacgacagtgcgctggccagattcctgctgaagcgtggcttgagggtaagtacttccactttgataacagtctgaccgtttaggctaccaggaattgcccagtaaacctacagcattagtcaccatgatctcaaccatcttgcacccatctcagaacaaaagaatcggtcacttcttgttctggttcctgcgaagtgagatcgcacagtccagacactatcagcagaggttcgctgtgatcctggaggcgtacctgcgaggctgtggcacagccatgttgcaggacttcacacagcaggtccatgtgattgagatgttacagaaagtcaccattgatattaaatcgctctcggcagagaagtatgacgtcagttcccaaggtaccgtggttgcgttttctcagttctccttccaaatgccataattgttttgaatcttctttctggaatccaagtagtattttgcaaaaggtgaccaagaaaacattttggtctcttatcttcaatgaagtaaatagatttaaagttctccttctataagacatgatgttttgtgaccataaatgtatatgttcttacaagtgaagctgtgcatgtgaaacttggagaaattgaagaactttgtgtgaacagaaaacataattttcaataacagttccacacacaagaagtatgtggaactccttttccaaatatccttttcctcatctttaaatactttcgtgctgatttcaaatagtcagaatttgaaggtaatattgagaggttaggttgattttaaaatttcatcatatacatacatttgcatctcagaataatacacatagataaatgtatgtcaccttcacacatgggtgtgtgtgtatgtgtgtgcccctcctctctgtagtcatccccaacctcttgtctcttctgctctaggaaaattaaccactcttataaggtttgggttgataccattggcacatcttttttgacacaataaagtgtatgaagcttgaacctagaagcacgccaacttaaaacgggcactaacatccctgcccagtggttaaagcttttgaatattttacatttataaccttccctttggatcattttctagttcattgagcatgctacccccaaagctactaacgatagcagtaacaatcttatgtttgggctggcctctgactgttatccagccagtaatctgtactctgtgtgttttgccttgagaatttcgaagttgccccatcttttgtacacaccctaacttcctcctttgagaatttgcagaactgtaaccgaactctagttaagaatgtgttcaaatgtctgctccacaaaccagagggctgttgaaagtctcacaggctagaaagatgatggcagcaccaattgcgtaggttcactctcagcacactctcttgactggaggttttacacatgtgttcacatatgccctctgcctttgaagggacatttacacttaagttgttgttcacagtgattctgacttactttgcctacttggaatggttagatccccaaaggcagagcgctatatcccttttcctactactaatttcccaaatgatatacatggacttctaaggggtgtgacgtcaggaagtgctgatatcatcgacagtactgataatgtcttgtgctcacttaactcctgtatgcttttgataattgcagttatttcacagcttaagcaaaagcttgaaagccttcagaactccaatctccccgagagctttagagttccctatgatcctggactaaaagccggtaccctggtggtaggtatcagtgggatttctctggatgttccttatgtcctgcaaatgtctagcatactttatagagccaggaccttcacaatggatcttcagtagacacagaatcaagagcatccccagatgggcttcggtcaagtcaccctctcatcactagcaccagacatcccaacacccaaaatgacacaccaatggaagggtaattgcctcccattgtgttttaaatcgatttatcgatgtattctttatacaaagagttgtccataggtgaagttccctgagttttcacagataaatgcttctatgcagccaccagcaaaaatcaaaacactgaacattcttctaaaaatataacagaagttctttatgtcaatatcagctgtccatattgtaggtgcatctgtgactcatctctgaccccttctgttgatttaaatgtctatgtgcatataccatatagtgtaagagaccactttgcatgcatgttagaattgtacagaggtatacttacactaatacacctcttctgcatgtattataaatgtatatattatttttgttctaaacaaaaaaatgtatgtatactagattaaaccattttaaatgtttgcccacatattattatgctggatatgagtacttctgatctttaacatgttatcctgcaagctggtggcaatatattctttcaaaatttacttagctaaaatattttactatgcatttattttttagcaatattttcactagacagagaatcctagcttactgtttttctcttgtagtaccatttcttctgccttgcctatgtcctgataacactctggctttgtctttgatgttctatctataatacgtcattttccccctatatcttttccgacctcttccctccctgtttttcagtggtttgattacagtgtgtgttggcacggtttcttgtataaggtgccaggtctttgggcttgtgggtatcttctatcatatttggaaattgtttgactgttattattttttgttgttctcgtctggcctttctttctgagacagctactatactctagattgctggaccctaagctcagcatggatgccttttttccatgctttaagcaagaaacagccccgaacagtacgctgagccttctctccatctctacgctatatttgtgattcatagtgcactcacttttgtctaaaacccatgaaagtcatattcttatgactgctttcacagtgctctgcttagatgtgaggggctggggctggaagccctgtgatcaggtgccagattttccacttatttctgttaaatttccctgagttagatttggcctacattgggttctgtagtaataatatttcagacactgtggaagcactggacctcatttttcaaattaaatctgaggaagggaatgcataaacagatggtagaaagtgctctgaacgatgcacttctagcggacataccgaggcccatggagtagggtgattaaaatggtacctgctgtaccccacaggccttcacagaaacttagagttaaacttagagtctgagagccattgtttccagggttatggatttttctcacccatttccagtttgggtgagaatgccttctatacttttatccaaacattgaaaatcattttccagccagttcacagcccctgtgtttagcaatgctctatgagagaatctgtgtctcctccatgtgtgttcattgtatgtgatggtgtgaccacggccttacagatcgagaaatgcaaagtgatggcctccaagaagaagcccctgtggcttgagtttaagtgtgctgatcccacagtcctatccaacgaaaccattggaatcatctttaaacatggtgatgatctgcgccaagacatgttgatcttgcaggtaggttaatgcgaagggagtgggcttatgcaattatctgatgagagagtgctgtgctggtctcaaacatgcctgccttctgtgggttttgttttgtttcgttttccgtatgataaacagcaatcaaaaggtacctaatagataagttttactagcgccttagttctctctgtcctttcaaagatgtgtattcaacattccctagtagccatatacacttgactctcctaccctctttttaagcactccattctatgcatggaagcatagactatgggattatttgcctacagtacccagttttctttcctgttcacagacatatcaacacaccagtaggcatactgcctaaatacatatcctttagtattcatactcaaactcatgtaatgatctgatgcaaaaaagaccagaaggcaggtgattatgcaggtgaacggtgagaaaaaggtgaacagcaaggtaccaacactgtctgtgtcaggttttttgacatttctgtgcagacagcatcacgagtctataagtcttttctatccagattttagtgcctcatcaaagaaggaggtgagggtgactaaaacctaacacagtttatttagatgacaaagtgtactaagttaagggcagcctatttaaaaacacaatgttttccattcatcttaagattctgttttgacttatttctaacatagtactcaggttcccttccagggtggattggttgccttaatattgttgttttcctttttgtccaagaaatattttttaaaagaatgaaagaaatcccttaatatttttaaagatcaatttagttttaaataaatctgcagaatcccttggattgttcaaagatgagcatttcaaagccacacaacagcgctctgctggtcctttaatcccgagagacagtctgcgcttagacttcattttattattggagcccactatgcactgaaactctccaagactttgttcctgtaccactgaacggaaatagcagttatatacccgatacaaggttactacaagaatcacacataaaagagcaaccagttaatgtttggggttagtcaatcaaccattattgatttcattgccttggttgtagcatagatcatgtgatatcacactattaaacatgtataaggacattacagttattgtgtgaaaaaatacataacaaagtggaatgttttgataagatagatactgaaacctggcaaaaagcctcccacaagtaaagattcttcatacttttcttcaacatataccccaggggctgaaattaacagatttgcagtgacaggaaatttctgagtatcagtctgaagagtgaaaattattgcttatgtgttttgcatctactcatatattgtatgcaaccagataagattactagctttttaagagagaaggaaaatgcattggccaacatctatgtgtaatagtagtgcctgtgccttggttcctagattctacgcatcatggagtccatttgggagactgaatctctggacctgtgccttctgccttacggttgcatctcaactggtgacaaaataggtttgtagttacatcaggagatgagcggcacagcactctgctggctttaaaaggacatcactccctcagggaaagaaagcagtccttaacgggaaaattatagtcataggcaagaggaggaaatgttcccaggctggaaagagactctcggttcaataagaacatgatgacgatgcagggatgcctgtctcgggcctgggcccttacacgggaacagccttcccaagaacttgctccctcccctgctcttctcggcctctaaagcgcaactcatctctttgcacattcagcgtttctctcacaaataacatttaaaattaaacagaaggaactgtcagttctttttaaattccaggattcacattactgaagctattacacactccactcaggtacttttatagacatttaacagtttagtcttaatcacacttatttttattcaaggttctgatatgagaaatgtacaaaacatttggccttgttacctataaaggaaaagtcagttccaatctccgagcaagggaaggctaaggttggcacatagatggctttatttgtcacttccccaaagcagccctttgctctccttagtcaggaatattgagaaagtattctttacgatttctggagccttgctgttattatcttccctaaaagcaagcaagcaaacaacaagaaaatagctcagaactggaaaacagatctttggcctaataaaaaaatcttccattctctgctccaccaagacttatagcagcatcggcctctcctgaattctgtctcttcatgtaggaatgatcgagattgtaaaggatgccacaacgatcgctcaaattcagcaaagcacagtgggtaacacgggggcattcaaagatgaagtcctgaatcactggctcaaggaaaaatgtcctattgaagaaaaggtgagttcttgctctcccctcctcagcccaggctcacttctccatacagcttgtcttctgttggacagtagtggttcctggtctaacaggctcttttaatggatgtctctgttccccaacatactggttgagtgttttactcctgaggctgtcggggtttgtgaggggttttcccctgatgacacagcttatctgtgagacagagcacctacttctagacccagaaaacatttgcttcagttttgaataccagtcaagctttgcatagaatttggttctgtgaaataatctgttagcactttttatggatacttttgttgtttaacccacagatttagctaccatatatacattctttcataccaaaccaaaaaacttacaatttctactgtggctctaaatggtaagttatgaatgttgaaaatgtctatcttgctgaagaacatatgctggatccttcacaaactgtttggctgggccatctgggtgctgtttaaagttctactgcccgagaatagcacttcacacttgcatggccagcagcctttggtggaggaaatataattagtagcctttattaatctgttatacatgaaagcttgtgaaaccatccatacacttaaatggttataagcaaagcataattgcagaaattgctacgagttctgtacagttgcgggcaagtggttaaaaggaaggatgggaaattttgataaatttctgtggccctttccttcttgggtcttcctcatgttgtactatttggatgactcttcactgaaaatacaagccaacagttaaaaatacaagtgacagttggcacttccttgatacgagggacgtactaatgaggctggactcaaatttcttgcttgctgtctgaagtggttctgagaacactgttcttctgggaggcattgccattgacttgggctgctctctgtcactggaaagcaaccaacattcagatccattctcctcagtttcaggccgcagtggaaaggtttgtttactcctgtgcaggctactgtgtggccacatttgttcttgggatcggtgacaggcacaacgacaacattatgatctcagagacaggtgagtttgcccactgtaaagtaacatttttattgtagtaagatacatttaacataagaggttctgttttaatcattcctacgtgttcagacaagggacactaaacacaatcacattattttgcacccatcaccactgtccatctgaagcacttcttctctttaaacgttgcctccccactaccccatcctcctggcacagagtgagagtctaagctggagcccagatttacaagtcattgtgtatagggacactggttactgtagacagaccacccatcttgagggttaatgggtaagggaagaaaaaggaggaaataaaggaaataaagactaaaataaaggaaaaaattacagggagaagtaaaaagagagagtggggaccatagctcagaaggaggcatcagcaatgtcaaatgttgcaagatccaactagaccaaataataaaagcacatgagctgtccctcttctaaaacacctgagtccctaactctcgcagccatactggttcacactaccctggcagtggcctataatggccaccataccatgaaatggtcatatatgaaatctgaatccagttttatagtcttctaggcgtggtaggcaatgtctataagtccaacactcaggaggcctaaggaaaaggaacacaagttcaaagctagcctgggctacatagaaagactttaacacaaaaattatttttaaagagtagagtttaggaacaagcaaaggagcttggtgtgaaatacctattccttgcaagaacagggtcaacacaaaagaacagtccatttgcggattatagaaatgctaaaagaccaaataaacaaaaactaatatggtcgtgctgctggcaatagtgttagaagctgaccccaaaaagattcaaaatggtatttctatagcactacttaaaagtaaaacattaataacatcactcttggcagacaaaatacagcaccagtttgttggttacatgaaggacataagtctctttagcatgatggtcacaccttagcgagagttttgatttgcctgtctaagagtactttggagacaagtttgcttgttagattgcttgcttgcttgcttgtttttaatgacatcttggtatcatctaaagaacaaacctatcaaaaaacacacttggttttgtctgaaagctttgtggctactgctttcaagcacctgttaaggctgaaaatatcaaacgctaataataaaagaggataaagtgctctcactcaaaatagttcattttcaggcaactgaattttttttaaaaaaaaaaagaccaaaatattaataaacgcttacaccaggtaatgacgccaggcattttcttctcttaaggaaacctatttcatatagacttcggacacattcttgggaattacaagagtttcctgggcatcaataaagagagagtgcccttcgtcctaaccccagacttcttgtttgtgatgggatcttctggaaaaaagacaagtccacacttccagaaattccaggtatgtcaccgcagtccttccagaaattccaggtatgtcaccgcagtccttccagaaattccaggtatgtcaccgcagtcctcctcacctcctgccagtacaaaccgatcacactgtagaagtcgcctctcctacccttatgatatggccgccctccttcctcctcctcacctctgttcattccacaaggacatgcaaagtgaggctttcagggatttgctcactaaaaccaaacagcaagtaaaaatgctccataaggggtggccccggggaccacagacctctgagggcaggctaggtgctcaggacagcttcaaagaaggacagttatggagactgatctactcaaggctttgagtagaagattcaaacttcaactatgtttcggggcttgcaaacaatcgtgagcttcacttgatttttggtactgtgtgtgtacttatcataataccaacaggggaatcttgttgcacatactggttttgctggtattaagagtagtccttttctcgttggcagtctcatcagcttggccacaggctctgctgtgagctctggttccactagcttgcaaacaagcccccacaggagtatttggatataaacacacaatgagagcatcttataatagctgtgaatgaatacaattcagaaaatttgtaagcatactgaatatataacaacagagtcacaaaacagaaaccaagagtgacctttgccttgccttgtctgaacacagccaccttccttagtgtgccttcactgtggtttgatttgcactccacatctgagggagaaggcttttccttcaaatccagcatgagcttgggaaaggacatgcgccttgaactataggggaagagctgcttcctcgtgttgttttgtaacttgtgctttgatctactggctggctgtcttgttggtaatggcatgactcacactctcggctcagttttaggagtttgggtatgtgctcttttgcacacactcagttgggtttcagacagtttccaaaaactggacacatttcatggggggagcagaaggactttactacttaaagaagagaaagcgctcagttttactctcttgaaagtgaggttgatatgactagcttcagacagggcatgacaacagctcagaatgttagataaatgcatggaattttgccttagacgtgagtctcttctttcctatagatacatggtctcttccttcttctaatgagtgaaatttcctagaagtccatccctttgtccttacagactcacacagagttcatgtcacaccaccaaatcccagcagttttcccctttagctttctttgttgcttctgcgatggttttcagttttaaaacgtttgtgatgaaaagatcttcataatgaggaagccaggagaggatccttgccccacccagcaacatcaactcagagcaacacgtgtgggggttttctcacagtctgtaacatctctctatcctttctgatcaagcttccttcttaaacaattaaacctcctccagtcacatgatgtccatacagcatgcaccgcccagagcacattcctgtgaattgtgttgtgctttacacacctgtgttctggaagactgacagcattttacacacctgtgagtattacctatatactaatcagtagcacagggatcaaaggagtggcctttgtagccaacagatctaagtatgctaacagctgtgtccacaatggcagtcacttagccttttagaaccttactttcttcatctgtaaaaaaggaacatggcctacttatggtttttccaggtactattgatctagttagcactataaagagaaagcttttatttagctcacagctctgaaggttccaaaccacgaccattagccccatgactctaaaccagtggctctcaacctgcgggttgtgaccccctttcacatatcaagggtcacatatcagatatcctgcatatcagatatttacattataattcataacagtagaaaaattacagttatgacgtagccatgaaaagacttttattgctgggggtcaccaggaaggttgagaaccactgctctagacctagagaaagcattgtggctatagcagtggtaagagccggctgctcagcatcattgcaatgaagaatgcagaatgactagctcatctcagaccacagcagagactctgttatcgttgcgttagacatcaggcaagtctcccaacttgaaatggaaatgttcttacaatttccaaattgaaaattttaagaatccattttttgaaatgagatctcgggcaatatagaaaacatggccaagtagcctattatagttaaagagagaactgaatcccgcctctacctgttctcacactatcccatcccccaccccaagcctattcatcctctgcacacaagagaaagctaaccactgaagcaggaaattatccacaggaagaattcccaaggtttgacaaaaatgggcagctgagctccatcatttaactccagacttggacaaattatcatctgccttttctttcatttcttttctctttcttttcttctctctctctctctctttctcctgctgcacacacaaacacacacacacacatacacacacaatctgtgatacttcaagttgctgtgttctaaggttgctaaatgatctgagatcacagggtggttcctggttgtgtgtggcaataaagttaaagtctagatcatgggatgcaggaaggtaggacatcttcactggaaacatggtttaacggtgttgtttaagattcccagaagatgttgagacagcaatgaagctagctccgacatggtacactgggtctccaggctagctctgacatggtacactgggtctccaggctagctctgacatggtacactgggtctccaggctagctccgacatggtacactgggtctccaacccagctctttgctttcctataaaaattctacatatgaaagcaagccagcaacctttgcagcagatgtcaatcatgctgcatttcttgcttgtcatctatgtagaggcttcaatcagatgctcggatgagaagtccctctttgttcctatgtcctgtaatttactttctttctatcctgtctcaatagcactatatttcaaatttcagtgacttgctgtaaacatatgtaacatgcaaatttatttaattcaagtccaaatgaaatttggatttctatctctttaataagaattgtattttttttcctaagcagcaatttttttattaaaaccacaacagcagaagaaaaaaaaaacccttttgatttatttgttttgctttttgaaacaaagtctccctatatggagcagactgtcctcatattgcagaagcaagccagcctctgcctcccaagtactggactaaagtcatttaccactgtgcccacccaaaagcaactttcttttaagtgtcagatccgtaagccttgttatctctccttccagagacaactctgccagctgtcaaggcttcttcctgattcacatttatgtttccaaaagtcgaagtcagtcagaattcgctttagaacttaaaataagaatagacgtgaatggttggggccaaagaatggctttaaggtcagcctggactatccggattaaatactaagaccctaagatcctgtgcatatgtgtgcatttgtgggacagggtggaggtggggtccttccttactgtaaactgcaaacggtgaactgagggtggcttcctgccttctatgtgctgcannnnnnnnnnnnnnnnnnnntgctgcacattcatccctttgagggcgtccaagtggtctgcaaggcccatgctgtgcacctcagctcctgcagcttcacccatagcagtcccatgctccactgttttgtagttgccttccatgttttctaccaccccatgctgtcccattgcctggcctaccactaagaagacctgccctgccctctaggtctcaatgtaaacgtcatagcacagagcgacttctggcacaggtcctcctgcctacctggtctcctgcgttgcatctatcatgtttatagctatttgtcctgcatgcctctccctttacaaatgtcaacagggctgcatgtgatacagcaaacacttggaagatgtttgcttagtgaaagggcagggggtgaaagggcaaatccttcaaaaggaggagttgatcagactgaattgccgcccctccccccaggagcctgattccctgccatgcattgtactctgtgggtgtatgagctattgactcaggcacacattgataaccatcaccacaccaaaccacctagaaagctttaccacacaaatagcttacccgtgcaaggaatgacaaccaaatcttatgaggaaatctagtgttttattagtaatataaataggggatatcatgtgttacctaccatgttctgtggagaatttttttccattttttattaggtatttagctcatttacatttccaatgctataccaaaagtcccccatacccacccacccctgtggagaattttttactgaaatgaatagtgcctgtgtgaatgtgtgtgtgtgtgtgtgtgtgtgtgtgtgtgtgtgtgtgtgtgtgaagcaaagcaactatctatgcccagagaacagaatgtgggatgcattcctataggacatgttcaatccaagtttatttcatggatcgtgagcaatttgatctcccaaggccagatctttgtaaaggaggacggtcttggcacacttcgggtgctgagcaaatgtgtcagctaatgctgatcatttagagcaccaaatggcattcatttgtgaagaggagacaatttgaggagtgtccctagagccacttgcccctagatgtcactgttagggagcatttcctaggaagtccaggaccggctactttgatctacaccggttgaagctaccttgccagtcttaccagtctgctctgtttcctacagctgttatcttgtcctcatatcaaggtacagcacgccttcagcctacaggtccaagtgcatgtccaaggacagaggcctgactcagaagatggccaggaacctggaggttcttgactgaagtccatgtctgctagtgtcaggccgaatccctggctcctgggttgttttaactgcttctgccccatcctccccaccagaggcgcctgcctcaacctccatctaggagtggaatgctgacttcctctttctttgcttcactgagacacagctatcctctctaagcccagccacagcataaaggagaccttaccatctgacaatcttctgtgtggataccttactgttcttcccacttgagcttcctttcctgtctatgggggatggtcatgcctgtgtatgtctgttacctgctgactgtacttcccagcctccggctccatcctgtagttatcatcaaacagtgttcagcacatgtgagacaggacaccgccactgggataggacaaagactccagcgttgttcttgaagaggctaacaggtcttcccagtttaatccccttcaaatgtcactgttctccaattccttgtcattttaaagcagtgagtcttgcccaagatctaacttgtgttctgtacagaaaactttcagccatctcacatgggcaggttattggcagtgtgttgaacatcatgctgggcacaggtgacccaaagcagaggcacagcagcctcgtaagtcagactggcaccacgccatgccaaggaatactttgtgtgacgagtgaatggaaagtggtttgcagagagaataattaatcctgcctggaagataagaaagggctgttcctagaagggagcctttggggatgaattcaatttcatcttgctgatagatgcagggagaggaaggagcatctaagcaggggggggggggggggaagccatgagcaagtacatcagttggcaaaatgcacacaataagtgtttaggaacacaaagtacaactgctctgtctaggagtaagccaggtctctgtggatttttctcttagaatcggagttgggaagggaagtgtccctcaatcgaaacagagcccaggctagggagggagggagcagagcaaagagaactcatttggaacacaactggttaagccaaattaccctaattaatgactaattaggtcaagtaggagatgacaagtgtacctgtcttgggatttttcactctggccaattaacaaggccaggctcagcctcctccattgcagcatgaagattgagtagtctccatctctccatgttacctataagaagacacataggaaagagtaagagtttgaatatgttaaggtatttccctcagatgaagactctcatggggttttcagattctcgggacttggtttatctgttaaatttaatctggaactcatacaaatctaggcctggtgacatggcattgggacaccaatcaagtcatttatgggttagtctaccagcatgaaatgttattcaacacccaagatagtagagccccagtcattttaagcactactcagaatgtcaacaaaggcatccttctaatgtttggtttcctttaaaggattgctgtgtctactttacagtactatggggtaagtgttccattatcttccaagcgtgctctccataacagtcttcttgggaaatttccactggtctcagtttctataaaagcactgcttctcataaatgaggtttggttttgtttttaacttctcaaagttgaatgaaaatatggattagaccgttcctttggctaggaatgtagttgaagatcgtgctttgtaaatatgaaaaacctgtagtttttttttttttaatctctggcctattgtgaatattttccttccttttatcagctacctttaagttacattatttttacttttatatatccaaatacatcacttcaaatttttttggtacaaagctgaaagatacacacacacatacacacatgagggggagggagagagagaaacagagagagacacacacacagagaaaccattctttttttttttttttcactactgttgtgacttctttttttttttttttttttttttaggtatttatttcagttacatttccaatgctatcccaaaagtcccccacacgctccccgacccaaccctccacccttccactccgacttcttggccctggcgttcccctgtactgaggcatataaagtttgcacgaccaatgggcctctctttccactgatggccaactaggccatcttctgatacatatgcagctagagacacgagctccagagggtactggttagttcatattgttgttctacctatagggttgctgatccctttagctcctagattactgtctctagctcctccattgggggccctgtgatccatccaatagctgactgtgagcatccacttctgtgtttgccaggccccagcataatctcacaagagacagctatatctgggtcctttcagcaaaatcttgctagtgtatgcaatggtgtcagtgtttggaagctgattatgggatggatccccagtatatggcagtccctagatggtccatcctttcttctcagctccaaattttgtctctgtaactccttccatgggtgttttgttcccaattctaagaaggggcaaagtgttcacactttggtcttcattcttcttgagtttcatgtgttttgcaaattgtatcttatatcttgggtattctaagtttctgtgctaatatccacttatcagtgagtacacattcttaatacaaactttgaaaaaaattaattatagcctttgtattcctaatgaatttttatctaaatatttgagagacaatggtatatcccattccctggcaaacagctagtttgtgactcatgttcaagtccataaatatggaactactaatttaaactcaataaataagtagcgaagggtcagacactctgtgtttagacataccacagagtgtttcttcctgcattaagtctatgaatcaaccttttctggtttgttaagataaatactaagaatgtaggctggggcaatacattgacttttattttaaaatatatttaatgcatgccttggactagactattattttctcaactgtgtctcttagacagacaggctattttttttttcagtgatgaatatttgacagttttctcctacccctcagcctcagaacctctccctggagtttctgtttcattgtcccagtgtcatttctctacttaactgaatatgcacagttcatctctagggagactggagggtttcagttgttagaaaaagtatccatgtgaccttgaaccttgaacactctagaactgctcttcagtggttaagaattagttggtggcacagatgaaatgagttggttccgtgactagaatgtaaatcaaggcaaggtttgagccctgaaatggtaatgaattcctttgtttccaagatgtgcggaggtggtagcctataaaaacatttctttctttcagggcgtagatgctacaattaaggcatttagacagcaatggaattaggagcagatgtaccacacaggctcaacctatttattagctactaatggagagtatgccagctaatgccaccattggtagtggaatgttctcgacagtaagtagtacatgaaaccaagtcccccagtcagactttcttcactcaataacacacagcctctcacaggcagttaagaagagcaatgtttggaccctggaagaaaaaaaagaagtcactttcaacaggcagtaagttctgtgttctgggtttttccctgagctccccagccacatccttttagccattccaaaccacggacctttgggctgaagcagtgcgaccagggcacactcgcaagccttgtcactgagtataaaggacagaaatgaaacttctggggcttgtgttggtggagcagtacccaaccgtgatccccaaaagataagaagtacctgtagatgcccagtgtgcagcatgctgtgtgtccgtcgtcgtgagccagtgtgaagacagccctttccatacatgtcgcaaaaacaggtagccgcccactctcactcccttcacctgctaaatgaactgtctgtggaatcatttggtggacagtctgcatacgaaactgatgcatttcgcattgggaaatgtgctcaataatgcaattctttgaagtatttagtaatgaaagggaactagttacacagcacttaaatctcaccacagccacaggaaatggacgatactattgtactcaccctacagatgaaaacactgaggtccaaaaggcctctctgattgttaataagaaaggcaaaatctgagttcattcaactaggtgtgaggccggctgttagctgccgttccactctgtcttcaacagaggatggtaatgtctgccctcaagttttaagtttctagagtcagttggaacctagacattctgtctgccaagtacgaaacatgcagttaaattcagggaagacactcctttctcacagaagagcctgcatgtgaaagtcaccactcatcaaacaagctaaaaccaacaaaaacccagtcttgcagccgggaatgcagctcactcatacaatgctcaccggctatgcacgaggttctgagttccctcctcaacaacctccagaagatgatagctcatatgggtgggatggcctccaagagacacaggaccctgtccttttcccactgtggatctctttgggcacagggatagttggatttacttaccatcaactgaaagtatttcatgaacacctatggattagggtaacagtgactttgtctggacttaatttacctccttgaagtttttctattaaaaagagattgacccccacagtgggctcacacatcaggagatttgcctggagcctctagtgtatagaagaataggaaataattaaaaatcaaaatgtacttctggttccaaatcaaaagacgtccccctaagtctgtgtgaaaagcacaagagttggcaaattaatgagtctgtggcctgaggtgaagtctgcactcagcttctgtaattaccaagaaactcgagatgccttggtggcgttggataagcaaagaaaatgatttctgggcatcagaggcgtcacttggaatgcaagagcactaatgtactggggctgccaccaggtaacagttaaaatctgggctgctgctgaaacatccccgagatgctttggggactgtgttagcccttctgctacagtgagcaaaaaggagattctgagttcaggaaggaaagatagggactaacatgtctggcatactcaggctgtgcagcctgctgtgcctgtattttatataaattgccttagttggatcagaatgatctgggtcatttgattaagctagggtaaatatgtccaccctccactgtccagtgtgatgcaggcctgacctctattgtcattgtggtcactgtgccacatgtaaatgttacagtgttatggtttgagaccacacctacatgcatcttgatactcagtcctgggctgacagcactgtgtgggtaaagttgcagaaccttaggacacacagtacagctggaggacacatatcttggaaggttatgtctgtttttggttccaagctgagttctcagattcctgtctgccgcagtgtgaccaggcagtcacctcaagctcctgctgtgctctcttacttacagtgatagactatcactctgaagccattagctgaaacaaatcctttctcctttaggatgtgggcatcttgtcatagtaataaggaaagaatgactagtagatacaaagtcatcttgtgttaactgacaaagatgtgaggatagccatatgtcctctcagtcctgcttcatatcacactttcacttgtttattctccactagctcagagactcaggaagtatggttgaggtagtgtgcttcagcctccctatccatcttttataacaggacattgaagttgccttcttcttcttcttcttcttcttcttcttctccttcttcttcttcttcttcttcttcttcttcttcttcttcttcttcttcttcttcttctggcagcactaagtggacttttattggatattttctttatttacatttcaaatgttatcccctttcctctttccccctccaaaaaacaccctcccctcatcccctccctgctccccctgcacaccagcccatccactcgctcttcctggccttggcattcccctatactggggcatagaaccttcacaggagcaagggtctatccttccattgatgaccgacaaggccatcctctgctacatatgcaactagagccatgagttccaccatgtgtgctctttggttggtggtttagtccctgggagctctgagggtactggttggttcatattgttgttcttcctatggggccacaaaccccttcagctccttgggtcctttctctagctccttcattggggaccctatgctcagtccaatggatggctgtgagcacccatttctgtatttgtcaggcactaggttgccactttcttgcatgatgttcttaagaactttcttttgtacgtaaattcatggaaaaggcgtccaaattgctaacagttcagttcctagcatagaagtatctgggggaaagcatagagaatttttttttcaagacaaggtttctctgtgtagccctggctgtcatggaactcactctgtagaccaggctggcctcgaactcagaaatctgcctgcctctgcctcccaagtgctgggattaaaggcatgcgccaccactgcccagtcatataaattcttttaaacgtcaaactttgaagcatatttcagccagaacttttcacctaatttaggtgtacagttctgaggtttgaccaatgtggcgtttgacctccacagctaagtccctatcacaacagcaactatattatcgtgtccgtaaagtcatgctgtgccctcctatcacttcttataggtgaacaggttctatctgtaagaaactgagagagtaaaacctttccattgcctgtggaatgtttctgccttacttcatgtttgttggttggcttgctaattcacattcttcaaggtttttcatctgctctcctgtctttcagtgtgagtttttgcatatccttgcctgtactttaggataggactgtcatgtgtcacattgcataaatgctttctttgtgagtccctgttaacaattgattgtatgtgtttacatctctataatttctccatgtttttccaccttggtaaagcaccttcctcatcctgattagttcaatatttggactctttctgtacaaacctttgtttcatatggaatttcttttgtcttgtctcagggagtgaaattttaattttatttaccctgaacaatgaattggttatccagaccccatttaccaaagaatagaccttttccccactaatcttcaagcttgtcttagttacatcccataattgctaggcactcagttgtgtcttcacactttttactctgttccacaaaatctcttgcctttgttttaaataataagtactatttcacctttttttttaatagcttcaaaaatgattttgggtttttttgtttgttttgttttgttgttgggtttctactcccttagaattagaaacagggatggctgtgagccatcatgtgggtgctgggaacagaatccgggtcctctcaagagcggacagtgttcttaacctactgagccatctctgcagccccataaaatgctttactatctgttgtagcgagcacagcgtctcattactgtgatctccaaaaatgtcttctcagaccctgactaagctgaacgaactaaaactcatacttgaatttaattagtgaggatttttactgaaatatcaccgcttgtagattagcccaagcgtaataaatatcctgagaggagttttctttcagagaaacatgctatgttatctcgtgtattcaatttttcctttatataacacaagagaattctacagtttcttttatttttaagatttatttatttatttattttctatatcggagtacactgtcattctcttcaatcggatccattgcagatgattgtgagccaccatgcagttgctgagaattgaacttgctggaagagcagcagtcagtgctcttaaccactgagccatctctccagccccatcctacagtttctttcagtgggttctccacaagtttgtgatgtgtttattctaggtatagcattcatcttgttatcaatattcacagcagctgttgtttttgtttttcatgatacttgccaactggtggcgactatttaaattattttttcatttcttactatctgtttttataaaaacatttgcatgagtggatagatggtttagttggaaagcacttgctgcaggagactgaggatgcagttcagcccctagcacccacataaaagatgatcatggtggcacaagcccatgacttcccagggctgaggaggaagagttggatggattctagcgtctgctggccaactggtctagatgaattgctgagcctcaggacccaagagagactgtctcaagcaataaggctgcaagggactgaggaagccacccaaggtcttgacactgatatctggcctctacatgcatacacaaatacacaaaacataatttactaaaagctgattataataatatttgaattttctttccctcagagatccaagaaaatgaacatttttacatcctagtcattttatctccacttttctgactttatacttcatttctttttctatttttttttaattttctggcatttaaaattttttaattatttttataaaatccagtacttcacactattacattttaatgtcatattcattttcatagtttataaaaatcacaaatggatgctttttgtgactatagttatggtcagaaaatcttaaagtgtgagcatagatcctattagtatggtgtaggagggttttggtttatttgttcatttccttcttttactttttttttcagtatcttaatatgaaatatttaatctataatcatctgccttggttttctgtacatgttctcttccaggtcctgatgtttaggttgagtcctgattttatgggactgagcaccctctacctttccctatgctgtaaaatatgcaatgacacagatgggctgctgcctaacaggaaggcaagacttgttgcctgccaaaggcagttatggaggcaacagccttcgagtctgtctgcctttctccttttgtttgctttagtttagttcttctttctcttagtttcttgaggcaggatctcacggtaggccaggcttatctggaacttactctgtagcctaagcttgcccggaactcgcagtgatcctcctgcctcaacctccagagtgctgagatgacagacttaaagtcaccaatgcttggctaactagcatcacagtttttaaagcactctcttttgctcagtgctggaatttgaattaaaatccctaagctcattcaagagtttagaaaatcagatggtgaaaagcaaattcacctgtttcttaaaatacaataaattgtaagatagatagatagatagatagatagatagatagatagatagatagatagatagatggctaaagtccccccatttctttggatttcattagctcttggcaaacattacttttactcacataaagcttactgattccaatatagtgttcaaaagtgagtgtctcagccctcttcagataggacagttgtttctacctttgatctcctagcaaggaacttgaatctgaaaggtacagcaaccaatagcatgagatttgtgcgtcagctggttctccttgcactcactggctggaacacactgatgggtagacaagatcctaaaaatagtttatgttcttgtcacactttttacctgcagcagagacctgccttgttcacaaagagttctttgcatgaacagaaacatgtaaattccagcacagcctgaagttttcagaacccgcccttgatcgcagccaaaaggcacaatcaacccagagcatttaaagtccagctagaacacactgataatggcatgtccttctcctttgtccaggatgtctgtgttagagcttacctagctcttcgccatcacacaaacctgttgatcatcttgttctccatgatgctgatgacaggaatgccccagctgacaagcaaagaggacattgaatatatccgggatgccctcaccgtgggaaaaagcgaggaggacgctaagaaatatttccttgatcagatcgaagtctgcagagacaaaggatggactgtgcagtttaactggttcctacatcttgttcttggcatcaaacaaggagaaaagcactccgcttgatatgtggtgctagggcccaaagcaatgtagtgttctggagcttttagatcagcatgtcaatcatcagcgttaagatttaaaacgcaataagactctctgaacactgtacttcagaaatccagctctttccccagctgaactcttcaccagaggggaaaaaaaatgttggcattactgatggtttggttaatattcagtgcgaggcttctctgttccttttccctcctctcagtctccatgatgttgaagaatattctcagtttaaatagcttagagcagccttgcttagtatgcctgacgatctcgtattgagtatctctgaaagccctttagttagaataactggcaatacctgttttctcgtgtgtccaccatgtattttggctctccttgtgttctctaagctcttggcagaaaaaggtgcaagcattgctaagctctgctgcattctttaaagggtgtttctaagcatcccctcagtgcccacagagcaaggaatgcaagttagctcatagaataccagagtactgtcagcagtttgtttcccacagtataccactgagatgcccaggcactgaacacaagctctgagcctgagccttgcccctccccagctgctgtggctctagggttatggacgtgaaaagtggaggtgacaccttttaccaagagcgaataacctattacagccagtgtcatcttctcctgcacaaagcaggaagtcgctagctggacccctggatgcccacaaatgtcatctttccctcttgttctgttcccccttacccatgctgcaacacttcctgtacttcttcctggacttgtggactcttcaaagacatctcaaaatgacttgaaaaagaaagtctactctaggctcaggagagttataggtacgtatttgtggagccgctccatggatttttaaaaagaatattatttaaaaaaaaaaaaaagagttccagaaaatactagtttctaaatgctttaattttacattttaaatctgagaagttttttctttattttttaatagaagatacctgctatcaaatgtattctaagcttataacaatacttattaggtattcattttttcagtttaaaggactttaaattttgaggcatcccagagttcataaagacaattaaaccaatttcctttgaagtactttttcatttcttaaatattatgctgtttgtcatcagtgttgatccacctttgagaggaatcagtaaattatttaatcaaatatctttagctatcattaattccatagaaagaaagatgtcaaagatgtccatatttagatataatcagatataactctttctgatttttaaattgtcaaaatagacacttccattagaaggaacccaacattccctttgtgtctccagaagccaagtagcacctaattctgctacaaataagaaccatcagggacactttcaacatagccttgcattttaaagtcaccccactttcagattataatttcattagtgtgaatgagcctgggtatggttttctaagcactgtggctgaatctaacacacatgcaggggaaggaggcttatttggtgcgtgatggtataggtaaccctgcctccttgcggactggaccttccctggctcataacgagctacaaaaacatctcctcatccctgggaagtaactgttctaaaactacgctgtctcctgtacaggccatgccctgtgctgaaactgtgcttctctctatgaatgtaattttatggcatttctggagtgtgattcctgctaatctaagaacaggacaaataggacgcaagcttaggcttctaaagaaccatacacagactctgcctttcatttgaattgctgaaacgatgatcttgatgataaaacaattacggagtatatctatacttagcttccgacaccacatgcatacatattagttctttaaatgagccagtcttttcataaggctgaactacatggcgccgtagactgggtttcattcttccatttcccaaagaatgcaatttcaactccatagacttgcatataagtaaaagccaccttcatatgctaccttgccattcctgtgagtgatattgtccagtgatttctacacctttgaaaataatctagacctagggtctccaggtaaataccaatatctctaccttcagtgctgagtgaagaaaacagatcacaggtcagatggatcgggttaaagcaacttatgtgtgtatttaagacaacaaaagacacaaagcttccgttgtagacttggtccaatatgactctactggttttggtggtgctctgaaaaatgcagaaagacattatgaataaaatatatcaaccagaaaaagaaaaaagctctagacttgcaaataaattaagtatagtaagtccatctttttcaggagacgagttgttttggttttattagttctttgagaattgtgtacaaagagttttgaccatatgcacccacttccccaacatctcccagattcaccccctttccctgcccacccaattgtgtcctctcttttttttttctttttgtccatcaatggcaacactcttcaagaatacttcctctctccgcagctatcaattgccaacagttcttggctaggggtggaacttcatatccacctcccctctccatgctgggatttggtgcacgcgccctgagctttcctggggcttgtcctagctgctgtgagttcatatgtgcagctgccctgccatgtccagaggatcctgcttcctcgtattcgttcaccacctctgtctctcaccgtctctccaggtcctcttccaatgatcactgagccttgggaggagatggggaggtaatagatgctccatttagggctgagtattctgcaggctcttactctctgcaccaggactagctatgaatctcagtggtgatcatcatctatgcaaacagacactgctctgatgcaggctgagagatatactaatctatagataaaacagcaagtcatgaagggtcattttgggaattctatagcatgatttggaagctgttagtcctatattaatgacaattgaatataatcttaaataaaaaaaattagaaaaaacatttctgaaatcatcagcaattatgtttaacaacgtgaagaaaataaaatgagctaggatttcttaatgattgtgtaggcttatttccatctttatccaactgaataattcttctgagcacatttgattctagccttagtgcttgttcacatgttctcaaaggctcatttaaggacagatgccagggaactctaaagcacagcgtggctagccctactggaagctaagacggtctcctggattttaattacaaatgttaatttaaattgaaaaaaaaaagaaatttgacatcttgtgtatcttttaatgtttaaacttccaaatgtttctgaaactcattttgaaactgaaacttattttaagaaatcgttattgaatgctcattgcctacgagaaactgcacagtgtgccgaggaattgaggacgcaacaagatggactgagtcccagttcctactcgtgtgtgtgtgtgtgtgtgtgtgtgtgtgtgtgtgtgtgtgtctgcactggtgcgtgtatgtgatatttgtgcatgtgtatgggttcctgtggatatatgcacatgtatgttctggtgcatatgcatatgtgtacctgcatgtacaggccagtggtcaacactgggtgccttcctctattatactccatattaattttcttaagacagactctctcactgaaactgtaggtcaccaattggctcaaatagttgaccagcaagctgcagaggacctcctgtagctgtaacctttccaaccctcttaactgatgctggggttattcatgcagactattgcaccctgcttttctttctgggaatacaaactcaagtgttcatgcttgtgtggcaagcacattactgactaaaccatctccctaaccccaatgtagtattggcaatgagtttcaggtcaatgattttctttggggaggggcagcacccgaatgcacacacacacacacacacacacacacacacacacacggcaagctttctatggccaagcaacaatcccagtgagcaatttacttcttagtaggttttttgtgagttgaattttgacccacccccaagacagacatggaaatcctagctctagtatctgtgtaatcttacgtggaaacagattatatatgtatattcaagttaagatgtgtttaaataactgatatccttaaatacagagaagtgacacatgaggcaagcacaatattggaatgaaccttctgcagaccaaggaaattggagggaaaagacacagaagatcctccctaagacccttcctaggatgcatggccctgccaacattttgattttggagttctggcctctagaactgtagcaagatctatttctatcattttaagccacccagtctgggatacttggttctgatatccttagggtactgattccaagtgaataacaacattccatggaatcatatcggatgagtatcccagaagttattgatgttttctgctactgtcagaacaatttaaacatatataaaccatgataataatgatgagaaactctaattcagtgggtaagaaataaatacttcttgaaaatatcgaatttccagaagaataaaatgcgtgtgtccagtaaccatgacagcaaacccaatacattgtttattaaacatgtacaatcaaaataacttaggatcatcttccatcagcaactattagttactggccacgtctggtgctgacttaaggggaagggtacctcaacaaagtaatgacatttatcacacgtactgtttctattctctgcttcagccggtccacatccaagaatttgtccatcagaaaggatgaagtgtgtgaagactaatcatcagaaatagttacaaggagctggggaaacagctcagtggataaagtgtatgctgtgcatacataaggacctgctcagccccccagcacccaaataaaagttgggcatcagagtgtgtctataagaccagtgctgaggagcagaggccgggacacagagttctctctggggccagttaaccagccaatttagcagaatttgtgtagtgttcccttgaaggcttcacagcggtcaggggaaaatgatcaggactagataagaatggaactcggttcagcctgattttattgtaaccagcgctaaaccagaacttctagagtctggctcagatcgttttactttaggtatatttaagcccagcacaattgggggcaggggtggggggagaagaaaggtattcagataacaactcagtcccaagttcacaacaattttaagacatgtttgtattgaggctttttgcaaagaacatatggcttcatccataagatgacttcttgttgacttggaaacaatgttcaagataaagttgtagggagaacaattgatgtaatacataatgcctgtgggggccaagattggtctggctcgaggataacacagaagacacttgggctgttgtaaagagcaagtgacatcacgcataaaaatgagtttaatggtctaagagcaatgcttaagatctagtgggaaagggtctgggataagttaatactgggagacatgggcagagcctgtctcatcagacagcaaaggaccaccaggctgtaaaactccatcattcctggcactctaggaagaaacagttgtgcacttcattccattgaagaggtgagcagtgcgtttaactttcctggcttctccagtgcttctctgtgtgcaccaggcccctttgcctgctgcagatctgtaagcttcaggttgtaaaaggcctggcctaaaaaaattaagatgaagagtaataaaggatacctgatgtgtagactctagtctacacatgtgcacgtgcgcacacacacacacactaaaataataataataataaaagagaataaaaatagtcaccatacttctttataataactaaaatttgcaaacagcccttaaagtctctctacaggagatcaattagctaagtgccattgaattaagagctgggggatgtggctctaattgatagtgcttgcctagagtgcacacaagtgaggcttcaaccacttgccctgaataaactagatatgatggtgcacacctctaatcccaacgtgaaagttaagggcaggaggatcagacattctaggttattctctaatacttaaggagtttgaggccagcctatgctagatactctgtctcaaaaattaatttaaaaatgtaagtggtggtaagtatgtgcatacataagaagtttgggagtatatatatatatatatatatatatatatatatatatatacatatactcacactggtgtttgtttttgtactagggaattgaatctaaggccttacacatggaagacaaacactaccaataagctgtatcttcagccatttttatttttatttttatttttatttcactatatagccctaagttacaggggcttgccttgaactcacactgtaacccaggcagaccttgagcttgggatctttctgcctcagcctcctgagtgtctgggagctatagcttatactattaatagtgatagttttttctgtgcattaacttttttcatttggatttggggacgtttcgagtttcttaaccaggagaaattaatattttcattttctgggaaaaaaaagatgcattccaaatgacaatcgtctctttgtctcttaacgtagatcatgctgcactaaaagctcaaagggcggcagagggactaaatttgaaggccttattatcaagcagtggcttcaaagctattgttggaagttgggatttgaaaacagggaccttgaaatcttcagccttatccctacctgatggtgatcagtcactgctaaaactggccttgatctctgttcaacaatagcagtgctttgaagaaggtgccacctgccactatgtcagtcaggagagtcctgcttgctgcagctcttcccaactgcagacctggtgctgcctgtgtggtcctgctgggctttccagctcgcatctgaagtcccctgaggaggtgcaaacagcctgttttcactccttgttaatgtcagattcttttctaagcatttgctcattaacacaactgagtaaatcttgctgcctgctgctttagtaggaattatcccctaagcggggctcggtgtggttctgagtcagggggcctgtggcctatcaagggatgcaaggccactttgcagtgtggagcagcaagcaccatgtgcctctcagcagaggaacaatcgcctggcaatcgaccccagaatcttctagttttactttagaattaaaatagcttcctattgtctggcagaaagccacccaccatttccgaccattgcaaggtttatggttgaacagtgctttctgcaacctgatgtgtttggtaggtaagtctacacaagtccccactgcacacacacacacacacacacacacacaccacctttcctctgcaccatcacaaagcacttgttctgttaagctaccagccctgtggctacaaagggcttcccctgaggaagtctcatagccacaaagaagtaccaaacccttggactacccccaccccaccccgttctcaccccagctgtgctcagtccacagtttcacagttctagacaccagagaaaacagcctctcactttaagagcaactccttcctcaggtactaattgctcaacgtgaatggacacatttgccggctttcagtaagtaaataggcttggcgccttaaacctccagaaatttaaaagattctgaattcttaacagaggaacctttaatggccaagaagcacttaagaaatattcaacatccttagccatcagggaaatgcaaatcaaacgactctgagactccatcttacatcagtcagagtggctaaggtcaaaaactcaagtgacagcagatgctgacaaggatgtggaacaaggaggaacactcctccattgctggtggaagtgcaaatttgtacaaccactttggaaatcaatttggcagtttttcagaaactttggaatagttctactctaagacccagctataccactcctgggcatatactctaaagatgccccactacagcacaagggtatgtgctccactatgaccatagcagcgttattcataatagccagaaactagaaacaacctgatcccctcaactgaagaatggataaagcaaatgtggtacatttacacaatggaatactattcagctattaaaagcaaagacatcatgaaatttgccggcaagtggatggatcttgatattctcatgttgacccaaagaaactaagtaacaaggaggccctcagaagcagaaacaaaatagtcatgggtagtgaatagagagaaggaactgggtgagagagggtgtgaggaggggaacaggggtgaggttcagatgtggggagggggtgaaggagagggcttgtagtgagaacagaaatcgatgaggagcatctctggaactggctggagatcttggatggaggaagctctgaggaatctattgaggtgatcctagctgtgatttctatcagtggtagatatggagactgaagtggccacttcttgtatccaggcaggacttccagtggagggaaggggacatcaacccacccacaaaaccttcttcaacccaaaatttgtcctacttacaaaatgtgcaggaataaagatagagcagagattgagggaatgaccaaccaatgtctgtcccaacttgagacccatcccatgggagagagccagcccctgatgctattaatgatattctgttatggttgcagacaggagcctagtataactgtctcctgagaggcttcctccagcagctgatggaaacagatgcagagacccacagccaaacatcaggtggaggtaaagaagccttgtgaaagagtgtgagatagaattgagcgagccagacgggtcaaggacaccacaagaagacctacagagtcaactaacctgggcccattgggggctcacggtgactgcctcaccagccgaagagaatgcaggggctgtacctaggccccctacacatttggagcagatgtgcagcttggtcttcatgtgggttacttaacaatcgaaatgggggctgtctctgactttgttgcctgccattgggtacccttcccctacctggactgcctggttgggtctcagtagaagattagtcttgctgggactagatgtcacaggcggagatggtactcaaaggggagcttccccttctcatcagggaaggagaggggacaattgggggagcgactggtaagggtgggactgggaagagaatagggaggggcctgaaattgggatacaaaaatgaataaataaattaatgaggaaaaaaataactaaaagattccgagagtcactgatccaggaagcgatgcagagtaaacagattaggttgagaacacagcatagcaatttagaaaaatttattttccagttggaggaagggaggtagtagcaatttaaaatagatgggacaggataaagagtgggtacagactttggtgttaggtcatctaaaaccaagaggcaattttcatctgaataagttatcccatctcttcactgttgactgttgtatttacagtacagcacagagacacagtactgactttaaagatttgctgtccaattaaatgaaagactaaatgagaagagtaggtgggtctacagtctggccaggagttatcactcaataatgttacctattattgagttgttcttttccaagaaagcctgaagaatcttgggaattggggtatttggtgggtccatccttggtgtgtgacttccaggagttctttacagatgtttctccgataaggcttcaaagcaaaaataatttccattcaatatcagataataagaaatcttcaaaatagtgtcaagcttctctgaagaactattctaatccatgcaaattagcttctggttctaggcctattacagattaaacagagacgctgcaattagttttaaatgctactcttcttcaccttttttatcagcatgatggaagatttacctatgtgaaattcactaatttttaaatgtataatttgagtgagtgttggtagacctatatgcttacgtatttgcaaccatggtcaggattaaaaaaataataatttcattattccagaatgttctctcatacttctttgcagttaatcctcttccatgtctctctttttaaaaacttacttttattttattgtatgggtgttttaaccactgtatatatatacatcatgtgcatacaatgccagtgagtgccagaa

SEQ ID NO: 1568 - DNA, 4084 bp, Mus musculus
cagtaacaccttccttctcagctagaatctttttgtctggatccattgccggttcaagctgagccaacccccgagcgtctgagtttccttgtctcgccgcgcttagactgtgtacatccacaaagttccgtccagcaagggcttgcaggtgcactagttctttctgtttttgtttgtgcggaaaggggcggccacagagcccgtgacggacaggctccagagtcgaccaagtgcttgcttgggaattctgtccagacagtgtttttgtaaaaggacaaagctacttagtcccagccatgaggaaacccagtcgcatagggcatggagctggagaactatgaacaaccggtggttctaagagaggacaacctccgccggcgccggaggatgaagccacgcagcgcagcaggcagcctgtcttccatggagctcatccccattgagttcgtactgcccaccagccagcgcatcagcaagactccagaaacagcgctgctgcatgtggctggccatggcaatgtggaacagatgaaagctcaggtgtggctgcgcgcactggagaccagtgtggctgcggagttctaccaccgattgggcccggaccaattcctcctgctctaccagaagaaaggacaatggtatgagatctatgacaggtaccaagtggtgcagaccctagactgcctgcattactggaagttgatgcacaagagccctggccagatccacgtggtacagcgacacgtaccttctgaggagaccttggctttccagaagcagctcacctccctgattggctatgacgtcactgacatcagcaatgtgcacgatgatgagctagagttcactcgccgccgtctggttacgccccgcatggctgaagtggctggccgggatgccaaactctatgctatgcacccttgggtaacgtccaaacctctcccagactacctgtcaaaaaagattgccaacaactgcatcttcatcgtcatccaccgcggtaccaccagccaaaccatcaaggtctccgcagatgatactcctggtaccatcctccagagcttcttcaccaagatggccaagaagaagtccctaatgaatatcccagaaagtcaaagtgagcaggattttgtattgcgggtttgtggccgcgatgagtacctggtgggtgaaacacccctcaaaaatttccagtgggtgaggcagtgcctcaagaacggagatgaaatacacctggtgctcgacacgcctccagacccagcccttgatgaggtgaggaaggaagaatggccgctggtggatgactgcactggagtcaccggctaccacgagcagctgaccatccatggcaaggaccacgagagtgtgttcacagtgtctttgtgggactgcgaccgaaagttcagggtcaagatcagaggcattgatatccctgtcctgcctcggaacaccgacctcactgtgtttgtggaagcgaacatccagcacgggcaacaagtcctctgccaaaggagaaccagccctaagcccttcgcagaagaggtactctggaatgtgtggctggagtttggcatcaaaatcaaagacttgcccaaaggggctctattgaacctacagatctactgctgcaaaaccccatcactgtccagcaaggcttctgcagagactccaggctccgagtccaagggcaaagcccagcttctctattacgtgaacttgctgttaatagaccaccgtttcctcctccgccacggggactatgtgctccacatgtggcagatatctggcaaggcagaggagcagggcagcttcaatgctgacaagctcacatccgcaaccaatcctgacaaggagaactcaatgtccatttccatcctgctggacaattactgtcaccccatagctttgcctaagcaccggcccacccctgacccagagggagacagggttcgggctgaaatgcccaatcagcttcgaaagcaattggaggcgatcatagccacagatccacttaaccccctcacagcagaggacaaagaattgctctggcattttcgatatgaaagcctgaagcatccgaaggcttaccctaagctattcagctcagtgaaatgggggcagcaagaaattgttgccaaaacgtaccagctgttagccagaagggagatctgggatcaaagtgctttggacgttggcttaaccatgcagctcctggactgcaacttttcagacgagaatgtccgggccattgcagttcagaaactggagagcttagaggacgatgacgttttacattaccttctccagctggtacaggctgtgaaatttgaaccgtaccacgacagtgcgctggccagattcctgctgaagcgtggcttgaggaacaaaagaatcggtcacttcttgttctggttcctgcgaagtgagatcgcacagtccagacactatcagcagaggttcgctgtgatcctggaggcgtacctgcgaggctgtggcacagccatgttgcaggacttcacacagcaggtccatgtgattgagatgttacagaaagtcaccattgatattaaatcgctctcggcagagaagtatgacgtcagttcccaagttatttcacagcttaagcaaaagcttgaaagccttcagaactccaatctccccgagagctttagagttccctatgatcctggactaaaagccggtaccctggtgatcgagaaatgcaaagtgatggcctccaagaagaagcccctgtggcttgagtttaagtgtgctgatcccacagtcctatccaacgaaaccattggaatcatctttaaacatggtgatgatctgcgccaagacatgttgatcttgcagattctacgcatcatggagtccatttgggagactgaatctctggacctgtgccttctgccttacggttgcatctcaactggtgacaaaataggaatgatcgagattgtaaaggatgccacaacgatcgctcaaattcagcaaagcacagtgggtaacacgggggcattcaaagatgaagtcctgaatcactggctcaaggaaaaatgtcctattgaagaaaagtttcaggccgcagtggaaaggtttgtttactcctgtgcaggctactgtgtggccacatttgttcttgggatcggtgacaggcacaacgacaacattatgatctcagagacaggaaacctatttcatatagacttcggacacattcttgggaattacaagagtttcctgggcatcaataaagagagagtgcccttcgtcctaaccccagacttcttgtttgtgatgggatcttctggaaaaaagacaagtccacacttccagaaattccaggatgtctgtgttagagcttacctagctcttcgccatcacacaaacctgttgatcatcttgttctccatgatgctgatgacaggaatgccccagctgacaagcaaagaggacattgaatatatccgggatgccctcaccgtgggaaaaagcgaggaggacgctaagaaatatttccttgatcagatcgaagtctgcagagacaaaggatggactgtgcagtttaactggttcctacatcttgttcttggcatcaaacaaggagaaaagcactccgcttgatatgtggtgctagggcccaaagcaatgtagtgttctggagcttttagatcagcatgtcaatcatcagcgttaagatttaaaacgcaataagactctctgaacactgtacttcagaaatccagctctttccccagctgaactcttcaccagaggggaaaaaaaatgttggcattactgatggtttggttaatattcagtgcgaggcttctctgttccttttccctcctctcagtctccatgatgttgaagaatattctcagtttaaatagcttagagcagccttgcttagtatgcctgacgatctcgtattgagtatctctgaaagccctttagttagaataactggcaatacctgttttctcgtgtgtccaccatgtattttggctctccttgtgttctctaagctcttggcagaaaaaggtgcaagcattgctaagctctgctgcattcttta

SEQ ID NO: 1569 - protein, 1103 aa, Mus musculus
GMELENYEQPVVLREDNLRRRRRMKPRSAAGSLSSMELIPIEFVLPTSQRISKTPETALLHVAGHGNVEQMKAQVWLRALETSVAAEFYHRLGPDQFLLLYQKKGQWYEIYDRYQVVQTLDCLHYWKLMHKSPGQIHVVQRHVPSEETLAFQKQLTSLIGYDVTDISNVHDDELEFTRRRLVTPRMAEVAGRDAKLYAMHPWVTSKPLPDYLSKKIANNCIFIVIHRGTTSQTIKVSADDTPGTILQSFFTKMAKKKSLMNIPESQSEQDFVLRVCGRDEYLVGETPLKNFQWVRQCLKNGDEIHLVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFAEEVLWNVWLEFGIKIKDLPKGALLNLQIYCCKTPSLSSKASAETPGSESKGKAQLLYYVNLLLIDHRFLLRHGDYVLHMWQISGKAEEQGSFNADKLTSATNPDKENSMSISILLDNYCHPIALPKHRPTPDPEGDRVRAEMPNQLRKQLEAIIATDPLNPLTAEDKELLWHFRYESLKHPKAYPKLFSSVKWGQQEIVAKTYQLLARREIWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLQDFTQQVHVIEMLQKVTIDIKSLSAEKYDVSSQVISQLKQKLESLQNSNLPESFRVPYDPGLKAGTLVIEKCKVMASKKKPLWLEFKCADPTVLSNETIGIIFKHGDDLRQDMLILQILRIMESIWETESLDLCLLPYGCISTGDKIGMIEIVKDATTIAQIQQSTVGNTGAFKDEVLNHWLKEKCPIEEKFQAAVERFVYSCAGYCVATFVLGIGDRHNDNIMISETGNLFHIDFGHILGNYKSFLGINKERVPFVLTPDFLFVMGSSGKKTSPHFQKFQDVCVRAYLALRHHTNLLIILFSMMLMTGMPQLTSKEDIEYIRDALTVGKSEEDAKKYFLDQIEVCRDKGWTVQFNWFLHLVLGIKQGEKHSA
